United States Patent 11,098,302 (IDENTIFICATION OF POLYNUCLEOTIDES ASSOCIATED WITH A SAMPLE) - sequence listing, part 75

SEQ ID NO: 257576 - DNA, 1007 bp, Homo sapiens
  misc_feature: GYAE6OF02I268A.34.14.B03.1.454.CMB.1.raw
  modified_base (232)..(232): a, c, t, g, unknown or other
  misc_feature (232)..(232): n is a, c, g, or t
  modified_base (258)..(258): a, c, t, g, unknown or other
  misc_feature (258)..(258): n is a, c, g, or t
tcagtacacgtgatcacgaccggtgctcgatttagtgtgagtagtttgggtttgagtgactcctgtgccccaccatggacacactgtgctccacgctcctgctgctgaccatcccttcatgggtcttgtcccagatcaccttgaaggagttctggtcccgacgccttagggtacaaaaccccaaacacgacccctcacgctgaccctgcctacctttctcgttggttttccncacctcacctaggtagaaaggaaggnggtcttggtcggcccgttggggtcccctacgaaccggaccccccgaaaggggaaaccggggtccccgttagggtaaccgttttcccgtaacggtcccggttaccgttttaccgggttttttaaggtttcggggggttcgtaccgttagggtacgttacgggaacggtcccggtaccgttaaccgtaaccggttacccctaaagttcccgttaccgttaaggtaaaaccggacccgtaacgggtcccctaccgtaaaccctacgtacccggaaaccggtaacccgggaaaccccctaaaaaccccccgaaaaacggtacgggtacgtaacctcccgtaacggtaacctaaccgtacgtaaacccgttaaacggtttacccgggaacccgttgggtaccgggaaaccaaccgtaccggaacccttaacccgttaagttttacgttacggtaccgaaccctaaaacccgtaaaccccgttaaaacccgtacgggtaccccgggttaggggtaacccggggttaaccttttaaccggtttacggtaacccgtttaaccgggtacccgggggggtaacccctaaccgggggggttaacccctttacgggtacccgttaaccccggttcccgttaccccgttaaccggaaccccggtcccccgttaaccccgaaacccgggttaacccggggtccccctttaaacgggttcccccgggtttacccccgttttccccccgggacgggttccccccg

SEQ ID NO: 257577 - DNA, 732 bp, Homo sapiens
  misc_feature: GYAE6OF02J0RWM.34.14.B03.1.454.CMB.1.raw
  modified_base (721)..(721): a, c, t, g, unknown or other
  misc_feature (721)..(721): n is a, c, g, or t
tcagtacacgtgatcacgaccggtgctcgatttagtgtgagtagtttgggtttgagtgactcctgtgccccaccatggacacactgtgctccacgctcctgctgctgaccatcccttcatgggtcttgtcccagatcaccttgaaggagtctggtccgacgctggtacgaaacccaaacagaccctcacgctgacctgctaccttctcttggtttctcactcaccagtagaagaagaggctggtcggccgtggtccgtcgacgccccgaagggaaacgggccgtaggtacgttccgtacggcgtcttacgtttaggttggggtgtcgtaggagtgacgtcggtctacgtacggtacctattcctcgtgaacgaccgaggcctccaccactaccgaaccgaaccggtaaccccaaaccccaaaaacgacggtagtacgtccgtacgacgtacgtacgaacgtaagttccgaccgtggacgacaccgacgacctaaccgttatttacgttcgtacgaccaaccgtaaaccctaaaccggtaccggccgggttaaccggggtaccgggttaaccgtttacgttacggaaccggttcggtaccggggacccgggacggggtaccccgttacggtacccgtacccgttaccgtcccgtacgtaccggtccctaccggaacccggtaccggtcccgtaaccggtttcccggtacccgtttcccccgngggttcccccg

SEQ ID NO: 257578 - DNA, 867 bp, Homo sapiens
  misc_feature: GYAE6OF02FNXEX.34.14.B03.1.454.CMB.1.raw
  modified_base (226)..(226): a, c, t, g, unknown or other
  misc_feature (226)..(226): n is a, c, g, or t
  modified_base (249)..(249): a, c, t, g, unknown or other
  misc_feature (249)..(249): n is a, c, g, or t
tcagtacacgtgatcacgaccggtgctcgatttagtgtgagtagtttgggtttgagtgactcctgtgcccaccatggacacactgtgctccacgctcctgctgctgaccattcccttcatcgggtcttcgtcccagactcaccgttgaaggagtctggtccgacgtctggtacgaaacccaaacacgaccctcacgctagacctgcctaccttctcgttagtttcncacctcacctagtagaagacggnggtctggtcggccgtcgggtcctacaccggtaccccgaaggggaaacggtccgtagggtactttaccggacgtccgtcgtttaacgttttacgggttcgggtacgtcgtgaagtggacgcgtactacgtacgtacctagtcctcgaacggtaacgaccgtacggtccgtaccaccgtacgtacccaaccgggaaccgaaacccccaaaaacccgtaaacggtacggttactaacgttaccgacgtaaccgtaccgttaacggaaacccgtttaacgggtacccggtaccggttagggaaccggtacgaaccctaccggtaacccgttaacgtttaacgtttacggttacgtacccgaaccgtaaacccttaaaacccggtaaacccgtaccgggttaccgggttaccgggtaaccgggttacctttacggttaccgtaacggttaaaccgggggttccgggaaacccggtaacccggggttacccggtaccggttaccccgggtacccttaccggtcccgtaccggtaacccggtacccccggtaaccccgaaaccgggttccccggtaccttacccgggttaaccccggtttccccctccgggtcccggtaccccgg

SEQ ID NO: 257579 - DNA, 751 bp, Homo sapiens
  misc_feature: GYAE6OF02GBM5X.34.14.B03.1.454.CMB.1.raw
  modified_base (118)..(118): a, c, t, g, unknown or other
  misc_feature (118)..(118): n is a, c, g, or t
  modified_base (193)..(193): a, c, t, g, unknown or other
  misc_feature (193)..(193): n is a, c, g, or t
  modified_base (280)..(280): a, c, t, g, unknown or other
  misc_feature (280)..(280): n is a, c, g, or t
  modified_base (679)..(679): a, c, t, g, unknown or other
  misc_feature (679)..(679): n is a, c, g, or t
tcagtacacgtgatcacgaccggtgctcgatttagtgtgagtagtttgggtttgagtgactcctgtgccccaccatggacacactgtgctccacgctcctgctgctgaccatcccttnatgggtcttgtccagatcaccttgaaggagtctcgggtccgacgtcgtggtacgaaaacccaaacgacgaccctnaacgctacgacctgcctaccttctacgttggtttccacgacctcaaccgagtaagaacgtaagcggtctaggtcggccgtgggtccncgaccgaccccgaaggaacggcctaggtacgttaccagcgtcgttacgttaggtgggtctacgtgagtcggacgccgtactaacgtacgtccagttctacgtaacgaacgtaaccgacggtacctacaaccgtactaaccggaaccggaaacccgaaacccctaaaaacccccgaaaaacggtcggttacaaccgttaccgacgtaaaccacgtacgtaaacgtaacggttccggtaaccgtggacgaactacgacccgtaaccctacttaacttagtcgtacgaaccctaacgtaaaacccgtaaaccgcccgggtaccgggtcgggtaacggttacctttacggttaacgaccggttacggacgggtaccggacggtaccgtcggtaccaccgttcnccgtacgaaccggccctacccgaaccggtccggtacctccggttaacccgtccccgttaccggccggtaccg

SEQ ID NO: 257580 - DNA, 251 bp, Homo sapiens
  misc_feature: GYAE6OF01CYMGB.49.15.B04.1.454.CMB.1.raw
  modified_base (250)..(251): a, c, t, g, unknown or other
  misc_feature (250)..(251): n is a, c, g, or t
tcagagtcgagagacacgaccggtgctcgatttagacagtatatatcccgggcacgaccggtgctcgatttagacagtatatatccgcgggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnn

SEQ ID NO: 257581 - DNA, 244 bp, Homo sapiens
  misc_feature: GYAE6OF01EIF7M.49.15.B04.1.454.CMB.1.raw
  modified_base (242)..(244): a, c, t, g, unknown or other
  misc_feature (242)..(244): n is a, c, g, or t
tcagagtcgagagacacgaccggtgctcgatttagacagtatatatccgcgggcacgaccggtgctcgatttagtcgagctctctcgcgggcacgaccggtgctcgatttagtcgagctctctcggcggcacgaccggtgcttcgatttagtcacgcgagaaagggaaggggctggccctgacgtgtttctgttcccgccctcctctctctcgactctgagcgggctggcaaggcgcatagnnn

SEQ ID NO: 257582 - DNA, 255 bp, Homo sapiens
  misc_feature: GYAE6OF01CH2LB.49.15.B04.1.454.CMB.1.raw
  modified_base (243)..(255): a, c, t, g, unknown or other
  misc_feature (243)..(255): n is a, c, g, or t
tcagagtcgagagacacgaccggtgctcgatttagacagtatatatccgcgggcacgaccggtgctcgatttagtcgagctctctcgcgggcacgaccggtgctcgatttagtcgagctctctcggcggcacgaccggtgcttcgattttagcacgcgagaaagggaaggggctggccctgacgtgtttctgttcccaccctcctctctctcgactcgtgagcgggctggcaaggcgcatagnnnnnnnnnnnnn

SEQ ID NO: 257583 - DNA, 167 bp, Homo sapiens
  misc_feature: GYAE6OF01BF653.49.15.B04.1.454.CMB.1.raw
  modified_base (164)..(167): a, c, t, g, unknown or other
  misc_feature (164)..(167): n is a, c, g, or t
tcagagtcgagagacacgaccggtgctcgatttagacagtatatatccgcgggcagaccggtgctcgatttagtcacgcgagaaagggaaggggctggccctgacgtgtttctgttcccaccctcctctctctcgactctgagcgggctggcaaggcgcatagnnnn

SEQ ID NO: 257584 - DNA, 209 bp, Homo sapiens
  misc_feature: GYAE6OF01DCY0U.49.15.B04.1.454.CMB.1.raw
  modified_base (200)..(209): a, c, t, g, unknown or other
  misc_feature (200)..(209): n is a, c, g, or t
tcagagtcgagagacacgaccggtgctcgatttagacagtatatatccgcggcacgaccggtgctcgatttagctctacgctcagggcacgaccggtgctcgatttagtcacgcgagaaagggaaggggctggccctgacgtgtttctgttcccaccctcctctctctcgactctgagcgggtctggcaaggcgcatagnnnnnnnnnn

SEQ ID NO: 257585 - DNA, 161 bp, Homo sapiens
  misc_feature: GYAE6OF01DWN92.49.15.B04.1.454.CMB.1.raw
  modified_base (161)..(161): a, c, t, g, unknown or other
  misc_feature (161)..(161): n is a, c, g, or t
tcagagtcgagagacacgaccggtgctcgatttagacagtatatatccgcgggcagaccggtgctcgatttagtcacgcgagaaggaagggctggccctgacgtgtttctgttcccaccctcctctctctcgactctgagcgggctggcaaggcgcatagn

SEQ ID NO: 257586 - DNA, 254 bp, Homo sapiens
  misc_feature: GYAE6OF01ELIND.49.15.B04.1.454.CMB.1.raw
  modified_base (218)..(254): a, c, t, g, unknown or other
  misc_feature (218)..(254): n is a, c, g, or t
tcagagtcgagagacacgaccggtgctcgatttagacagtatatataccggcgggcacgaccggtgctcgatttagagtgagctcgttgggtttgggggaagaggaaggactgacggtccccccaggagttcaggtgctgggcacagcggccctgggctgcctggtcaaggctacttcctctctcgactctgagcgggctggcaaggccgcgataggnnnnnnnnnnnnnnnnnnnnnnnnnnnnnnnnnnnnn

SEQ ID NO: 257587 - DNA, 251 bp, Homo sapiens
  misc_feature: GYAE6OF01A8Q0Z.49.15.B04.1.454.CMB.1.raw
  modified_base (248)..(251): a, c, t, g, unknown or other
  misc_feature (248)..(251): n is a, c, g, or t
tcagagtcgagagacacgaccggtgctcgatttagacagtatatatccgcgggcacgaccggtgctcgatttagtcgagctctctcgcggcacgaccggtgctcgatttagtcgagctctacgtacggcggcaccgaccggtgcttcgattttacgtccacgcgagaaaggaaggggctggccctgacgtgtttctgttacccaccctcctctctctcgactctgagcgggctggcaaggcgcatagnnnn

SEQ ID NO: 257588 - DNA, 213 bp, Homo sapiens
  misc_feature: GYAE6OF01CUO8S.49.15.B04.1.454.CMB.1.raw
  modified_base (212)..(213): a, c, t, g, unknown or other
  misc_feature (212)..(213): n is a, c, g, or t
tcagagtcgagagacacgaccggtgctcgatttagacagtatatatccgcgggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnn

SEQ ID NO: 257589 - DNA, 201 bp, Homo sapiens
  misc_feature: GYAE6OF01CDMY1.49.15.B04.1.454.CMB.1.raw
  modified_base (200)..(201): a, c, t, g, unknown or other
  misc_feature (200)..(201): n is a, c, g, or t
tcagagtcgagagacacgaccggtgctcgatttagacagtatatatccgcgggcacgaccggtgctcgatttagcgagacgcgcagggcacgaccggtgctcgatttagtcacgcgagaaagggaaggggctggccctgacgtgtttctgttcccaccctcctctctctcgactctgagcgggctggcaaggcgcatagnn

SEQ ID NO: 257590 - DNA, 132 bp, Homo sapiens
  misc_feature: GYAE6OF01CDWGD.49.15.B04.1.454.CMB.1.raw
  modified_base (132)..(132): a, c, t, g, unknown or other
  misc_feature (132)..(132): n is a, c, g, or t
tcagagtcgagagacacgaccggtgctcgatttagacagtatatatccgcggggtgctcgatttagatagctccctttgtgtgttcccgccctcctctctctcgactctgagcggctggcaaggcgcatagn

SEQ ID NO: 257591 - DNA, 165 bp, Homo sapiens
  misc_feature: GYAE6OF01EMBJN.49.15.B04.1.454.CMB.1.raw
  modified_base (165)..(165): a, c, t, g, unknown or other
  misc_feature (165)..(165): n is a, c, g, or t
tcagagtcgagagacacgaccggtgctcgatttagacagtatatatccgcgggcacgaccggtgctcgatttagtcacgcagaaagggaaaggggctggccctgacgtgtttctgttcccgccctcctctctctcgactctgagcgggctggcaaggcgcatagn

SEQ ID NO: 257592 - DNA, 165 bp, Homo sapiens
  misc_feature: GYAE6OF01CECZP.49.15.B04.1.454.CMB.1.raw
  modified_base (165)..(165): a, c, t, g, unknown or other
  misc_feature (165)..(165): n is a, c, g, or t
tcagagtcgagagacacgaccggtgctcgatttagacagtatatatccgcgggcagaccggtgctcgatttagtcacgcgagaaagggaaaggggctggccctgacgtgtttctgttcccaccctcctctctctcgactctgagcgggctggcaaggcgcatagn

SEQ ID NO: 257593 - DNA, 165 bp, Homo sapiens
  misc_feature: GYAE6OF01AH6DY.49.15.B04.1.454.CMB.1.raw
  modified_base (165)..(165): a, c, t, g, unknown or other
  misc_feature (165)..(165): n is a, c, g, or t
tcagagtcgagagacacgaccggtgctcgatttagacagtatatatccgcgggcagaccggtgctcgatttagtcacgcgagaaagggaaaggggctggccctgacgtgtttctgttcccgccctcctctctctcgactctgagcgggctggcaaggcgcatagn

SEQ ID NO: 257594 - DNA, 166 bp, Homo sapiens
  misc_feature: GYAE6OF01A006A.49.15.B04.1.454.CMB.1.raw
  modified_base (166)..(166): a, c, t, g, unknown or other
  misc_feature (166)..(166): n is a, c, g, or t
tcagagtcgagagacacgaccggtgctcgatttagacagtatatatccgcgggcacgaccggtgctcgatttagtcacgcgagaaagggaaaggggctggccctgacgtgtttctgttcccgccctcctctctctcgactctgagcgggctggcaaggcgcatagn

SEQ ID NO: 257595 - DNA, 259 bp, Homo sapiens
  misc_feature: GYAE6OF01C5HVI.49.15.B04.1.454.CMB.1.raw
  modified_base (190)..(190): a, c, t, g, unknown or other
  misc_feature (190)..(190): n is a, c, g, or t
  modified_base (192)..(198): a, c, t, g, unknown or other
  misc_feature (192)..(198): n is a, c, g, or t
  modified_base (200)..(259): a, c, t, g, unknown or other
  misc_feature (200)..(259): n is a, c, g, or t
tcagagtcgagagacacgaccggtgctcgatttagacagtatatattccggtcggggcacgaccggtgctcgatttagatcgtctgtgttgggtttcgggccagccctaaaggcctgccccccagccgtcaccttctgttcccaccctcctctctcctcgactctgagcgggctggcaaggccgcatagncnnnnnnngnnnnnnnnnnnnnnnnnnnnnnnnnnnnnnnnnnnnnnnnnnnnnnnnnnnnnnnnnnnn

SEQ ID NO: 257596 - DNA, 564 bp, Homo sapiens
  misc_feature: GYAE6OF01DN4FW.49.15.B04.1.454.CMB.1.raw
  modified_base (133)..(133): a, c, t, g, unknown or other
  misc_feature (133)..(133): n is a, c, g, or t
  modified_base (247)..(247): a, c, t, g, unknown or other
  misc_feature (247)..(247): n is a, c, g, or t
  modified_base (273)..(275): a, c, t, g, unknown or other
  misc_feature (273)..(275): n is a, c, g, or t
  modified_base (277)..(277): a, c, t, g, unknown or other
  misc_feature (277)..(277): n is a, c, g, or t
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
  modified_base (298)..(299): a, c, t, g, unknown or other
  misc_feature (298)..(299): n is a, c, g, or t
  modified_base (304)..(304): a, c, t, g, unknown or other
  misc_feature (304)..(304): n is a, c, g, or t
  modified_base (306)..(306): a, c, t, g, unknown or other
  misc_feature (306)..(306): n is a, c, g, or t
  modified_base (317)..(317): a, c, t, g, unknown or other
  misc_feature (317)..(317): n is a, c, g, or t
  modified_base (320)..(320): a, c, t, g, unknown or other
  misc_feature (320)..(320): n is a, c, g, or t
  modified_base (337)..(337): a, c, t, g, unknown or other
  misc_feature (337)..(337): n is a, c, g, or t
  modified_base (339)..(339): a, c, t, g, unknown or other
  misc_feature (339)..(339): n is a, c, g, or t
  modified_base (359)..(359): a, c, t, g, unknown or other
  misc_feature (359)..(359): n is a, c, g, or t
  modified_base (436)..(436): a, c, t, g, unknown or other
  misc_feature (436)..(436): n is a, c, g, or t
tcagagtcgagagacacgaccggtgctcgatttagacagtatatagtcgcggggcacgaccggtgctcgatttagtcgagctctctcgcggcacgaccggtgcgtcgatttagtccagctctacgacggcgtnacctcggtggcttcgagttttccgccgaccgcgtacgtaaagggaacggggcttggccctagccggtgtttcgtcgttaccgcccttcgtacttcctgcgacttcagagccggnttcggccaagggcctacagtaaacgnnngngtgngtatatntctctgacanncacgnancacactatatntgngtctcgtcgctcgtgtntntcgtctctcgtctcacgtcngacacgacgtcctcctcactactctactacactacgacgtcgagagacgtacgtcgtagtacttattactacgtacncgtctactatactactagtaagtagtaagtagtacgtacgtacgtcgtcgtcgtacggtacggacggtacgtacggtacgtacgtacgtacgtacgacgacgtacgtcgtccgtcccgtccgtcgtcg

SEQ ID NO: 257597 - DNA, 176 bp, Homo sapiens
  misc_feature: GYAE6OF01B3OCN.49.15.B04.1.454.CMB.1.raw
  modified_base (175)..(176): a, c, t, g, unknown or other
  misc_feature (175)..(176): n is a, c, g, or t
tcagagtcgagagacacgaccggtgctcgatttagacagtatatatccgcgggcacgaccggtgctcgatttagatcgtctgtgttgggtttgggcagcctaaggctgcccccagcgtcactctgttcccaccctcctctctctcgactctgagcgggctggcaaggcgcatagnn

SEQ ID NO: 257598 - DNA, 228 bp, Homo sapiens
  misc_feature: GYAE6OF01DKMT9.49.15.B04.1.454.CMB.1.raw
  modified_base (208)..(208): a, c, t, g, unknown or other
  misc_feature (208)..(208): n is a, c, g, or t
  modified_base (214)..(228): a, c, t, g, unknown or other
  misc_feature (214)..(228): n is a, c, g, or t
tcagagtcgagagacacgaccggtgctcgatttagacagtatatatccggtcgggcacgaccggtgctcgatttagagagagtgtgttgggttggggaagaggaacgactgacggtcccccaggagttcaggtgctgggcacagcggccctgggctgcctggtcaaggactacttcctctctcgactctgagccgggctggcaaggcncatagnnnnnnnnnnnnnnn

SEQ ID NO: 257599 - DNA, 166 bp, Homo sapiens
  misc_feature: GYAE6OF01B4MS4.49.15.B04.1.454.CMB.1.raw
  modified_base (166)..(166): a, c, t, g, unknown or other
  misc_feature (166)..(166): n is a, c, g, or t
tcagagtcgagagacacgaccggtgctcgatttagacagtatatatccgcgggcacgaccggtgctcgatttagtcacgcgagaaagggaaaggggctggccctgacgtgtttctgttcccaccctcctctctctcgactctgagcgggctggcaaggcgcatagn

SEQ ID NO: 257600 - DNA, 165 bp, Homo sapiens; identical to SEQ ID NO: 257592
  misc_feature: GYAE6OF01BZ2S0.49.15.B04.1.454.CMB.1.raw
  modified_base (165)..(165): a, c, t, g, unknown or other
  misc_feature (165)..(165): n is a, c, g, or t

SEQ ID NO: 257601 - DNA, 203 bp, Homo sapiens
  misc_feature: GYAE6OF01AHG8A.49.15.B04.1.454.CMB.1.raw
  modified_base (203)..(203): a, c, t, g, unknown or other
  misc_feature (203)..(203): n is a, c, g, or t
tcagagtcgagagacacgaccggtgctcgatttagacagtatatatccgcgggcacgaccggtgctcgatttagacagtatatatccgcgggcacgaccggtgctcgatttagtcacgcgagaagggaaggggctggccctgacgtgtttctgttcccgccctcctctctctcgactctgagcgggctggcaaggcgcatagn

SEQ ID NO: 257602 - DNA, 158 bp, Homo sapiens
  misc_feature: GYAE6OF01DZOXG.49.15.B04.1.454.CMB.1.raw
  modified_base (157)..(158): a, c, t, g, unknown or other
  misc_feature (157)..(158): n is a, c, g, or t
tcagagtcgagagacacgaccggtgctcgatttagacagtatatatccgcggcacgaccggtgctcgatttagacagtatatacccgcggatatatactgtctaaatcgagcaccggtcgtgtctctcgactctgagcggctggcaaggcgcatagnn

SEQ ID NO: 257603 - DNA, 167 bp, Homo sapiens
  misc_feature: GYAE6OF01CZ2BA.49.15.B04.1.454.CMB.1.raw
  modified_base (166)..(167): a, c, t, g, unknown or other
  misc_feature (166)..(167): n is a, c, g, or t
tcagagtcgagagacacgaccggtgctcgatttagacagtatatatccgcgggcacgaccggtgctcgatttagtcacgcgagaaagggaaaggggctggccctgacgtgtttctgttcccgccctcctctctctcgactctgagcgggctggcaaggcgcatagnn

SEQ ID NO: 257604 - DNA, 343 bp, Homo sapiens
  misc_feature: GYAE6OF01CQRQE.49.15.B04.1.454.CMB.1.raw
  modified_base (311)..(313): a, c, t, g, unknown or other
  misc_feature (311)..(313): n is a, c, g, or t
  modified_base (315)..(343): a, c, t, g, unknown or other
  misc_feature (315)..(343): n is a, c, g, or t
tcagagtcgagagacacgaccggtgctcgatttagacagtatatatccggtcgggcgatatatatccgcgggcacgaccggtgctcgatttagtcgagctctctcgcgggctacgaccggtgctcgatttgtccgagctctctctcgggcacgaccggtgctcgactttagagtagagtgtgttgggtttgggggaagaggaagactgacggtccccccaggagttcaggtgctgggcacagcggccctgggctgcctggtcaaggactacttcctctctcgactctgagcgggctggcaaggcgcatagnnngnnnnnnnnnnnnnnnnnnnnnnnnnnnnn

SEQ ID NO: 257605 - DNA, 217 bp, Homo sapiens
  misc_feature: GYAE6OF01B5YE3.49.15.B04.1.454.CMB.1.raw
  modified_base (213)..(217): a, c, t, g, unknown or other
  misc_feature (213)..(217): n is a, c, g, or t
tcagagtcgagagacacgaccggtgctcgatttagacagtatatatccgcgggcacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagnnnnn

SEQ ID NO: 257606 - DNA, 215 bp, Homo sapiens
  misc_feature: GYAE6OF01CMNS8.49.15.B04.1.454.CMB.1.raw
  modified_base (214)..(215): a, c, t, g, unknown or other
  misc_feature (214)..(215): n is a, c, g, or t
tcagagtcgagagacacgaccggtgctcgatttagacagtatatatccgcgggcacgaccggtgctcgatttagagagagtgtgttgggtttgggggaagaggaagactgaccggtccccccaggagttcaggtgctgggcacagcggccctgggctgcctggtcaaggactacttcctctctcgactctgagcgggctggcaaggcgcatagnn

SEQ ID NO: 257607 - DNA, 106 bp, Homo sapiens
  misc_feature: GYAE6OF01CSM83.49.15.B04.1.454.CMB.1.raw
tcagagtcgagagacacgaccggtgctcgatttagacagtatatatccgcgggcacgaccggtgctcgatttagtcgagctctctgcgggctggcaaggcgcatag

SEQ ID NO: 257608 - DNA, 175 bp, Homo sapiens
  misc_feature: GYAE6OF01EXX1Z.49.15.B04.1.454.CMB.1.raw
  modified_base (174)..(175): a, c, t, g, unknown or other
  misc_feature (174)..(175): n is a, c, g, or t
tcagagtcgagagacacgaccggtgctcgatttagacagtatatatccgcgggcacgaccggtgctcgatttagtcacgcgagaaagggaaagggggctggccctgacgtgtttctgttcccgccctccctctctctcgactctgacggcggtcgtggacgaggcgacagtagnn

SEQ ID NO: 257609 - DNA, 166 bp, Homo sapiens; identical to SEQ ID NO: 257599
  misc_feature: GYAE6OF01E4RPP.49.15.B04.1.454.CMB.1.raw
  modified_base (166)..(166): a, c, t, g, unknown or other
  misc_feature (166)..(166): n is a, c, g, or t

SEQ ID NO: 257610 - DNA, 252 bp, Homo sapiens
  misc_feature: GYAE6OF01EZT42.49.15.B04.1.454.CMB.1.raw
  modified_base (252)..(252): a, c, t, g, unknown or other
  misc_feature (252)..(252): n is a, c, g, or t
tcagagtcgagagacacgaccggtgctcgatttagacagtatatatccgcgggcacgaccggtgctcgatttagacagtatatatccgcgggcacgaccggtgctcgactttagagagagtgtgttgggtttgggggaagaggaagactgacggtcccccaggagttcaggtgctgggcacagcggccctgggctgcctggtcaaggactacttcctctctcgactctgagcgggctggcaaggcgcatagn

SEQ ID NO: 257611 - DNA, 166 bp, Homo sapiens
  misc_feature: GYAE6OF01DXNR3.49.15.B04.1.454.CMB.1.raw
  modified_base (166)..(166): a, c, t, g, unknown or other
  misc_feature (166)..(166): n is a, c, g, or t
tcagagtcgagagacacgaccggtgctcgatttagacagtatatatccgcgggcagaccggtgctcgatttagtcacgcgagaaagggaaagggggctggccctgacgtgtttctgttcccaccctcctctctctcgactctgagcgggctggcaaggcgcatagn

SEQ ID NO: 257612 - DNA, 201 bp, Homo sapiens
  misc_feature: GYAE6OF01E29N6.49.15.B04.1.454.CMB.1.raw
  modified_base (200)..(201): a, c, t, g, unknown or other
  misc_feature (200)..(201): n is a, c, g, or t
tcagagtcgagagacacgaccggtgctcgatttagacagtatatatccgcgggcacgaccggtgctcgatttagctctacgctcagggcacgaccggtgctcgatttagtcacgcgagaaagggaaggggctggccctgacgtgtttctgttcccaccctcctctctctcgactctgagcgggctggcaaggcgcatagnn

SEQ ID NO: 257613 - DNA, 168 bp, Homo sapiens
  misc_feature: GYAE6OF01EHNCV.49.15.B04.1.454.CMB.1.raw
  modified_base (167)..(168): a, c, t, g, unknown or other
  misc_feature (167)..(168): n is a, c, g, or t
tcagagtcgagagacacgaccggtgctcgatttagacagtatatatccgcgggcacgaccggtgctcgatttagtcacgcgagaaagggaaagggggctggccctgacgtgtttctgttcccaccctcctctctctcgactctgagcgggctggcaaggcgcatagnn

SEQ ID NO: 257614 - DNA, 175 bp, Homo sapiens
  misc_feature: GYAE6OF01EMI62.49.15.B04.1.454.CMB.1.raw
  modified_base (175)..(175): a, c, t, g, unknown or other
  misc_feature (175)..(175): n is a, c, g, or t
tcagagtcgagagacacgaccggtgctcgatttagacagtatatatccgcgggcacgaccggtgctcgatttagatcgtctgtgttgggtttgggcagcctaaggctgcccccagcgtcactctgttcccaccctcctctctctcgactctgagcgggctggcaaggcgcatagn

SEQ ID NO: 257615 - DNA, 213 bp, Homo sapiens
  misc_feature: GYAE6OF01EQEO2.49.15.B04.1.454.CMB.1.raw
  modified_base (213)..(213): a, c, t, g, unknown or other
  misc_feature (213)..(213): n is a, c, g, or t
tcagagtcgagagacacgaccggtgctcgatttagacagtatatatccgcgggcacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagn

SEQ ID NO: 257616 - DNA, 213 bp, Homo sapiens
  misc_feature: GYAE6OF01ESQGY.49.15.B04.1.454.CMB.1.raw
  modified_base (199)..(213): a, c, t, g, unknown or other
  misc_feature (199)..(213): n is a, c, g, or t
tcagagtcgagagacacgaccggtgctcgatttagacagtatatatccgcgggcgacgaccggtgctcgatttagctctacgctcagggcacgaccggtgctcgatttagcacgcggaaggaaaggggacgtgccctcgacgtgtttctgttccgccctcctctctctcgactctgagcggcgtgcgaacgcgcatagnnnnnnnnnnnnnnn

SEQ ID NO: 257617 - DNA, 111 bp, Homo sapiens
  misc_feature: GYAE6OF01DGZGW.49.15.B04.1.454.CMB.1.raw
  modified_base (109)..(111): a, c, t, g, unknown or other
  misc_feature (109)..(111): n is a, c, g, or t
tcagagtcgagagacacgaccggtgctcgatttagacagtatatatccgcgggcacgaccggtgctcgatttagacagtatatatgagcgggctggcaaggcgcatagnnn

SEQ ID NO: 257618 - DNA, 203 bp, Homo sapiens
  misc_feature: GYAE6OF01ABSTB.49.15.B04.1.454.CMB.1.raw
  modified_base (148)..(148): a, c, t, g, unknown or other
  misc_feature (148)..(148): n is a, c, g, or t
  modified_base (197)..(203): a, c, t, g, unknown or other
  misc_feature (197)..(203): n is a, c, g, or t
tcagagtcgagagacacgaccggtgctcgatttagacagtatatatccgcggcacgaccggtgctcgatttagacagtatatatccgcggcacgaccggtgctcgatttagtcacgcgagaaggaagggctggccctgacgtgtttcngttcccgcctctctctctcgactctgagcgggctggcaaggcgcatagnnnnnnn

SEQ ID NO: 257619 - DNA, 308 bp, Homo sapiens
  misc_feature: GYAE6OF01BCDEL.49.15.B04.1.454.CMB.1.raw
  modified_base (305)..(308): a, c, t, g, unknown or other
  misc_feature (305)..(308): n is a, c, g, or t
tcagagtcgagagacacgaccggtgctcgatttagacagtatatatccgtcgggcatatatatccgccggcacgaccggtgctcgatttagtcgagctctctcgcgggcacgaccggtgctcgactttgtcgagctctctcgcgggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnn

SEQ ID NO: 257620 - DNA, 174 bp, Homo sapiens
  misc_feature: GYAE6OF01CWLNN.49.15.B04.1.454.CMB.1.raw
  modified_base (167)..(167): a, c, t, g, unknown or other
  misc_feature (167)..(167): n is a, c, g, or t
  modified_base (173)..(174): a, c, t, g, unknown or other
  misc_feature (173)..(174): n is a, c, g, or t
tcagagtcgagagacacgaccggtgctcgatttagacagtatatatccgcgggcacgaccggtgctcgatttagacagtatatatccgcggcacgaccggtgctcgatttagctagtcactctgttcccacctcctctctctcgactctgagcgggctggcaaggcncatagnn

SEQ ID NO: 257621 - DNA, 167 bp, Homo sapiens
  misc_feature: GYAE6OF01C5X6W.49.15.B04.1.454.CMB.1.raw
  modified_base (166)..(167): a, c, t, g, unknown or other
  misc_feature (166)..(167): n is a, c, g, or t
tcagagtcgagagacacgaccggtgctcgatttagacagtatatatccgcgggcacgaccggtgctcgatttagtcacgcgagaaagggaaagggggctggccctgacgtgttctgttcccaccctcctctctctcgactctgagcgggctggcaaggcgcatagnn

SEQ ID NO: 257622 - DNA, 245 bp, Homo sapiens
  misc_feature: GYAE6OF01BEH9B.49.15.B04.1.454.CMB.1.raw
  modified_base (236)..(245): a, c, t, g, unknown or other
  misc_feature (236)..(245): n is a, c, g, or t
tcagagtcgagagacacgaccggtgctcgatttagacagtatatatccgcgggcacgaccggtgctcgatttagtcgagctctctcgcggcacgaccggtgctcgatttagtcgagctctctcggcggcacgaccggtgctcgatttagcacgcgagaaagggaaggggctggccctgacgtgtttctgttcccacctctctctctcgactctgagcggctggcaaggcgcatagnnnnnnnnnn

SEQ ID NO: 257623 - DNA, 169 bp, Homo sapiens
  misc_feature: GYAE6OF01ATRIS.49.15.B04.1.454.CMB.1.raw
  modified_base (132)..(169): a, c, t, g, unknown or other
  misc_feature (132)..(169): n is a, c, g, or t
tcagagtcgagagacacgaccggtgctcgatttagacagtatatatccgcggcgtggcgaaggcgcatagggcgtgcaaggcgcatagggctggacaaggcgctagagcgggcctggcaagggcgcatagcnnnnnnnnnnnnnnnnnnnnnnnnnnnnnnnnnnnnnn

SEQ ID NO: 257624 - DNA, 213 bp, Homo sapiens
  misc_feature: GYAE6OF01ETNE8.49.15.B04.1.454.CMB.1.raw
  modified_base (198)..(198): a, c, t, g, unknown or other
  misc_feature (198)..(198): n is a, c, g, or t
  modified_base (203)..(213): a, c, t, g, unknown or other
  misc_feature (203)..(213): n is a, c, g, or t
tcagagtcgagagacacgaccggtgctcgatttagacagtatatatccgcgggcacgaccggtgctcgatttagagtgagctcgctgggtttgggggaagaggaagactgacggtcccccaggagttcaggtgctgggcacagcggccctgggctgcctggtcaaggactacttcctctgagcgggctggcaaggcgnatagnnnnnnnnnnn

SEQ ID NO: 257625 - DNA, 173 bp, Homo sapiens
  misc_feature: GYAE6OF01AVUYM.49.15.B04.1.454.CMB.1.raw
  modified_base (170)..(173): a, c, t, g, unknown or other
  misc_feature (170)..(173): n is a, c, g, or t
tcagagtcgagagacacgaccggtgctcgatttagacagtatatatcgcgggcacgaccggtgctcgatttagtcgagctctctcgcgggcacgaccggtgctcgatttagtagtgtagattccgcgggatttagtagtgtagattcaggcggctggacaggcgcatagnnnn

SEQ ID NO: 257626 - DNA, 245 bp, Homo sapiens
  misc_feature: GYAE6OF01EPQV9.49.15.B04.1.454.CMB.1.raw
  modified_base (191)..(191): a, c, t, g, unknown or other
  misc_feature (191)..(191): n is a, c, g, or t
  modified_base (234)..(234): a, c, t, g, unknown or other
  misc_feature (234)..(234): n is a, c, g, or t
  modified_base (240)..(245): a, c, t, g, unknown or other
  misc_feature (240)..(245): n is a, c, g, or t
tcagagtcgagagacacgaccggtgctcgatttagacagtatatatccgcgggcacgaccggtgcttcgatttagtcgagctctctcgcgggcacgaccggtgctcgatttagtcgagctctctcgcgggcacgaccggtgctcgattttagcacgcgagaaagggaaggggctggccctgacgtgtttcngttcccgcctctctctctcgactctgagcgggctggcaaggcncaatgnnnnnn

SEQ ID NO: 257627 - DNA, 175 bp, Homo sapiens; identical to SEQ ID NO: 257614
  misc_feature: GYAE6OF01CXV07.49.15.B04.1.454.CMB.1.raw
  modified_base (175)..(175): a, c, t, g, unknown or other
  misc_feature (175)..(175): n is a, c, g, or t

SEQ ID NO: 257628 - DNA, 175 bp, Homo sapiens
  misc_feature: GYAE6OF01ATG2G.49.15.B04.1.454.CMB.1.raw
  modified_base (175)..(175): a, c, t, g, unknown or other
  misc_feature (175)..(175): n is a, c, g, or t
tcagagtcgagagacacgaccggtgctcgatttagacagtatatatccgcgggcacgaccggtgctcgatttagatcgtctgtgttgggtttgggcagcctaaggctgcccccagcgtcactctgttcccgccctcctctctctcgactctgagcgggctggcaaggcgcatagn

SEQ ID NO: 257629 - DNA, 214 bp, Homo sapiens
  misc_feature: GYAE6OF01CY0WI.49.15.B04.1.454.CMB.1.raw
  modified_base (213)..(214): a, c, t, g, unknown or other
  misc_feature (213)..(214): n is a, c, g, or t
tcagagtcgagagacacgaccggtgctcgatttagacagtatatatccgcgggcacgaccggtgctcgatttagagagagtgtgttgggtttgggggaagaggaagactgacggtccccccaggagttcaggtgctgggcacagcggccctgggctgcctggtcaaggactacttcctcgtagcactctgagcgggctggcaaggcgcatagnn

SEQ ID NO: 257630 - DNA, 254 bp, Homo sapiens
  misc_feature: GYAE6OF01BZAES.49.15.B04.1.454.CMB.1.raw
  modified_base (252)..(254): a, c, t, g, unknown or other
  misc_feature (252)..(254): n is a, c, g, or t
tcagagtcgagagacacgaccggtgctcgatttagacagtatatatccgcgggcacgaccggtgctcgatttagacagtatatatccgcgggcacgaccggtgctcgactttagagagagtgtgttgggtttgggggaagaggaagactgacggtcccccaggagttcaggtgctgggcacagcggccctgggctgcctggtcaagtactacttcctctctcgactctgagcgggctggcaaggcgcatagnnn

SEQ ID NO: 257631 - DNA, 214 bp, Homo sapiens
  misc_feature: GYAE6OF01CWF3S.49.15.B04.1.454.CMB.1.raw
  modified_base (213)..(214): a, c, t, g, unknown or other
  misc_feature (213)..(214): n is a, c, g, or t
tcagagtcgagagacacgaccggtgctcgatttagacagtatatatccgcgggcacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagnn

SEQ ID NO: 257632 - DNA, 231 bp, Homo sapiens
  misc_feature: GYAE6OF01BKMOL.49.15.B04.1.454.CMB.1.raw
  modified_base (206)..(231): a, c, t, g, unknown or other
  misc_feature (206)..(231): n is a, c, g, or t
tcagagtcgagagacacgaccggtgctcgatttagacagtatatagtccggcggtcacgaccggtgctcgatttagctctacgctcacgggcacgaccggtgctcgatttagcacgcgagaaagggaaggggctggccctgacgtgtttctgttacccaccctcctctctactccgactctgagcgggtctggcaaggcgcatagnnnnnnnnnnnnnnnnnnnnnnnnnn

SEQ ID NO: 257633 - DNA, 220 bp, Homo sapiens
  misc_feature: GYAE6OF01CQ1XV.49.15.B04.1.454.CMB.1.raw
  modified_base (178)..(178): a, c, t, g, unknown or other
  misc_feature (178)..(178): n is a, c, g, or t
  modified_base (213)..(220): a, c, t, g, unknown or other
  misc_feature (213)..(220): n is a, c, g, or t
tcagagtcgagagacacgaccggtgctcgatttagacagtatatatccgcgggcacgaccggtgctcgatttagagagagtgtgttgggtttgggggaagaggaagactgacggtccccccaggagttcaggtgctgggcacagcggccctgggctgcctggtcaaggactacttccncgtagcactctgagcggctggcaaggcgcagtagnnnnnnnn

SEQ ID NO: 257634 - DNA, 168 bp, Homo sapiens
  misc_feature: GYAE6OF01CONHY.49.15.B04.1.454.CMB.1.raw
  modified_base (165)..(168): a, c, t, g, unknown or other
  misc_feature (165)..(168): n is a, c, g, or t
tcagagtcgagagacacgaccggtgctcgatttagacagtatatatccgcgggcacgaccggtgctcgatttagtgtagtgtgaagggaaaggggctggccctgacgtgtttctgttcccgccctcctctctctcgactctgagcgggctggcaaggcgcatagnnnn

SEQ ID NO: 257635 - DNA, 114 bp, Homo sapiens
  misc_feature: GYAE6OF01CVEMN.49.15.B04.1.454.CMB.1.raw
  modified_base (113)..(114): a, c, t, g, unknown or other
  misc_feature (113)..(114): n is a, c, g, or t
tcagagtcgagagacacgaccggtgctcgatttagacagtatatatccgcggcacgaccggtgctcgatttagtcacgcgagaaagggagagcgggctggcaaggcgcatagnn

SEQ ID NO: 257636 - DNA, 106 bp, Homo sapiens; identical to SEQ ID NO: 257607
  misc_feature: GYAE6OF01CVDYN.49.15.B04.1.454.CMB.1.raw

SEQ ID NO: 257637 - DNA, 166 bp, Homo sapiens
  misc_feature: GYAE6OF01DRQXG.49.15.B04.1.454.CMB.1.raw
tcagagtcgagagacacgaccggtgctcgatttagacagtatatatccgcgggcacgaccggtgctcgatttagtcacgcgagaaagggaaagggggctggccctgacgtgtttctgttcccaccctcctctctctcgactctgagcgggctggcaaggcgcatag

SEQ ID NO: 257638 - DNA, 179 bp, Homo sapiens
  misc_feature: GYAE6OF01BJU19.49.15.B04.1.454.CMB.1.raw
  modified_base (174)..(179): a, c, t, g, unknown or other
  misc_feature (174)..(179): n is a, c, g, or t
tcagagtcgagagacacgaccggtgctcgatttagacagtatatatccgcgggcacgaccggtgctcgatttagatcgtctgtgttgggtttggcagcctaaggctgcccccagcgtcactctgttcccaccctcctctctctcgactctgagcgggctggcaaggcgcatagnnnnnn

SEQ ID NO: 257639 - DNA, 167 bp, Homo sapiens
  misc_feature: GYAE6OF01EVHEA.49.15.B04.1.454.CMB.1.raw
  modified_base (166)..(167): a, c, t, g, unknown or other
  misc_feature (166)..(167): n is a, c, g, or t
tcagagtcgagagacacgaccggtgctcgatttagacagtatatatccgcgggcagaccggtgctcgatttagtcacgcgagaaagggaaagggggctggccctgacgtgtttctgttccgaccctcctctctctcgactctgagcgggctggcaaggcgcatagnn

SEQ ID NO: 257640 - DNA, 287 bp, Homo sapiens
  misc_feature: GYAE6OF01CTTO7.49.15.B04.1.454.CMB.1.raw
  modified_base (271)..(287): a, c, t, g, unknown or other
  misc_feature (271)..(287): n is a, c, g, or t
tcagagtcgagagacacgaccggtgctcgatttagacagtatatatccgcgggcacgaccggtgctcgatttagctctacgctcagggcacgaccggtgctcgatttagagagagtgtgttgggtttggggggaagaggaagactggacccggtcccccgagggtacgttcgaggtgcgtgggcacaggccggcccgtgggctgccgtggtacaaggactacttcctctctcgactctggaggcgggctggacgaacgggcactaagtagnnnnnnnnnnnnnnnnn

SEQ ID NO: 257641 - DNA, 283 bp, Homo sapiens
  misc_feature: GYAE6OF01C6G6V.49.15.B04.1.454.CMB.1.raw
  modified_base (257)..(257): a, c, t, g, unknown or other
  misc_feature (257)..(257): n is a, c, g, or t
  modified_base (263)..(283): a, c, t, g, unknown or other
  misc_feature (263)..(283): n is a, c, g, or t
tcagagtcgagagacacgaccggtgctcgatttagacagtatatatcccggggcacgaccggtgctcgatttagacagtatatatccgcgggcacgaccggtgctcgatttagagagagtgtggttggggtttggggggaaagagggaagactcggaccggttccccccaggagttcaggtgcgtgggcacagccggccctgggctgcctggtcaaggactacttcctctctcgactctgagcgggctggcaaggcncatagnnnnnnnnnnnnnnnnnnnnn

SEQ ID NO: 257642 - DNA, 218 bp, Homo sapiens
  misc_feature: GYAE6OF01CCROG.49.15.B04.1.454.CMB.1.raw
  modified_base (213)..(218): a, c, t, g, unknown or other
  misc_feature (213)..(218): n is a, c, g, or t
tcagagtcgagagacacgaccggtgctcgatttagacagtatatatccgcgggcacgaccggtgctcgatttagagagagtgtgttgggtttgggggaagaggaagactgacggtccccccaggagttcaggtgctgggcacagcggccctgggctgcctggtcaaggactacttcctctctcgactctgagcgggctggcaaggcgcatagnnnnnn

SEQ ID NO: 257643 - DNA, 262 bp, Homo sapiens
  misc_feature: GYAE6OF01DIV44.49.15.B04.1.454.CMB.1.raw
  modified_base (252)..(262): a, c, t, g, unknown or other
  misc_feature (252)..(262): n is a, c, g, or t
tcagagtcgagagacacgaccggtgctcgatttagacagtatatatcccgggcacgaccggtgctcgatttagacagtatatatccgcgggcacgaccggtgctcgatttagagagagtgtgttgggttggggggaagaggaagactgacggtccccccaggagttcaggtgctgggcacagcggccctgggctgcctggtcaaggtactacttcctctctcgactctgagcggctggcaaggcgacatagnnnnnnnnnnn

SEQ ID NO: 257644 - DNA, 176 bp, Homo sapiens
  misc_feature: GYAE6OF01D16VH.49.15.B04.1.454.CMB.1.raw
  modified_base (166)..(176): a, c, t, g, unknown or other
  misc_feature (166)..(176): n is a, c, g, or t
tcagagtcgagagacacgaccggtgctcgatttagacagtatatatccgcgggcagaccggtgctcgatttagtcacgcgagaaagggaagggggctggccctgacgtgtttctgttcccaccctcctctctctcgactctgaggcggctggcaaggcgacatagnnnnnnnnnnn

SEQ ID NO: 257645 - DNA, 172 bp, Homo sapiens
  misc_feature: GYAE6OF01DMMM9.49.15.B04.1.454.CMB.1.raw
  modified_base (154)..(154): a, c, t, g, unknown or other
  misc_feature (154)..(154): n is a, c, g, or t
  modified_base (164)..(164): a, c, t, g, unknown or other
  misc_feature (164)..(164): n is a, c, g, or t
  modified_base (169)..(172): a, c, t, g, unknown or other
  misc_feature (169)..(172): n is a, c, g, or t
tcagagtcgagagacacgaccggtgctcgatttagacagtatatatcgcgggcacgaccggtgctcgatttagtcgagctctctcgcgggcacgaccggtgctcgatttagtagtgtagattccgcgggatttagtagtgtagattcaggcggngtgacgagcnatagnnnn

SEQ ID NO: 257646 - DNA, 211 bp, Homo sapiens
  misc_feature: GYAE6OF01DTJVW.49.15.B04.1.454.CMB.1.raw
  modified_base (207)..(211): a, c, t, g, unknown or other
  misc_feature (207)..(211): n is a, c, g, or t
tcagagtcgagagacacgaccggtgctcgatttagacagtatatatccgcgggcacgaccggtgctcgatttagacagtatatatccggcgggcacgaccggtgctcgatttagtcacgcgagaaagggaagggggctggccctgacgtgtttctcgttcccaccctcctctctctcgactctgagcgggctggcaaggcgcatagnnnnn

SEQ ID NO: 257647 - DNA, 176 bp, Homo sapiens
  misc_feature: GYAE6OF01BGTB7.49.15.B04.1.454.CMB.1.raw
  modified_base (166)..(176): a, c, t, g, unknown or other
  misc_feature (166)..(176): n is a, c, g, or t
tcagagtcgagagacacgaccggtgctcgatttagacagtatatatccgcgggcagaccggtgctcgatttagtcacgcgagaaagggaaagggggctggccctgacgtgttctgttcccaccctcctctctctcgactctgaggcgggctggcaaggcgcatagnnnnnnnnnnn

SEQ ID NO: 257648 - DNA, 228 bp, Homo sapiens
  misc_feature: GYAE6OF01C6KSF.49.15.B04.1.454.CMB.1.raw
  modified_base (205)..(228): a, c, t, g, unknown or other
  misc_feature (205)..(228): n is a, c, g, or t
tcagagtcgagagacacgaccggtgctcgatttagacagtatatatccgcgggaacgaccggtgctcgatttagacagtatatatccgcgggcacgaccggtgctcgatttagtcacgcgagaaagggaaagggggctggccctgacgtgtttctgttcccgcctcctctctctcgactctgagcgggctggcaaggcgcatagnnnnnnnnnnnnnnnnnnnnnnnn

SEQ ID NO: 257649 - DNA, 211 bp, Homo sapiens
  misc_feature: GYAE6OF02JYQDN.49.15.B04.1.454.CMB.1.raw
  modified_base (210)..(211): a, c, t, g, unknown or other
  misc_feature (210)..(211): n is a, c, g, or t
tcagagtcgagagacacgaccggtgctcgatttagacagtatatatccgcggcacgaccggtgctcgatttagagagagtgtgttgggtttggggaagaggaagactgacggtccccacggagttcaggtgctgggcacagcggccctgggctgcctggtcaaggactacttcctctctcgactctgagcgggctggcaaggcgcatagnn

SEQ ID NO: 257650 - DNA, 174 bp, Homo sapiens
  misc_feature: GYAE6OF02HVJ14.49.15.B04.1.454.CMB.1.raw
  modified_base (174)..(174): a, c, t, g, unknown or other
  misc_feature (174)..(174): n is a, c, g, or t
tcagagtcgagagacacgaccggtgctcgatttagacagtatatatccgcgggcacgaccggtgctcgatttagatcgtctgtgttgggtttgggcagcctaaggctgccccagcgtcactctgttcccaccctcctctctctcgactctgagcgggctggcaaggcgcatagn

SEQ ID NO: 257651 - DNA, 211 bp, Homo sapiens
  misc_feature: GYAE6OF02GID65.49.15.B04.1.454.CMB.1.raw
  modified_base (203)..(211): a, c, t, g, unknown or other
  misc_feature (203)..(211): n is a, c, g, or t
tcagagtcgagagacacgaccggtgctcgatttagacagtatatatccgcgggcacgaccggtgctcgatttagagtgagctcgctgggtttgggggaagaggaagactgacggtcccccaggagttcaggtgctgggcacagcggccctgggctgcctggtcaaggactacttcctctgagcgggctggcaaggcgcatagnnnnnnnnn

SEQ ID NO: 257652 - DNA, 184 bp, Homo sapiens
  misc_feature: GYAE6OF02GP2S7.49.15.B04.1.454.CMB.1.raw
  modified_base (172)..(184): a, c, t, g, unknown or other
  misc_feature (172)..(184): n is a, c, g, or t
tcagagtcgagagacacgaccggtgctcgatttagacagtatatatccgcggacacgaccggtgctcgatttacgatcgtctgtgttgggtttggcagcctaaggctgccccagcgtcactctgttccgcctcctctctctcgactctgagcgggctggcaaggcgcatagnnnnnnnnnnnnn

SEQ ID NO: 257653 - DNA, 200 bp, Homo sapiens
  misc_feature: GYAE6OF02F77BG.49.15.B04.1.454.CMB.1.raw
  modified_base (199)..(200): a, c, t, g, unknown or other
  misc_feature (199)..(200): n is a, c, g, or t
tcagagtcgagagacacgaccggtgctcgatttagacagtatatatccgcggcacgaccggtgctcgatttagctctacgctcagggcacgaccggtgctcgatttagtcacgcgagaaagggaaggggctggccctgacgtgtttctgttcccgccctcctctctctcgactctgagcgggctggcaaggcgcatagnn

SEQ ID NO: 257654 - DNA, 190 bp, Homo sapiens
  misc_feature: GYAE6OF02I427C.49.15.B04.1.454.CMB.1.raw
  modified_base (168)..(190): a, c, t, g, unknown or other
  misc_feature (168)..(190): n is a, c, g, or t
tcagagtcgagagacacgaccggtgctcgatttagacagtatatatccggcgggcacgaccggtgctcgatttagtcacgcgagaaagggaaaggggctggccctgacgtgttctgttcccgccctcctcgtctctcgactctgagcgggctggcaaggcgcgatagnnnnnnnnnnnnnnnnnnnnnnn

SEQ ID NO: 257655 - DNA, 165 bp, Homo sapiens
  misc_feature: GYAE6OF02H8S13.49.15.B04.1.454.CMB.1.raw
  modified_base (164)..(165): a, c, t, g, unknown or other
  misc_feature (164)..(165): n is a, c, g, or t
tcagagtcgagagacacgaccggtgctcgatttagacagtatatatccgcgggcagaccggtgctcgatttagtcacgcgagaaagggaaaggggctggccctgacgtgtttctgttcccaccctcctctctctcgactctgagcggctggcaaggcgcatagnn

SEQ ID NO: 257656 - DNA, 175 bp, Homo sapiens
  misc_feature: GYAE6OF02GZTB7.49.15.B04.1.454.CMB.1.raw
  modified_base (174)..(175): a, c, t, g, unknown or other
  misc_feature (174)..(175): n is a, c, g, or t
tcagagtcgagagacacgaccggtgctcgatttagacagtatatatccgcgggcacgaccggtgctcgatttagatcgtctgtgttgggtttgggcagcctaaggctgccccagcgtcactctgttcccaccctcctctctctcgactctgagcgggctggcaaggcgcatagnn

SEQ ID NO: 257657 - DNA, 166 bp, Homo sapiens
  misc_feature: GYAE6OF02IUQEL.49.15.B04.1.454.CMB.1.raw
  modified_base (165)..(166): a, c, t, g, unknown or other
  misc_feature (165)..(166): n is a, c, g, or t
tcagagtcgagagacacgaccggtgctcgatttagacagtatatatccgcgggcagaccggtgctcgatttagtcacgcgagaaagggaaaggggctggccctgacgtgtttctgttcccaccctcctctctctcgactctgagcgggctggcaaggcgcatagnn

SEQ ID NO: 257658 - DNA, 213 bp, Homo sapiens
  misc_feature: GYAE6OF02IM7V9.49.15.B04.1.454.CMB.1.raw
  modified_base (212)..(213): a, c, t, g, unknown or other
  misc_feature (212)..(213): n is a, c, g, or t
tcagagtcgagagacacgaccggtgctcgatttagacagtatatatccacgggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnn

SEQ ID NO: 257659 - DNA, 167 bp, Homo sapiens
  misc_feature: GYAE6OF02H1ZDW.49.15.B04.1.454.CMB.1.raw
  modified_base (166)..(167): a, c, t, g, unknown or other
  misc_feature (166)..(167): n is a, c, g, or t
tcagagtcgagagacacgaccggtgctcgatttagacagtatatatccgcgggcacgaccggtgctcgatttagtcacgcgagaaagggaaaggggctggccctgacgtgtttctgttcccaccctcctctctctcgactctgagcgggctggcaaggcgcatagnn

SEQ ID NO: 257660 - DNA, 175 bp, Homo sapiens; identical to SEQ ID NO: 257614
  misc_feature: GYAE6OF02JG07Y.49.15.B04.1.454.CMB.1.raw
  modified_base (175)..(175): a, c, t, g, unknown or other
  misc_feature (175)..(175): n is a, c, g, or t

SEQ ID NO: 257661 - DNA, 167 bp, Homo sapiens
  misc_feature: GYAE6OF02GQVZ9.49.15.B04.1.454.CMB.1.raw
  modified_base (165)..(167): a, c, t, g, unknown or other
  misc_feature (165)..(167): n is a, c, g, or t
tcagagtcgagagacacgaccggtgctcgatttagacagtatatatccgcgggcacgaccggtgctcgatttagtcacgcgagaaagggaaaggggctggccctgacgtgtttctgttcccacctcctctctctcgactctgagcgggctggcaaggcgcatagnnn

SEQ ID NO: 257662 - DNA, 182 bp, Homo sapiens
  misc_feature: GYAE6OF02INYU2.49.15.B04.1.454.CMB.1.raw
  modified_base (168)..(182): a, c, t, g, unknown or other
  misc_feature (168)..(182): n is a, c, g, or t
tcagagtcgagagacacgaccggtgctcgatttagacagtatatatccgcgggcacgaccggtgctcgatttagtcacgcgagaaagggaaagggggctggccctgacgtgtttctgttcccgccctcctctctctcgactctgagcgggctgggcaaggcgcatagnnnnnnnnnnnnnnn

SEQ ID NO: 257663 - DNA, 256 bp, Homo sapiens
  misc_feature: GYAE6OF02FO9V6.49.15.B04.1.454.CMB.1.raw
  modified_base (253)..(256): a, c, t, g, unknown or other
  misc_feature (253)..(256): n is a, c, g, or t
tcagagtcgagagacacgaccggtgctcgatttagacagtatatatccgcgggcacgaccggtgctcgatttagtcgagctctctcgcgggcacgaccggtgctcgatttagtcgagctctacgtacggcggcgaccgaccggtgcttcgattttacgtccacgcgagaaaggaaaggggctggccctgacggtgtttctgttacccgaccctcctctctctcgactctgagcgggctggcaaggcgcatagnnnn

SEQ ID NO: 257664 - DNA, 259 bp, Homo sapiens
  misc_feature: GYAE6OF02I9URQ.49.15.B04.1.454.CMB.1.raw
  modified_base (254)..(259): a, c, t, g, unknown or other
  misc_feature (254)..(259): n is a, c, g, or t
tcagagtcgagagacacgaccggtgctcgatttagacagtatatatccgcgggcacgaccggtgctcgatttagtcgagctctacgtacggcgggcgaccgaccggtgcttcgatttacgtccgacgctctctacggcggtcacgacggtggcttcgatttacgtcacgcgagaagggaaggggctggccctgacgtgtttctgttcccaccctcctctctctcgactctgagcgggctggcaaggcgcatagnnnnnn

SEQ ID NO: 257665 - DNA, 282 bp, Homo sapiens
  misc_feature: GYAE6OF02I8LGS.49.15.B04.1.454.CMB.1.raw
  modified_base (268)..(282): a, c, t, g, unknown or other
  misc_feature (268)..(282): n is a, c, g, or t
tcagagtcgagagacacgaccggtgctcgatttagacagtatatatccgcgggcatagtatatccgcgggcacgaccggtgctcgatttagtcgagctctctcgcgggcacgaccggtgctccgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnnnnnnnnnnnnn

SEQ ID NO: 257666 - DNA, 325 bp, Homo sapiens
  misc_feature: GYAE6OF02JAQDG.49.15.B04.1.454.CMB.1.raw
  modified_base (320)..(325): a, c, t, g, unknown or other
  misc_feature (320)..(325): n is a, c, g, or t
tcagagtcgagagacacgaccggtgctcgatttagacagtatatattccggtcggggacagtaatatatccgcccgggcgacgtaccggtgctcgagtttagtcgagcgtcctcgtcgcgggcacgaccggtagctcgactttgtcgagctctctcgcgggcacgaccggtagctcgatttagagagagtgtgttgggtttgggggaagaggaagactgacggtcccccaggagttcaggtgctgggcacagcggccctgggctgcctggtcaaggctacttcctctctcgactctgagcgggctggcaaggcgcatagnnnnnn

SEQ ID NO: 257667 - DNA, 108 bp, Homo sapiens
  misc_feature: GYAE6OF02I8J0A.49.15.B04.1.454.CMB.1.raw
  modified_base (87)..(87): a, c, t, g, unknown or other
  misc_feature (87)..(87): n is a, c, g, or t
  modified_base (108)..(108): a, c, t, g, unknown or other
  misc_feature (108)..(108): n is a, c, g, or t
tcagagtcgagagacacgaccggtgctcgatttagacagtatatatccgcgggcacgaccggtgctcgatttagtcgagctctctancgggctggcaaggcgcatagn

SEQ ID NO: 257668 - DNA, 166 bp, Homo sapiens
  misc_feature: GYAE6OF02IMCAV.49.15.B04.1.454.CMB.1.raw
  modified_base (166)..(166): a, c, t, g, unknown or other
  misc_feature (166)..(166): n is a, c, g, or t
tcagagtcgagagacacgaccggtgctcgatttagacagtatatatccgcgggcacgaccggtgctcgatttagtcacgcagaaagggaaagggggctggacctgacgtgtttctgttcccaccctcctctctctcgactctgagcgggctggcaaggcgcatagn

SEQ ID NO: 257669 - DNA, 109 bp, Homo sapiens
  misc_feature: GYAE6OF02GIUJE.49.15.B04.1.454.CMB.1.raw
  modified_base (109)..(109): a, c, t, g, unknown or other
  misc_feature (109)..(109): n is a, c, g, or t
tcagagtcgagagacacgaccggtgctcgatttagacagtatatatccgcgggcacgaccggtgctcgatttagtgtgagtagttcagcgggctggcaaggcgcatagn

SEQ ID NO: 257670 - DNA, 173 bp, Homo sapiens
  misc_feature: GYAE6OF02IEFP3.49.15.B04.1.454.CMB.1.raw
  modified_base (166)..(173): a, c, t, g, unknown or other
  misc_feature (166)..(173): n is a, c, g, or t
tcagagtcgagagacacgaccggtgctcgatttagacagtatatatccgcgggcagaccggtgctcgatttagtcacgcgagaaagggaaagggggctggccctgacgtgtttctgttcccaccctcctctctctcgactctgagcgggctggcaaggcgcatagnnnnnnnn

SEQ ID NO: 257671 - DNA, 164 bp, Homo sapiens
  misc_feature: GYAE6OF02IYD45.49.15.B04.1.454.CMB.1.raw
  modified_base (155)..(164): a, c, t, g, unknown or other
  misc_feature (155)..(164): n is a, c, g, or t
tcagagtcgagagacacgaccggtgctcgatttagacagtatatatccgcggcagaccggtgctcgatttagtcacgcgagaaggaagggctggcctgacgtgttctgttccacctcctctctctcgactctgagcggctggcaaggcgcatagnnnnnnnnnn

SEQ ID NO: 257672 - DNA, 205 bp, Homo sapiens
  misc_feature: GYAE6OF02HUW2O.49.15.B04.1.454.CMB.1.raw
  modified_base (201)..(205): a, c, t, g, unknown or other
  misc_feature (201)..(205): n is a, c, g, or t
tcagagtcgagagacacgaccggtgctcgatttagacagtatatatccgcgggcgacgaccggtgctcgatttagctctacgctcagggcacgaccggtgctcgatttagtcacgcgagaaagggaaggggctggccctgacgtgtttctgttcccgccctcctctctctcgactctgagcgggctggcaaggcgcatagnnnnn

SEQ ID NO: 257673 - DNA, 215 bp, Homo sapiens
  misc_feature: GYAE6OF02HWO3J.49.15.B04.1.454.CMB.1.raw
  modified_base (214)..(215): a, c, t, g, unknown or other
  misc_feature (214)..(215): n is a, c, g, or t
tcagagtcgagagacacgaccggtgctcgatttagacagtatatatcgcgggcacgaccggtgctcgatttagtcgagctctctcgcgggcacgaccggtgctcgatttagtagtgtagattccgcgggatttagtagtgtagattccgcgggctggcaaggcgatcattagtacttatgttgcacgtctgagcgggctggcaaggcgcatagnn

SEQ ID NO: 257674 - DNA, 238 bp, Homo sapiens
  misc_feature: GYAE6OF02HWRHY.49.15.B04.1.454.CMB.1.raw
  modified_base (235)..(238): a, c, t, g, unknown or other
  misc_feature (235)..(238): n is a, c, g, or t
tcagagtcgagagacacgaccggtgctcgatttagacagtatatatcgcgggcacgaccggtgctcgatttagacagttatatccgcgggcacgaccggtgctcgatttagcgagacgcgcagggcacgaccggtgctcgatttagtcacgcgagaaaggaaggggctggccctgacgtgtttctgttcccacctcctctctctcgactctgagcgggctggcaaggcgcatagnnnn

SEQ ID NO: 257675 - DNA, 252 bp, Homo sapiens
  misc_feature: GYAE6OF02HSATM.49.15.B04.1.454.CMB.1.raw
  modified_base (250)..(252): a, c, t, g, unknown or other
  misc_feature (250)..(252): n is a, c, g, or t
tcagagtcgagagacacgaccggtgctcgatttagacagtatatatccgcgggcacgaccggtgctcgatttagacagtatatatccgcgggcacgaccggtgctcgatttagagagagtgtgttgggttgggggaagaggaagactgacggtcccccaggagttcaggtgctgggcacagcggccctgggctgcctggtcaagtactacttcctctctcgactctgagcgggctggcaaggcgcatagnnn

SEQ ID NO: 257676 - DNA, 167 bp, Homo sapiens
  misc_feature: GYAE6OF02FIQPO.49.15.B04.1.454.CMB.1.raw
  modified_base (167)..(167): a, c, t, g, unknown or other
  misc_feature (167)..(167): n is a, c, g, or t
tcagagtcgagagacacgaccggtgctcgatttagacagtatatatccgcgggcacgaccggtgctcgatttagtcacgcgagaaagggaaagggggctggccctgacgtgtttctgttcccaccctcctctctctcgactctgagcgggctggcaaggcgcatagn

SEQ ID NO: 257677 - DNA, 193 bp, Homo sapiens
  misc_feature: GYAE6OF02JVHIP.49.15.B04.1.454.CMB.1.raw
  modified_base (178)..(178): a, c, t, g, unknown or other
  misc_feature (178)..(178): n is a, c, g, or t
  modified_base (186)..(193): a, c, t, g, unknown or other
  misc_feature (186)..(193): n is a, c, g, or t
tcagagtcgagagacacgaccggtgctcgatttagacagtatatatccgcgggcacgaccggtgctcgatttagacagtatatatccgcgggcacgaccggtgctcgatttagtcgagctctctcgcgggcacgaccggtgctcgatttagcgagctctcacgcgggctggcaaggcnctatagcnnnnnnnn

SEQ ID NO: 257678 - DNA, 219 bp, Homo sapiens
  misc_feature: GYAE6OF02IRMLM.49.15.B04.1.454.CMB.1.raw
  modified_base (211)..(219): a, c, t, g, unknown or other
  misc_feature (211)..(219): n is a, c, g, or t
tcagagtcgagagacacgaccggtgctcgatttagacagtatatattccgcggcacgaccggtgctcgatttagagagagtagtgttgggtttggggaagaggaagactgacggtcccccaggagttcaggtgctgggcacagcggccctgggctgcctggtcaaggactactcctctctcgactctgagcgggctggcaaggcgcatagnnnnnnnnn

SEQ ID NO: 257679 - DNA, 203 bp, Homo sapiens
  misc_feature: GYAE6OF02ICHF2.49.15.B04.1.454.CMB.1.raw
  modified_base (200)..(203): a, c, t, g, unknown or other
  misc_feature (200)..(203): n is a, c, g, or t
tcagagtcgagagacacgaccggtgctcgatttagacagtatatatccgcgggcacgaccggtgctcgatttagcgagacgcgcagggcacgaccggtgctcgatttagtcacgcgagaaagggaaggggctggccctgacgtgtttctgttcccaccctcctctctctcgactctgagcgggctggcaaggcgcatagnnnn

SEQ ID NO: 257680 - DNA, 178 bp, Homo sapiens
  misc_feature: GYAE6OF02GBFDR.49.15.B04.1.454.CMB.1.raw
  modified_base (175)..(178): a, c, t, g, unknown or other
  misc_feature (175)..(178): n is a, c, g, or t
tcagagtcgagagacacgaccggtgctcgatttagacagtatatatccgcgggcacgaccggtgctcgatttagatcgtctgtgttgggtttgggcagcctaaggctgcccccagcgtcactctgttcccaccctcctctctctcgactctgagcgggctggcaaggcgcatagnnnn

SEQ ID NO: 257681 - DNA, 311 bp, Homo sapiens
  misc_feature: GYAE6OF02HQIEQ.49.15.B04.1.454.CMB.1.raw
  modified_base (308)..(311): a, c, t, g, unknown or other
  misc_feature (308)..(311): n is a, c, g, or t
tcagagtcgagagacacgaccggtgctcgatttagacagtatatatccgcgggcatatatatccgccgggcacgaccggtgctcgatttagtcgagctctctcgcgggcacgaccggtagctcgactttgtcgagctctctcgcgggcacgaccggtgctcgatttagagagagtgtgttgggtttgggggaagaggaagacgtgaccggtcccccaggagttcaggtgctgggcacagcggccctgggctgcctggtcaaggactacttcctcgtagcactctgagcgggctggcaaggcgcatagnnnn

SEQ ID NO: 257682 - DNA, 253 bp, Homo sapiens
  misc_feature: GYAE6OF02IQATT.49.15.B04.1.454.CMB.1.raw
  modified_base (250)..(253): a, c, t, g, unknown or other
  misc_feature (250)..(253): n is a, c, g, or t
tcagagtcgagagacacgaccggtgctcgatttagacagtatatatccgcgggcacgaccggtgctcgatttagatcacgtgcgtcgcgggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnn

SEQ ID NO: 257683 - DNA, 166 bp, Homo sapiens; identical to SEQ ID NO: 257611
  misc_feature: GYAE6OF02IWD4R.49.15.B04.1.454.CMB.1.raw
  modified_base (166)..(166): a, c, t, g, unknown or other
  misc_feature (166)..(166): n is a, c, g, or t

SEQ ID NO: 257684 - DNA, 169 bp, Homo sapiens
  misc_feature: GYAE6OF02HRTH2.49.15.B04.1.454.CMB.1.raw
  modified_base (166)..(169): a, c, t, g, unknown or other
  misc_feature (166)..(169): n is a, c, g, or t
tcagagtcgagagacacgaccggtgctcgatttagacagtatatatccgcgggcacgaccggtgctcgatttagtcacgcgagaaagggaaaggggctggccctgacgtgtttctgttcccaccctcctctctctcgactctgagcgggctggcaaggcgcatagnnnn

SEQ ID NO: 257685 - DNA, 176 bp, Homo sapiens; identical to SEQ ID NO: 257597
  misc_feature: GYAE6OF02HNW1M.49.15.B04.1.454.CMB.1.raw
  modified_base (175)..(176): a, c, t, g, unknown or other
  misc_feature (175)..(176): n is a, c, g, or t

SEQ ID NO: 257686 - DNA, 244 bp, Homo sapiens
  misc_feature: GYAE6OF02FP4JO.49.15.B04.1.454.CMB.1.raw
  modified_base (241)..(244): a, c, t, g, unknown or other
  misc_feature (241)..(244): n is a, c, g, or t
tcagagtcgagagacacgaccggtgctcgatttagacagtatatatccgcgggcacgaccggtgctcgatttagtcgagctctctcgcgggcacgaccggtgctcgatttagtcgagctctctcgcgggcacgaccggtgctcgatttagtcacgcgagaaagggaaggggctggccctgacgtgtttctgttcccgccctcctctctctcgactctgagcgggctggcaaggcgcatagnnnn

SEQ ID NO: 257687 - DNA, 169 bp, Homo sapiens
  misc_feature: GYAE6OF02JQQ7E.49.15.B04.1.454.CMB.1.raw
  modified_base (160)..(169): a, c, t, g, unknown or other
  misc_feature (160)..(169): n is a, c, g, or t
tcagagtcgagagacacgaccggtgctcgatttagacagtatatatccgcggcacgaccggtgctcgatttagtcacgcgagaaagggaaggggctggccctgacgtgttctgttccgcctcctctctctcgactctgagcggctggcaaggcgcatagnnnnnnnnnn

SEQ ID NO: 257688 - DNA, 214 bp, Homo sapiens
  misc_feature: GYAE6OF02HZRDG.49.15.B04.1.454.CMB.1.raw
  modified_base (213)..(214): a, c, t, g, unknown or other
  misc_feature (213)..(214): n is a, c, g, or t
tcagagtcgagagacacgaccggtgctcgatttagacagtatatatccgcgggcacgaccggtgctcgatttagagagagtgtgttgggtttggggggaagaggaagactgacggtcccccaggagttcaggtgctgggcacagcggccctgggctgcctggtcaaggactacttcctctctcgactctgagcgggctggcaaggcgcatagnn

SEQ ID NO: 257689 - DNA, 213 bp, Homo sapiens
  misc_feature: GYAE6OF02JU4UM.49.15.B04.1.454.CMB.1.raw
  modified_base (211)..(213): a, c, t, g, unknown or other
  misc_feature (211)..(213): n is a, c, g, or t
tcagagtcgagagacacgaccggtgctcgatttagacagtatatatccgcgggcacgaccggtgctcgatttagagagagtgtgttgggtttgggggaagaggaagactgacggtcccccaggagttcaggtgctgggcacagcggccctgggctgcctggtcaaggctacttcctctctcgactctgagcgggctggcaaggcgcatagnnn

SEQ ID NO: 257690 - DNA, 252 bp, Homo sapiens
  misc_feature: GYAE6OF02I7NOK.49.15.B04.1.454.CMB.1.raw
  modified_base (246)..(252): a, c, t, g, unknown or other
  misc_feature (246)..(252): n is a, c, g, or t
tcagagtcgagagacacgaccggtgctcgatttagacagtatatatccgcgggcacgaccggtgctcgatttagtcgagctctctcgcgggcacgaccggtgctcgatttagtcgagctctcgtcggcgggcacgaccggtgcttcgatttacgtcacgcgagaaagggaaagggggctggcctgacgtgtttctgttcccaccctcctctctctcgactctgagcgggctggcaaggcgcatagnnnnnnn

SEQ ID NO: 257691 - DNA, 169 bp, Homo sapiens
  misc_feature: GYAE6OF02JF55G.49.15.B04.1.454.CMB.1.raw
  modified_base (167)..(169): a, c, t, g, unknown or other
  misc_feature (167)..(169): n is a, c, g, or t
tcagagtcgagagacacgaccggtgctcgatttagacagtatatatccgcgggcacgaccggtgctcgatttagtcacgcgagaaagggaaagggggctggccctgacgtgtttctgttcccgccctcctctctctcgactctgagcgggctggcaaggcgcatagnnn

SEQ ID NO: 257692 - DNA, 216 bp, Homo sapiens
  misc_feature: GYAE6OF02IFJTT.49.15.B04.1.454.CMB.1.raw
  modified_base (212)..(216): a, c, t, g, unknown or other
  misc_feature (212)..(216): n is a, c, g, or t
tcagagtcgagagacacgaccggtgctcgatttagacagtatatatcgcggcacgaccggtgctcgatttagtcgagctctctcgcggcacgaccggtgctcgatttagtagtgtagattccgcgggatttagtagtgtagattccgcgggctggcaaggcgatcattagtacttatgttgcacgtctgagcgggctggcaaggcgcatagnnnnn

SEQ ID NO: 257693 - DNA, 343 bp, Homo sapiens
  misc_feature: GYAE6OF02GMWIV.49.15.B04.1.454.CMB.1.raw
  modified_base (265)..(266): a, c, t, g, unknown or other
  misc_feature (265)..(266): n is a, c, g, or t
  modified_base (268)..(343): a, c, t, g, unknown or other
  misc_feature (268)..(343): n is a, c, g, or t
tcagagtcgagagacacgaccggtgctcgattttagacagtatatatccggacggggcaacgaccggtgctcgatttagtcgagctctctcgcgggcacgaccggtgctcgattttagtccgagctctacgtcggcggcacgaccggtgcgtcgattttacgtcacgtcgagaaaggaagggggctggcccctgacggtgtttctgttcccaccctcgtctactcctcgactctgacgtcgggctggccaaggctcgaatagcanncnnnnnnnnnnnnnnnnnnnnnnnnnnnnnnnnnnnnnnnnnnnnnnnnnnnnnnnnnnnnnnnnnnnnnnnnnnnn

SEQ ID NO: 257694 - DNA, 310 bp, Homo sapiens
  misc_feature: GYAE6OF02IDYD1.49.15.B04.1.454.CMB.1.raw
  modified_base (216)..(216): a, c, t, g, unknown or other
  misc_feature (216)..(216): n is a, c, g, or t
  modified_base (305)..(310): a, c, t, g, unknown or other
  misc_feature (305)..(310): n is a, c, g, or t
tcagagtcgagagacacgaccggtgctcgatttagacagtatatatccgcgggcatatatatccgcgggcacgaccggtgctcgatttagtcgagctctctcgcgggcacgaccggtgctcgactttgtcgagctctctcgcgggcacgaccggtgctcgatttagagagagtgtgttgggtttgggggaagaggagactgaccggtcccccaggngttcaggtgctgggcacgagcggccgtgggctgccgtggtcaaggctacttcctctctcgaatctgaggcggctggcaaggcgcatagnnnnnn

SEQ ID NO: 257695 - DNA, 177 bp, Homo sapiens
  misc_feature: GYAE6OF02I7DJK.49.15.B04.1.454.CMB.1.raw
  modified_base (149)..(149): a, c, t, g, unknown or other
  misc_feature (149)..(149): n is a, c, g, or t
  modified_base (156)..(156): a, c, t, g, unknown or other
  misc_feature (156)..(156): n is a, c, g, or t
  modified_base (168)..(177): a, c, t, g, unknown or other
  misc_feature (168)..(177): n is a, c, g, or t
tcagagtcgagagacacgaccggtgctcgatttagacagtatatatcgcgggcacgaccggtgctcgatttagtcgagctctctcgcgggcacgaccggtgctcgatttagtagtgtagattccgcgggatttagtagtgtagattcgnggcgtgngagacgcatagnnnnnnnnnn

SEQ ID NO: 257696 - DNA, 635 bp, Homo sapiens
  misc_feature: GYAE6OF02F1Y4U.49.15.B04.1.454.CMB.1.raw
  modified_base (202)..(202): a, c, t, g, unknown or other
  misc_feature (202)..(202): n is a, c, g, or t
  modified_base (300)..(300): a, c, t, g, unknown or other
  misc_feature (300)..(300): n is a, c, g, or t
tcagagtcgagagacacgaccggtgctcgatttagacagtatatatccgcgggcacgaccggtgctcgatttagacagtatatatccgcgggcacgaccggtgctcgatttagacagtatgtatccggcgggcacgaccggtgctcgtttagagagagtgtgttgggtttgggggtgggtccaggaggcagaactctgggtntctcaccatggcctggactccctctacttcctccccctcctcactctctgcacagacctcgtgacgcctcctatgagctgacacagccaccctcggtntctggtcgtcctcgaggacagacggaccaggtactaccgacctgctcgtggacgatgcagttcgacccaaagccaatctaggtaccttacgtcggtaaccagtacgaagtaacgccgacggcccgacggtccccgtacgttccgttgtactacgttaactttaacgtaaacgttacgtttaggaacgtacgggtacccgttcggaaccgggtaccctcggtacgtacgtacttcgttcgacggtccctaccgacgtccgtacgacggtaccgtaaaccaacgtacgttaccgtacggttaccgtaacctagtaccgtagggtacggtaaccgggg

SEQ ID NO: 257697 - DNA, 264 bp, Homo sapiens
  misc_feature: GYAE6OF02F698D.49.15.B04.1.454.CMB.1.raw
  modified_base (190)..(190): a, c, t, g, unknown or other
  misc_feature (190)..(190): n is a, c, g, or t
  modified_base (240)..(264): a, c, t, g, unknown or other
  misc_feature (240)..(264): n is a, c, g, or t
tcagagtcgagagacacgaccggtgctcgatttagacagtatatatccgcgggcacgaccggtgctcgatttagtcgagctctctcgcgggcacgaccggtgctcgatttagtcgagctctcgtcggcgggcaccgacggtgctcgatttacgcacgcgagaaagggaaggggctggcctgacgtgttcngttcccacctctctctctcgactctgagcgggctggacaaggcacatagnnnnnnnnnnnnnnnnnnnnnnnnn

SEQ ID NO: 257698 - DNA, 167 bp, Homo sapiens
  misc_feature: GYAE6OF02H9LIA.49.15.B04.1.454.CMB.1.raw
  modified_base (164)..(167): a, c, t, g, unknown or other
  misc_feature (164)..(167): n is a, c, g, or t
tcagagtcgagagacacgaccggtgctcgatttagacagtatatatccgcgggcagaccggtgctcgatttagtcacgcgagaaagggaaaggggctggccctgacgtgtttctgttcccgccctcctctctctcgactctgagcggctggcaaggcgcatagnnnn

SEQ ID NO: 257699 - DNA, 218 bp, Homo sapiens
  misc_feature: GYAE6OF02FN5LS.49.15.B04.1.454.CMB.1.raw
  modified_base (204)..(218): a, c, t, g, unknown or other
  misc_feature (204)..(218): n is a, c, g, or t
tcagagtcgagagacacgaccggtgctcgatttagacagtatatatccgcgggcacgaccggtgctcgatttagtcgagctctctcgcgggcacgaccggtgctcgatttagtcacgcgagaaagggaaaggggctggccctgacgtgtttctgttcccaccctcctctctctcgactctgagcgggctggcaaggcgcatagnnnnnnnnnnnnnnn

SEQ ID NO: 257700 - DNA, 201 bp, Homo sapiens
  misc_feature: GYAE6OF02HJKDV.49.15.B04.1.454.CMB.1.raw
  modified_base (178)..(201): a, c, t, g, unknown or other
  misc_feature (178)..(201): n is a, c, g, or t
tcagagtcgagagacacgaccggtgctcgatttagacagtatatatcgcgggcacgaccggtgctcgatttagtcgagctctctcgcgggcacgaccggtgctcgatttagtagtgtagattccgcgggatttagtagtgtagattcgaggcgggctggacgaacgggcgcaagtagnnnnnnnnnnnnnnnnnnnnnnnn

SEQ ID NO: 257701 - DNA, 204 bp, Homo sapiens
  misc_feature: GYAE6OF02HIHGB.49.15.B04.1.454.CMB.1.raw
  modified_base (114)..(114): a, c, t, g, unknown or other
  misc_feature (114)..(114): n is a, c, g, or t
  modified_base (166)..(204): a, c, t, g, unknown or other
  misc_feature (166)..(204): n is a, c, g, or t
tcagagtcgagagacacgaccggtgctcgatttagacagtatatatccgcgggcagaccggtgctcgatttagtcacgcgagaaagggaaaggggctggccctgacgtgtttcnggttcccgccctcctctctctcgactctgagcgggctggcaaggcgcatagnnnnnnnnnnnnnnnnnnnnnnnnnnnnnnnnnnnnnnn

SEQ ID NO: 257702 - DNA, 301 bp, Homo sapiens
  misc_feature: GYAE6OF02H1ZEN.49.15.B04.1.454.CMB.1.raw
  modified_base (251)..(301): a, c, t, g, unknown or other
  misc_feature (251)..(301): n is a, c, g, or t
tcagagtcgagagacacgaccggtgctcgatttagacagtatatatccgcgggcacgaccggtgctcgatttagtcgagctctctcgcgggcacgaccggtgctcgatttagtcgagctctctcggcgggcacgaccggtgcttcgattttagcacgcgagaaaagggaaggggctggcctgacgtgtttctgttccccgccctcctctctctcgtactctgaggcgggctggacaacgggctcaataggnnnnnnnnnnnnnnnnnnnnnnnnnnnnnnnnnnnnnnnnnnnnnnnnnnn

SEQ ID NO: 257703 - DNA, 282 bp, Homo sapiens
  misc_feature: GYAE6OF02HZ913.49.15.B04.1.454.CMB.1.raw
  modified_base (260)..(282): a, c, t, g, unknown or other
  misc_feature (260)..(282): n is a, c, g, or t
tcagagtcgagagacacgaccggtgctcgatttagacagtatatatccgcgggcacgaccggtgctcgatttagtcgagctctctcgcgggcacgaccggtgctcgattttagtcgagctctcgtcggcgggcgaccgaccgggtgcttcgtattttacgtccacgcgagaaaggggaaggggctggcctgacggttgtttctcgttacccaccctcctctctctcgactctgaggcgggctggacgaaggcgacatagnnnnnnnnnnnnnnnnnnnnnnn

SEQ ID NO: 257704 - DNA, 173 bp, Homo sapiens
  misc_feature: GYAE6OF02H2V9D.49.15.B04.1.454.CMB.1.raw
  modified_base (166)..(173): a, c, t, g, unknown or other
  misc_feature (166)..(173): n is a, c, g, or t
tcagagtcgagagacacgaccggtgctcgatttagacagtatatatccgcgggcacgaccggtgctcgatttagtcacgcgagaaagggaaagggggctggccctgacgtgtttctgttcccaccctcctctctctcgactctgagcggctggcaaggcgcatagnnnnnnnn

SEQ ID NO: 257705 - DNA, 205 bp, Homo sapiens
  misc_feature: GYAE6OF02I5WAV.49.15.B04.1.454.CMB.1.raw
  modified_base (152)..(152): a, c, t, g, unknown or other
  misc_feature (152)..(152): n is a, c, g, or t
  modified_base (170)..(170): a, c, t, g, unknown or other
  misc_feature (170)..(170): n is a, c, g, or t
  modified_base (173)..(205): a, c, t, g, unknown or other
  misc_feature (173)..(205): n is a, c, g, or t
tcagagtcgagagacacgaccggtgctcgatttagacagtatatatcgcgggcacgaccggtgctcgatttagtcgagctctctcgcgggcacgaccggtgctcgatttagtagtgtagattccgcgggtattttagtagtgtagattccgnggcggtgtgagacgcganagnnnnnnnnnnnnnnnnnnnnnnnnnnnnnnnnn

SEQ ID NO: 257706 - DNA, 236 bp, Homo sapiens
  misc_feature: GYAE6OF02F2QBE.49.15.B04.1.454.CMB.1.raw
  modified_base (217)..(236): a, c, t, g, unknown or other
  misc_feature (217)..(236): n is a, c, g, or t
tcagagtcgagagacacgaccggtgctcgatttagacagtatatatccgcgggcacgaccggtgctcgatttagagagagtgtgttgggtttgggggaagaggaagactgaccggtccccccaggagttcaggtgctgggcacgagccggccctgggctgcctggtcaaggactactcctctctcgactctgagcgggtctggacaaggcgcatagnnnnnnnnnnnnnnnnnnnn

SEQ ID NO: 257707 - DNA, 238 bp, Homo sapiens
  misc_feature: GYAE6OF02JE953.49.15.B04.1.454.CMB.1.raw
  modified_base (183)..(238): a, c, t, g, unknown or other
  misc_feature (183)..(238): n is a, c, g, or t
tcagagtcgagagacacgaccggtgctcgatttagacagtatatatccgcgggcacgaccggtgctcgatttagatcgtctgtgttgggtttggcagcctaaggctgcccccagcgtcactctgttccccaccctcctctctcgtcgtactctgacgcgggctggacaaagggcacatacgcnnnnnnnnnnnnnnnnnnnnnnnnnnnnnnnnnnnnnnnnnnnnnnnnnnnnnnnn

SEQ ID NO: 257708 - DNA, 263 bp, Homo sapiens
  misc_feature: GYAE6OF02G3C0E.49.15.B04.1.454.CMB.1.raw
  modified_base (247)..(263): a, c, t, g, unknown or other
  misc_feature (247)..(263): n is a, c, g, or t
tcagagtcgagagacacgaccggtgctcgatttagacagtatatatccgcgggcacgaccggtgctcgattagacagtatatatccgcgggcacgaccggtgctcgatttagagagagtgtgttgggtttgggggaagaggaagactgacggtcccccaggagttcaggtgctgggcacagcggccctgggctgcctggtcaaggctacttcctctctcgactctgagcggctggcaaggcgcatgnnnnnnnnnnnnnnnnn

SEQ ID NO: 257709 - DNA, 743 bp, Homo sapiens
  misc_feature: GYAE6OF01BJSGR.10.6.A06.1.454.CMB.1.raw
  modified_base (268)..(268): a, c, t, g, unknown or other
  misc_feature (268)..(268): n is a, c, g, or t
  modified_base (732)..(732): a, c, t, g, unknown or other
  misc_feature (732)..(732): n is a, c, g, or t
tcagcatagtagtgcacgaccggtgctcgatttagatctactgacagggggagagaggagccttagccctggattccaaggcctatccacttggtgatcagcacggagcaccgacgattcaccatggaactggggctccgctgggttttcctgtcgctattctagaaggtgtcctgtgtgaggtgcagctggtggagtcgtgggggaggcctggtcaaggccggggggtctcgtgagactgtcctgtgttgcctctggtacttccctntcgaggtacgtttcagcctatcgaacgtgggtcccgccgaggtccgtaccgaggggaacgggcctagggacgttcgggtccgacgaaaccgatccgaagtactagttatttcgaagttacacttaatacgtaccgctaagtaacttcgtaggtacggaaacgggtccctacctttaccaaccctagttaccctaccggaaggtacggtacccgaacccgacccgtaaagggtaaaccctcgtaaagttcggtacggtacctggaaacccttaaaggtacgtaaaccgaccggtaccggttaggggaaccgtcccgggaagggtaacccgaaccgggtaacaaaacgggttactttaaaccgtttaccggtaggttaaggcccggtaaaggttacggttaccggttttaaagggtcggggttaccgtaaggtaaaacgtttaaccgggtaggtaaaacccggttntttaacccggg

SEQ ID NO: 257710 - DNA, 565 bp, Homo sapiens
  misc_feature: GYAE6OF01EU00X.10.6.A06.1.454.CMB.1.raw
  modified_base (256)..(256): a, c, t, g, unknown or other
  misc_feature (256)..(256): n is a, c, g, or t
  modified_base (433)..(433): a, c, t, g, unknown or other
  misc_feature (433)..(433): n is a, c, g, or t
  modified_base (442)..(442): a, c, t, g, unknown or other
  misc_feature (442)..(442): n is a, c, g, or t
  modified_base (447)..(447): a, c, t, g, unknown or other
  misc_feature (447)..(447): n is a, c, g, or t
tcagcatagtagtgcacgaccggtgctcgatttagatctactgacagggggagagaggagccttagccctggattccgaggcctatccacttggtgatcagcacggagcaccgacgattcaccatggaactggggctccgctgggttttccttgtcgctattctagaaggtgtcctgtgtgaggtgcagctggtggagtctgggggaggcctggtcaaggccgggggggtctcgtgagactgtcctgtgttgcctntggattccctctcaggagtttcagcatgaactgggtccgccaggctccgaggggaaggcctgggagtgggtcgcgaaccatcgagcagtatttccagttacatatactacgcaagtaatctgtaggaacgggccgtcttcacctatcctccagacgacgacgccagacctacaatgngctgacaangaacngccgtaggggacgaccggaggacgacggcaaaggtataacgttacgaggtagcgtaggagttacgtttaaagtcgggtacgggttagaaagttaaccggtagggaaaccgcgttaacg

SEQ ID NO: 257711 - DNA, 705 bp, Homo sapiens
  misc_feature: GYAE6OF01AYWMW.10.6.A06.1.454.CMB.1.raw
tcagcatagtagtgcacgaccggtgctcgatttagatctactgacagggggagagaggagccttagccctggattccaaggcctatccacttggtgatcagcacggagcaccgacgattcaccatggaactggggctccgctgggttttccttgtcgctattctagaaggtgtcctgtgtgaggtgcagctggtggagtcgtgggggaggcctggtcgaaggccgggggggtctcgtgagactgtcctgtgttgcctcgtggtacttccctctcgtaggtagtttcagctatggtaacgtcggggtcccgccgaggccgtaccggaaggggaacgggcccgtggggacggtcggggtccgaccgaaacccgtagtccgaaggtaccgtaacgttacgtttaccctaaggtttaacaattaactaaccgtaaccgtacgaagtaacttcgtaggtacgggaaacggggtccctaccttacccgacctacgttcccgtaccgaaggtaacggaaccccgaaccggaccgtaaacgggaacttacgaaacgttcggtacggctacgaactaaagtacgaacgcggaccggtagggaccgaccggtaacggaccgacggaacaagtaacttacgttacgtggtacgacggaagtacggttacgttaggtgggttacgtagtaacgttaacggacggtaacgtagttacg

SEQ ID NO: 257712 - DNA, 954 bp, Homo sapiens
  misc_feature: GYAE6OF01CHW8F.10.6.A06.1.454.CMB.1.raw
tcagcatagtagtgcacgaccggtgctcgatttagatctactgacagggggagagaggagccttagccctggattccaaggcctatccacttggtgatcagcacggagcaccgacgattcaccatggaactggggctccgctgggttttccttgtcgctattctagaaggtgtcctgtgtgaggtgcagctgggtggagtcgtgggggaggcctggtcgaaggccggggggttctcgtgagtactgtcctgtgttcgcctcgtggtacttcccctctcgaggtagtttccgagtacagtaggaaccgttcggggtcccgcccgaagggtccgtccggaaggggtaacgggcccgttaggggaacgggttcggggttaccgaccgaaacccgtacgtaccgaacggtcctaacggtttacttttaccccgtaaagtttaacctaagttaacttaacccgtaaaccggtacctaacggtaaacgtttcgttacggttaacgggtaaacccggggttcccgtaccctttaccgaaccccttacgttaccccgtaaccccgaagggtaaaccgggaaccccgtaacccgggaaccccgtaaaacgggtaaacccgttaaccgtaaaacggttcgggttaaccggtacccgtttaaccggaaacccgttaaaaagtaccgggaaaaaccgttccgggtaccccgggttaggggaaccccgggtacccggggaaaaccgggaaccgtaaacccggggggaacccttaaaaagggtaaaccgtttttaacggttaaaccgggtttacgggttaccggggaaacccggttaaagggttaaaccggtttaccggttttttaaaacggggtttaccggggggttaacgggtttaacccggttaaaaacgggtttaaaccgggttaaccgggttaaaaacccggtaacccggtttttaaaccggg

SEQ ID NO: 257713 - DNA, 649 bp, Homo sapiens
  misc_feature: GYAE6OF01B3FOO.10.6.A06.1.454.CMB.1.raw
  modified_base (536)..(536): a, c, t, g, unknown or other
  misc_feature (536)..(536): n is a, c, g, or t
tcagcatagtagtgcacgaccggtgctcgatttagatctactgacaggggagagaggagccttagccctggattccaaggcctatccacttggtgatcagcacggagcaccgacgattcaccatggaactgggctccgctgggtttcctgtcgctattctagaagtgtcctgtgtgaggtgcagctggtggagtcgtggggaggcctggtcaaggccggggggtctcgtgagctgtcctgtgttcgcctcgtggtacttccctctcaggtagttttcagtcctagtcgtaacgtcgggtaccgccgaggtcctaccgaaggggaacggcccgtagggacgttcgggtcgacaaccagtcgagctaggttacttaccgtagttactaatactacgtacgcaagtactctggagtaacgggcctcttacaccgtatctaccagtacgacgaccgcgaaggacctcaagttgcggtactagaactaagtacgaactacggacccgttagggaccgaccggaacgggaaccaccgggtanaaacggtacttaacgttaccggtgtacggtaccggtaaggtacggttaacgtttacggtacgggttacgtacggttaaacgttacgggtaacgtaaccggaacgttttaccgg

SEQ ID NO: 257714 - DNA, 669 bp, Homo sapiens
  misc_feature: GYAE6OF01CE7SO.10.6.A06.1.454.CMB.1.raw
  modified_base (300)..(300): a, c, t, g, unknown or other
  misc_feature (300)..(300): n is a, c, g, or t
tcagcatagtagtgcacgaccggtgctcgatttagatctactgacgagggggagagaggagccttagccctggattccaaggcctatccacttggtgatcagcacggagcaccgacgattcaccatggaactggggctccgctgggttttccttgtcgctattctagaaggtgtcctgtgtgaggtgcagctggtgagtcgtggggagcctggtcaaggccgggggtctcgtagagactgtcctgtgtgcctcgtgtacttcctactcgaggtactttcagctagtcgacgtcgggtccncgaggcctacggagggacggtccgtggtacgtgggtcacctaaccgtagtcacgcgtacgtttacgtttcccgaagtttaaccaattaacgtactaacgactaagaacgttcgtaggttaccggaagggtccctacgttacctacccgtaattcctaccgaagtacccggaacgaccgaccgaaacgtaacgtacaagtcggtacgacgtacgaactaagtacgaacgtccggacgtagggacaccgggtaggaaccgcgggtacaaaggtacgtttacgtaccggtgtaacggtccgggtaaattacgggtacgttttaaacggcgggtttacgtaactaacggttacgaacggtacgtctttaacgg

SEQ ID NO: 257715 - DNA, 605 bp, Homo sapiens
  misc_feature: GYAE6OF01EKX79.10.6.A06.1.454.CMB.1.raw
tcagcatagtagtgcacgaccggtgctcgatttagatctactgacagggggagagaggagccttagccctggattccaaggcctatccacttggtgatcagcacggagcaccgacgattcaccatggaactggggctccgctgggttttccttgtcgctattctagaaggtgtcctgtgtgaggtgcagctggtggagtcgtgggggaggcctggtcaaggccgggggggtctctgagactgtcctgtgttgcctctggtacttccctctcgtaggtagtttcagctatgaactgggtcccgcgaggcctcgaggggaacgggccgtgggaggtgggtccgcaaccatcagctagtacttcagttactatatactacgacaagtaatcgtgtaggaacgggcctacttcacctactctaccgagacgacgacgacgaaggaacctcaagtgtacggctagaacaaagtgaacgtacgccggtagggacggaccggaggaccgaacgggacaaagattacgttagtgtacggtcggaagtaggttacgtttaaggcggggttacggtacgttaaacgtaaccgtaagggtaaaccgtacgttacgg

SEQ ID NO: 257716 - DNA, 751 bp, Homo sapiens
  misc_feature: GYAE6OF01DTKNB.10.6.A06.1.454.CMB.1.raw
tcagcatagtagtgcacgaccggtgctcgatttagatctactgacagggggagagaggagccttagccctggattccaaggcctatccacttggtgatcagcacggagcaccgacgattcacatggactggggctccgcttggttttctgtcgctattctagaaggtgtcctgtgtgaggtgcagcgtggtggagtcggtgggggaggccgtggtacgaagggccgggggggttctcgtgagtacgtgtcctggttgttcgccgttcgtcggtacttcccgtctccgtaaggtagttttcgacgtctagtacggtaacggttccggggtccccgccggtacgggaccctaccgggtaaggggggaaccggggtcccgtaggggtaggggttcggggtaccgaaccgtaaaccgtagtacggtaacgtacgttaagggttttaacctttacccgtaaggttaaccgtaaacttaaacgtaaccgtaacgacgtaagtaacttcgtaggtacgggaacgggtccgtcttaccgaactacgttcctacgaacgaacgtaccggacgaaccgaagtaacctacgaaaggttcggtacgtacgtacgaacaagttacggaacgacgtccgggtaggggaccgtcgggtaaacgggccgaaggacctaaggtaagttaccgttacggtgacggtacggtaattaccggtaagttagggtcggtagtacggtaactaagggtacgtagtactttacgg

SEQ ID NO: 257717 - DNA, 702 bp, Homo sapiens
  misc_feature: GYAE6OF01CMJG3.10.6.A06.1.454.CMB.1.raw
tcagcatagtagtgcacgaccggtgctcgatttagatctactgacagggggagagaggagccttagccctggattccaaggcctatccacttggtgatcagcacggagcaccgacgattcaccatggaactggggctccgctgggttttccttgtcgctattctagaaggtgtcctgtgtgaggtgcagctggtggagtcgtgggggaggcctggtcgaagggccgggggggtctcgtggagtactgtccgtgtgttcgcctcgtggtacttcccctctcgaggtagtttcacgctataggaacgttcgggtcccgccgacgggtcctaccggaggggaacgggccgtgggacggtcgggtccgaccaaccgtatccgagctaagttactttaccgtaagttactataactactacgcaagtaactcgtagtaggaacgggccctcttaccaccgtactccctaccgaaggtaccgaaccgaccgaccgaaacgggtaacctaccgaagttcggtacggtctaacggaacctaaagaccggtaaacgcggtaccgggtacggggaaccggaccgggaacgggaaccgtacgggaacaaaggtacttaacgttacgtaggtacggacggtaagtacggttaccgtttaaaggtcgggtttacggtacgttaacgtaacggtacggtaaacgtacgtttaacgg

SEQ ID NO: 257718 - DNA, 767 bp, Homo sapiens
  misc_feature: GYAE6OF01BC6YK.10.6.A06.1.454.CMB.1.raw
tcagcatagtagtgcacgaccggtgctcgatttagatctactgacagggggagagaggagccttagccctggattccaaggcctatccacttggtgatcagcacggagcaccgacgattcaccatggaactggggctccgcttgggttttcctgtcgctattctagaaggtgtcctgtgtgaggtgcagcgtgggtggagtcgtgggggagcctggtcgaacggccgggggtctcgtgagactgtcctgtgttcgcctctggacttccctctcgtaggtagtttcagacctagtcgtaacgtcgggtcccgccgacggtccgtaccgaagggggaacgggccgtaggggtacggttcggggtaccgacccgtaaaacccgacgtccggaacgaccgttaacggtttaacgtttacccgtaaacgtttaactaacttaacgttaaaccgttaccgacgtaaagtaacgttacgtacggtacggggaaaccgggtcccgtacccgtttaacccaccctaccgttacccgtaccgaaggtaaccgaccggaaccgacccgaaacgtaactaccgaagtcgggttacgaccgttagaactaaagtacggaaaccgacgtaccggtacggggaaccgtacggggaaccgtaacgaacgggactaaagtacgtttaaactacggtcggtaaggccgtaaggttaccgttaagtttaacgggtcgggttacgggttactaaacggtttaacggacggtaaaacgtcgttaacgg

SEQ ID NO: 257719 - DNA, 784 bp, Homo sapiens
  misc_feature: GYAE6OF01DC3XD.10.6.A06.1.454.CMB.1.raw
tcagcatagtagtgcacgaccggtgctcgatttagatctactgacagggggagagaggagccttagccctggattccaaggcctatccacttggtgatcagcgacggagccaccgacgattccaccagtggaacgtggggctccgtcgttcggttttccttgtcgtcttattcgtagtaaggtctccgtgtgtgtaggtgcgagtcgtggtggaggtcggtggggacgccgtggtacgacggggtccgggggttctacgtgacgtcgtcgtccgttgtcgttcgcctcgtgtaccttcctcgtcgtacggtcgttacgagctagtacggtaccgtcggacccgtacgtacggaccgtaccgggaaggggaccggtccggtagggtcgggtccggtaaccgaccgtaaaccgtcgtaccgaacggtcttaacgtttccgttaaccgtaagttaaacctagtaaacgttaccgtaaccgacgtaacgttaacgttacgtagggtaccggaccggtcccgtactaccgactaccctacgtaccgaaggtaccgaacgtccggtaaccgtaacggtaacccttagtacggttacggaccgggtactaacggtaaccgaagtaaccgacgtaaccgggaccggacgggtaaccggaccggaacggaaccggtaacgtacgtaaagttacgttacggtacgtggtacccgaggtaacgtacggttaacggttaaggttacggttaccggttaaaggtaacgtaacggttacggaaacgttacgttaacgg

SEQ ID NO: 257720 - DNA, 784 bp, Homo sapiens
  misc_feature: GYAE6OF01AM6XA.10.6.A06.1.454.CMB.1.raw
  modified_base (739)..(739): a, c, t, g, unknown or other
  misc_feature (739)..(739): n is a, c, g, or t
tcagcatagtagtgcacgaccggtgctcgatttagatctactgacagggggagagaggagccttagccctggattccaaggcctatccacttggtgatcagcacggagcaccgacgattcaccatggaactggggctccgctgggttttccttgtcgctattctagaaggtgtcctgtgtgaggtgcagctggtggagtcgtgggggaggccgtggtcgaaggccgggggggtctcgtgagactgtcctgtgttcgcctctggacttccctctcgaggtacgttttacgaggcattacggtaaccgttcggggtcccgaccgacgggtccgttaccggaaggggaacgggtcccgtaggggacggttcggggtaccggccaaccgactaccgaggactacggtttactttaccgaacgtttacgaattacgttaccgtacgtacaaggtaacttcgttaggtacgggtaacgggtcccgttaccgtttcccaacccgttacttaccccgttaccccgaagggaacgggaaccccgtaaccggaacccgtaaacgggaaacccttaaccgtaacgtttacgggtacgtacccgtaagaccgttaaaaggtaccggaaactaccgggtaacccgggtaggggggacccgtacccggggaaaggtaacccgaacgggtaaccgaaggttaaactttaacggtaccgttggtacggaccggtaggtaacgttcgttttaaagngggggttccgtaggtaacgttaaacccggaggtaaccgtattacg

SEQ ID NO: 257721 - DNA, 527 bp, Homo sapiens
  misc_feature: GYAE6OF02J2ANB.10.6.A06.1.454.CMB.1.raw
  modified_base (297)..(297): a, c, t, g, unknown or other
  misc_feature (297)..(297): n is a, c, g, or t
  modified_base (330)..(330): a, c, t, g, unknown or other
  misc_feature (330)..(330): n is a, c, g, or t
  modified_base (358)..(358): a, c, t, g, unknown or other
  misc_feature (358)..(358): n is a, c, g, or t
  modified_base (386)..(386): a, c, t, g, unknown or other
  misc_feature (386)..(386): n is a, c, g, or t
  modified_base (394)..(394): a, c, t, g, unknown or other
  misc_feature (394)..(394): n is a, c, g, or t
  modified_base (429)..(429): a, c, t, g, unknown or other
  misc_feature (429)..(429): n is a, c, g, or t
  modified_base (441)..(441): a, c, t, g, unknown or other
  misc_feature (441)..(441): n is a, c, g, or t
  modified_base (453)..(453): a, c, t, g, unknown or other
  misc_feature (453)..(453): n is a, c, g, or t
  modified_base (489)..(489): a, c, t, g, unknown or other
  misc_feature (489)..(489): n is a, c, g, or t
  modified_base (496)..(496): a, c, t, g, unknown or other
  misc_feature (496)..(496): n is a, c, g, or t
  modified_base (505)..(505): a, c, t, g, unknown or other
  misc_feature (505)..(505): n is a, c, g, or t
tcagcatagtagtgcacgaccggtgctcgatttagatctactgacagggggagagaggagccttagccctggattccaaggcctatccacttggtgatcagcacggagcaccgacgattcaccatggaactggggctccgctgggttttccttgtcgctatctagaaggtgtcctgtgtgaggtgcagctggtggagtctgggggaggcctgggtcaaggccgggggggtctcgtgagactgtcctgtgttgcctctggtattcccgtctcaggagtttcagcatgaactgggtccncgaggctccgagggacggccgtggagtgggtcncgaaccatcagcagtacttccagttacntactactacgcagaatctgtgaaggccnttcactanctcagacgacgacgccaggaactcaagttgtggcngtcaaatgaacngaccgtgggacncggagacacggacaagatatactgtagcgagacgtntttaagngggttacgngaataacggtgaaccgtatacg

SEQ ID NO: 257722 - DNA, 523 bp, Homo sapiens
  misc_feature: GYAE6OF02IVPW9.10.6.A06.1.454.CMB.1.raw
  modified_base (469)..(469): a, c, t, g, unknown or other
  misc_feature (469)..(469): n is a, c, g, or t
  modified_base (519)..(519): a, c, t, g, unknown or other
  misc_feature (519)..(519): n is a, c, g, or t
tcagcatagtagtgcacgaccggtgctcgatttagatctactgacagggggagagaggagccttagccctggattccaaggcctatccacttggtgatcagcacggagcaccgacgattcaccatggaactggggctccgctgggttttccttgtcgctattctagaaggtgtcctgtgtgaggtgcagctggtggagtctgggggaggcctggtcaagccgggggggtctctgagactgtcctgtgttgcctctggattccctctcaggagtttcagcatgaactgggtccgccaggctccgaggggagggcctgggagtgggtcgcaaccatcagcagtatttccagttacatactactacgcagaatctgtgaaggccgcttcaccatctaccagagacgacgccaggaacctcaatgtggctgacaaatgaacagccgtagggagccggaggacacggacaaagntagttactgtagcgagagtctttaagtggtacggtgataacgaggaacgntacg

SEQ ID NO: 257723 - DNA, 554 bp, Homo sapiens
  misc_feature: GYAE6OF02JHEJB.10.6.A06.1.454.CMB.1.raw
  modified_base (443)..(443): a, c, t, g, unknown or other
  misc_feature (443)..(443): n is a, c, g, or t
  modified_base (485)..(485): a, c, t, g, unknown or other
  misc_feature (485)..(485): n is a, c, g, or t
  modified_base (488)..(488): a, c, t, g, unknown or other
  misc_feature (488)..(488): n is a, c, g, or t
tcagcatagtagtgcacgaccggtgctcgatttagatctactgacagggggagagaggagccttagccctggattccaaggcctatccacttggtgatcagcacggagcaccgacgattcaccatggaactggggctccgctgggttttccttgtcgctattctagaaggtgtcctgtgtgaggtgcagctggtggagtcgtgggggagggcctggtcaaggccggggggtcgtctgagactgtcctgtgttgcctctggattccctctcaggagtttcagcatgaactgggtcccgccaggctccgaggggaaggccgtggaggtgggtcgcaaccatcagcagtactttccagttacatatactacgcagaatctgtagaaggccgcttcaccatcctccagagacgacgccaggaactcaatgtcggctgcaaatgaacngccgtgggagccggaggacgacggacaaagtatactttacgnggngacggagaacggttctttaaaggtcgggttacggtagtaacgttaacgtgggaaaccgtaccttag

SEQ ID NO: 257724 - DNA, 597 bp, Homo sapiens
  misc_feature: GYAE6OF02H5GHV.10.6.A06.1.454.CMB.1.raw
  modified_base (267)..(267): a, c, t, g, unknown or other
  misc_feature (267)..(267): n is a, c, g, or t
  modified_base (563)..(563): a, c, t, g, unknown or other
  misc_feature (563)..(563): n is a, c, g, or t
tcagcatagtagtgcacgaccggtgctcgatttagatctactgacagggggagagaggagccttagccctggattccaaggcctatccacttggtgatcagcacggagcaccgacgattcaccatggaactggggctccgctgggttttccttgtcgctattctagaaggtgtcctgtgtgaggtgcagctggtggagtcgtgggggaggcctggtcaaggccgggggggtctcgtgagactgtcctgtgtgcctctggattccctntcaggagtttcagcatgaacgtcgggtccgccacggctccgaggggaagggccgtagggagtcggggtcgaccaaaccgatcgagcgtagttactttccagttacagtatactacgacaagatcgtgtaggaacgggccgtacttccgacactcctacagagaccgacgaccgaaggaactacaagttcggtacgctagaacaaagtacgaaacgacgaccggtagggacgccggaacggacgacgggacaaaggtattaagttacgtggaggtcgaaggtacgtacgttttaagnggttcggtataacgtacgttaggaaccagttacg

SEQ ID NO: 257725 - DNA, 658 bp, Homo sapiens
  misc_feature: GYAE6OF02HVV6P.10.6.A06.1.454.CMB.1.raw
  modified_base (271)..(271): a, c, t, g, unknown or other
  misc_feature (271)..(271): n is a, c, g, or t
  modified_base (303)..(303): a, c, t, g, unknown or other
  misc_feature (303)..(303): n is a, c, g, or t
  modified_base (401)..(401): a, c, t, g, unknown or other
  misc_feature (401)..(401): n is a, c, g, or t
  modified_base (431)..(431): a, c, t, g, unknown or other
  misc_feature (431)..(431): n is a, c, g, or t
  modified_base (541)..(541): a, c, t, g, unknown or other
  misc_feature (541)..(541): n is a, c, g, or t
  modified_base (588)..(588): a, c, t, g, unknown or other
  misc_feature (588)..(588): n is a, c, g, or t
tcagcatagtagtgcacgaccggtgctcgatttagatctactgacagggggagagaggagccttggccctggattccaaggcctatccacttggtgatcagcacggagcaccgacgattcaccatggaactggggctccgctgggttttccttgtcgctattctagaaggtgtcctgtgtgaggtgcagctgggtggaggtcgtggggggaggcctggtcaaggccggggggtctcgtgagactgtcctgtgttgcctctggacttccctntcaggtagtttcagcatgaacgtcgggtcccnccgaggcctccggaaggggacgggtccgtgggaggtcggggtcaccaaccgtatcgacgctagttacttaccagttacatatactacgcaagtaactntagtaggtaacggccgtaccttaccaaccncttaccctaccgaaagacggaaccgaccgtaccgaaggtaacctacaaggttccggtacgaccgttacgaactaaagttacgaaacgtacgacccggtagggggaaaccnccggtaaggacccaacgggaacaaagtattagtaccgtggtaacggnggttaactacggtaagtttaacggtggttacggtaagttacgtaaccggtacggtaaccgtacgttaacg

SEQ ID NO: 257726 - DNA, 616 bp, Homo sapiens
  misc_feature: GYAE6OF02HIKCF.10.6.A06.1.454.CMB.1.raw
  modified_base (299)..(299): a, c, t, g, unknown or other
  misc_feature (299)..(299): n is a, c, g, or t
  modified_base (338)..(338): a, c, t, g, unknown or other
  misc_feature (338)..(338): n is a, c, g, or t
tcagcatagtagtgcacgaccggtgctcgatttagatctactgacagggggagagaggagccttagccctggattccaaggcctatccacttggtgatcagcacggagcaccgacgattcaccatggaactggggctccgctgggttttccttgtcgctattctagaaggtgtcctgtgtgaggtgcagctggtggagtcgtgggggaggcctggtcaaggccgggggggtctcgtgagactgtcctgtgttgcctcgtggacttccctctcaggtagtttcagcatgaactgggtccncaggctccgagggaacggcctggagtgggtcgacaaccntcagcagtattccagttacatatactacgcagaatctgtgaacggccgcttcaacctatcctccgaagagacgacgccaagggtaacctcgaaagttgtacggcttaggactaaaatcgaaacaggtcccgtaggggaacgcccgggaagggaccaacggggaccaaagggacttaacgttaaccgtggtacggaccggaaggaacggttaccgttttaaagtcggggttaccgggttaggaaactttaaaccggtacggggtaaaccacgtttaacg

SEQ ID NO: 257727 - DNA, 555 bp, Homo sapiens
  misc_feature: GYAE6OF02FZRFG.10.6.A06.1.454.CMB.1.raw
  modified_base (296)..(296): a, c, t, g, unknown or other
  misc_feature (296)..(296): n is a, c, g, or t
  modified_base (384)..(384): a, c, t, g, unknown or other
  misc_feature (384)..(384): n is a, c, g, or t
  modified_base (462)..(462): a, c, t, g, unknown or other
  misc_feature (462)..(462): n is a, c, g, or t
  modified_base (491)..(491): a, c, t, g, unknown or other
  misc_feature (491)..(491): n is a, c, g, or t
  modified_base (518)..(518): a, c, t, g, unknown or other
  misc_feature (518)..(518): n is a, c, g, or t
tcagcatagtagtgcacgaccggtgctcgatttagatctactgacagggggagagaggagccttagccctggattccaaggcctatccacttggtgatcagcacggagcaccgacgattcaccatggaactggggctccgctgggttttccttgtcgctattctagaaggtgtcctgtgtgaggtgcagctggtggagtctgggggaggcctggtcaaggccggggggggtctctgagactgtcctgtgttgcctctggattccctctcaggtagtttcagcatgaactgggtccnccaggctccagggaagggcctggaggtgggtcgcaaccatcagcagtatttccagttacatatactacgcagaatctgtgaagggccncttcaccatcctccaagacgaccgacgcccagggaacctcaaatgtaggcctagcaaatggaacaggccctggggacnccggagacgaccggcaaagattacttacnggtcgacgaaggtacgtacttttaagngggttacggtgaacgttaaccgtgggaaccagttacg

SEQ ID NO: 257728 - DNA, 529 bp, Homo sapiens
  misc_feature: GYAE6OF02GG6CT.10.6.A06.1.454.CMB.1.raw
  modified_base (297)..(297): a, c, t, g, unknown or other
  misc_feature (297)..(297): n is a, c, g, or t
  modified_base (422)..(422): a, c, t, g, unknown or other
  misc_feature (422)..(422): n is a, c, g, or t
  modified_base (478)..(478): a, c, t, g, unknown or other
  misc_feature (478)..(478): n is a, c, g, or t
  modified_base (499)..(499): a, c, t, g, unknown or other
  misc_feature (499)..(499): n is a, c, g, or t
tcagcatagtagtgcacgaccggtgctcgatttagatctactgacagggggagagaggagccttagccctggattccaaggcctatccacttggtgatcagcacggagcaccgacgattcaccatggaactggggctccgctgggttttccttgtcgctattctagaaggtgtcctgtgtgaggtgcagctggtggagtctgggggaggcctggtcaaggccggggggtctcctgagactgtcctgtgttggcctcgtggattcccgtctcaggagtttcagcatgaactgggtccnccaggctccgagggaagggcctggagtgggtcgcaaccatcagcagtattccagttacatatactacgcagaatctgtgaaggccgcttcaccatctccagacgacgacgccaggaactcaatgngctgacaatgaacagccgtagggacgccggaaggaccacggcaaagatacttacgnggtgcgagacgtactttaagnggttcggtgaattaacgtggaaccgatacg

SEQ ID NO: 257729 - DNA, 769 bp, Homo sapiens
  misc_feature: GYAE6OF02F3LLS.10.6.A06.1.454.CMB.1.raw
tcagcatagtagtgcacgaccggtgctcgatttagatctactgacagggggagagaggagccttagccctggattccaaggcctatccacttggtgatcagcacggagcaccgacgattcaccatggaactggggctccgctgggttttccttgtcgctattctagaaggtgtcctgtgtgaggtgcagctggtggagtcgtgggggaggcctgggtcaaggccgggggggtctcgtgagactgtcctgtgttgcctcgtggacttccctctcgaggtagtttcagcatgaactgggtccgccaggcctccgaggggaacgggccgtagggaggtcggggtcgacgtaaaccgatcgaacgctaggttaactttcccgaagttacctaagttaactaaccgttacgacctaaggtaaacttccgtagggtacggaaacggggtccccgtactttaccgaaccctagttccctaccgaacgggaacggaacccggaaccggaccccgaaaggggtaaaccccttacgtaaaacggtttcgggtacgggtaccgttacggtaaccgtaaaaattaccgggaaaaccgacggtacccggtagggggaaccgacccgggtaaggaacccggaaccgggaacgtaaaaggaacgttaacgtttacgtgggtaacggtaccggtaaacgggtacgtttaaccgttttaaaggtaccggggttcggggttaacgttaaacgttaaacggtaccggggtaaacctacgtttaaacgg

SEQ ID NO: 257730 - DNA, 573 bp, Homo sapiens
  misc_feature: GYAE6OF02IISQV.10.6.A06.1.454.CMB.1.raw
  modified_base (535)..(535): a, c, t, g, unknown or other
  misc_feature (535)..(535): n is a, c, g, or t
tcagcatagtagtgcacgaccggtgctcgatttagatctactgacagggggagagaggagccttagccctggattccaaggcctatccacttggtgatcagcacggagcaccgacgattcaccatggaactggggctccgctgggttttccttgtcgctattctagaaggtgtcctgtgtgaggtgcagctggtggagtcgtgggggaggcctggtcaagccgggggggtctcgtgagactgtcctgtgttgcctctggattccctctcaggtagtttcagcatgaacgtgggtccgccaggcctccgaggggaacgggccgtgggaggtgggtcgcaaccatcgagctagtactttccagttacatatactacgcagaatctgtaggagggccgtcttcacctatcctccaagacgacgaccgccaggacctcaatggtaggctgactaaatcgaacgacgccgtagggacgaccggaagggaccacggacaaagtatagttacgtggtaggacgaaggacgttacgtttaagngggttacggtagtaacgtaacgtaggaaccgtattacg

SEQ ID NO: 257731 - DNA, 590 bp, Homo sapiens
  misc_feature: GYAE6OF02GVJTN.10.6.A06.1.454.CMB.1.raw
tcagcatagtagtgcacgaccggtgctcgatttagatctactgacagggggagagaggagccttagccctggattccaaggcctatccacttggtgatcagcacggagcaccgacgattcaccatggaactggggctccgctgggttttccttgtcgctattctagaaggtgtcctgtgtgaggtgcagctggtggagtcgtggggggaggcctggtcaaggccggggggggtctcgtgagactgtcctgtgttgcctctggattcccctctcaggtagtttcagcatgaactgggtccgccaggctccgagggaacgggccgtgggaggtgggtcgcaaccgatcagcagtactttccagttacatatactacgcagaatctgtagacgggcctctcacctatctccagacgacgacgacccgaaggtaacctcgaaagttggtacggacttgaactaaatacggaaacacggaccgtaggggaccgccggaaggaccgacggacaaagattacttacgtgtaggcgaagtacggtactttaaggtcgggttacggttagaacttaaccggtaggaaccgtattaacgg

SEQ ID NO: 257732 - DNA, 666 bp, Homo sapiens
  misc_feature: GYAE6OF02ICKI3.10.6.A06.1.454.CMB.1.raw
tcagcatagtagtgcacgaccggtgctcgatttagatctactgacagggggagagaggagccttagccctggattccaaggcctatccacttggtgatcagcacggagcaccgacgattcaccatggaactggggctccgctgggttttccttgtcgctattctagaaggtgtcctgtgtgaggtgcagctggtggagtcgtgggggaggccgtggtcgaaaggccgggggggtctcgtgagactgtcctgtgttgcctctggattccctctcaggtagtttcagcatgaactcgggtcccgcgacggctccgagggaacgggccgtggaggtgggtcgacgaaccatcagcagtattccagttacatatactacgacaagtaatctgtaggaacgggccgtacttaccaactactcctaccgaaggacgaaccgaccgacccgaagggaacttacgaaagttcggtacggctagaactaaaagtagaaaccgaacggtacccggttaggggaaccggacccgggtaacgggaaacccgacggggaaaccaaaggtaacttaagtttaccgtaggtaccggacgggtaaggtacggttaacgttttaaaggtcggggttaccggtaaggtaacgttaaacggtacgggtaaaccgtatttaaccgg

SEQ ID NO: 257733 - DNA, 627 bp, Homo sapiens
  misc_feature: GYAE6OF02IAKT1.10.6.A06.1.454.CMB.1.raw
  modified_base (256)..(256): a, c, t, g, unknown or other
  misc_feature (256)..(256): n is a, c, g, or t
  modified_base (315)..(315): a, c, t, g, unknown or other
  misc_feature (315)..(315): n is a, c, g, or t
  modified_base (325)..(325): a, c, t, g, unknown or other
  misc_feature (325)..(325): n is a, c, g, or t
  modified_base (330)..(330): a, c, t, g, unknown or other
  misc_feature (330)..(330): n is a, c, g, or t
  modified_base (555)..(555): a, c, t, g, unknown or other
  misc_feature (555)..(555): n is a, c, g, or t
  modified_base (584)..(584): a, c, t, g, unknown or other
  misc_feature (584)..(584): n is a, c, g, or t
tcagcatagtagtgcacgaccggtgctcgatttagatctactgacagggggagagaggagccttagccctggattccaaggcctatccacttggtgatcagcacggagcaccgacgattcaccatggaactggggctccgctgggttttccttgtcgctattctagaaggtgtcctgtgtgaggtgcagctggtggagtcgtgggggaggcctggtcaaggccgggggggtctctgagactgtcctgtgttgcctntggtacttccttctcgaggagtttcagcatgactgggtccgcacggctcgagggaggcnggagtggtcncaacntcagctagtactttaccgagtactatatactacgacaagaattcctaggtaggaacgggtcccgtctttaccaaccgacttccctaccgaagggaaccgtaaccgaaccggaccgaaacggaacctaccgaattcgggtacgacgttacggaactaaagtacgaacgaacgtcccggtagggacgaccgggaacgaccgaacggacgtaaagtagtaacttacgnggtacggcgaacggtagttactttaacgngggtacgtagtaacgttaacggtaacgggaccgtacgttaacg

SEQ ID NO: 257734 - DNA, 730 bp, Homo sapiens
  misc_feature: GYAE6OF02H5ICL.10.6.A06.1.454.CMB.1.raw
  modified_base (184)..(184): a, c, t, g, unknown or other
  misc_feature (184)..(184): n is a, c, g, or t
  modified_base (274)..(274): a, c, t, g, unknown or other
  misc_feature (274)..(274): n is a, c, g, or t
  modified_base (316)..(316): a, c, t, g, unknown or other
  misc_feature (316)..(316): n is a, c, g, or t
  modified_base (528)..(528): a, c, t, g, unknown or other
  misc_feature (528)..(528): n is a, c, g, or t
tcagcatagtagtgcacgaccggtgctcgatttagatctactgacagggggagagaggagccttagccctggattccaaggcctatccacttggtgatcagcacggacgcaccgacgattcaccatggaactgggctccgctgggttttcctgtcgctatctagaagtgtcctgtgtgagtgcngcgtggtggagtcgtgggggaggccgtggtcgaaggccggggggtctcgtgaggtactgtccgtgttcgtgtcctgtacggtcttccctntcgaggtacgtttcacggtctagtacgtacgtcggggtcccnccgtacggtccgtaccgacggggaaccggtccgggtggtaccgggtcggggttaccgcctaaaccgacgtacgacgacgtagtttacttacccgtacgttaacgtaactacgttacgacgtacgtagtaacgtcgtaggtacggacgggtccacgttccacgtctacgtccgtagacgacgaccgacgtaacgacgtacaacgttggtacgntacgtaacgtaaatacgaacgtccggacggttacgggaccgaccggtaacggaaccgaccgggtaaacgaaacgtttaacggtacgttaccggtaggttacggaacggttaaaccggagtttaccggtttaaacggttcgggtttaacgggtacgttaaaggttaaaccgggtaacggaaaccggttaccgtttaaaccggg

SEQ ID NO: 257735 - DNA, 673 bp, Homo sapiens
  misc_feature: GYAE6OF02FXO8V.10.6.A06.1.454.CMB.1.raw
  modified_base (228)..(228): a, c, t, g, unknown or other
  misc_feature (228)..(228): n is a, c, g, or t
  modified_base (246)..(246): a, c, t, g, unknown or other
  misc_feature (246)..(246): n is a, c, g, or t
  modified_base (250)..(250): a, c, t, g, unknown or other
  misc_feature (250)..(250): n is a, c, g, or t
  modified_base (259)..(259): a, c, t, g, unknown or other
  misc_feature (259)..(259): n is a, c, g, or t
  modified_base (268)..(268): a, c, t, g, unknown or other
  misc_feature (268)..(268): n is a, c, g, or t
  modified_base (354)..(354): a, c, t, g, unknown or other
  misc_feature (354)..(354): n is a, c, g, or t
tcagcatagtagtgcacgaccggtgctcgatttagatctactgacaggggagagaggagccttagccctggattccaaggcctatccacttggtgatcagcacggagcaccgacgattcaccatggaactggggctccgctgggtttccttgtcgctattctagaaggtgtcctgtgtgaggtgcagctggtgagtcgtgggggaggcctggtcaaggccgggggttnctgagctgtcctgtgttncctntgacttccnctcgtaggngtttcgagctatcgaacgtcggtccggcctagggtcctcccggaggggtaaccggggcctcgggaggttcggggtacgccgaaccngtacgacgcgtaaggttactttccgaagttccgaattcttaaccgtacgacagtaatcgtaggttcggaaagggccctcttaccgacctacgttacctaccgtacggaacgaccgacggacccgaacgggaaccgtaacgtaagtcggtaggtacgtcgactaagtacgaacaacgtcgtacgggacgtaccggacggaccgaacggacgaaacgtacgtaacgttacgtacggtagtacgggaacgtacggtaaccgttttaaagtcgggttacgggttactaaaggttaccggtaacggtaaccggtaacgtaacgg

SEQ ID NO: 257736 - DNA, 640 bp, Homo sapiens
  misc_feature: GYAE6OF02G5EAH.10.6.A06.1.454.CMB.1.raw
tcagcatagtagtgcacgaccggtgctcgatttagatctactgacagggggagagaggagccttagccctggattccaaggcctatccacttggtgatcagcacggagcaccgacgattcaccatggaactggggctccgcttgggttttccttgtcgctattctagaaggtgtctgtgtgaggtgcagcgtggtggagtcgtggggggaggccgtggtcaaggccggggggtctcgtgagactgtcctgtgttcgcctcgtggtacttccctctgaggtagtttcagcatgaacgtcgggtccgccgaggcctccgaaggggaacgggccgtagggaggtggggtcgacaaccgtatccgagctaagttcttaccagttactaatattactacgcgaagtaactcgtagtacgggaacggtcccgtcttaccaccgtactacccgccgtaaggacggaccgaccgtacccgtaaggtaaccctaccgaaagttcggtggtacctaggtaactaaagtcgaaacgcggtacggtacgggaacgccggagaccgaggaccaaagtactagttagtcggtagacggtaggtagtaacgtttaaggtggttacggtacaagttaacggtacggtactattacg

SEQ ID NO: 257737 - DNA, 558 bp, Homo sapiens
  misc_feature: GYAE6OF02FL2DM.10.6.A06.1.454.CMB.1.raw
  modified_base (370)..(370): a, c, t, g, unknown or other
  misc_feature (370)..(370): n is a, c, g, or t
  modified_base (387)..(387): a, c, t, g, unknown or other
  misc_feature (387)..(387): n is a, c, g, or t
  modified_base (438)..(438): a, c, t, g, unknown or other
  misc_feature (438)..(438): n is a, c, g, or t
tcagcatagtagtgcacgaccggtgctcgatttagatctactgacagggggagagaggagccttagccctggattccaaggcctatccacttggtgatcagcacggagcaccgacgattcaccatggaactggggctccgctgggttttccttgtcgctattctagaggtgtcctgtgtgaggtgcagctggtggagtcgtgggggagcctggtcaaggccgggggggtctcgtgagactgtcctgtgttgcctctggattccctctcaggagtttcagcatgaactgggtccgccgaggctccgaggggaagggccgtggagtgggtcgccaacgatcagcagttattccagttacatatactacgcanaatctgtagaggccgtntaccactatcctcagacgaacacgaccgacgaactcaagttgtacggctanactaaatcgaacacgcgtagggacgccggaggacgtacggacaagtagtattacgcgtggacaggtactaacgttttaagtgggtacggttacgacgttaacgtcgggtaacgacttacg

SEQ ID NO: 257738 - DNA, 727 bp, Homo sapiens
  misc_feature: GYAE6OF02GWVS0.10.6.A06.1.454.CMB.1.raw
tcagcatagtagtgcacgaccggtgctcgatttagatctactgacagggggagagaggagccttagccctggattccaaggcctatccacttggtgatcagcacggagcaccgacgattcaccatggaactggggctccgctgggttttccttgtcgctattctagaaggtgtcctgtgtgaggtgcagctggtggagtcgtgggggagcctggtcaaggccggggggtctcgtgagactgtcctgtgttgcctctggattcccgtactcgaggtacgtttcagcagtgaacttcgggtcccgccgaggccgtaccgaggggaacgggtcccgtgggtacggttgggtccgacgaacccgtatccgaagctaagtactttaccaagttacagttactaacttaacgacgtaacgtaaactcgttaggtacggaaacggggtccctacgtttaccaacccgtacttcctacccgaagggtaacgaaccggtaccgaccgaaacgggtaacctacgaaacgttcggtcgggaccttaggaaacctaaacgtacggaaacgacggtacccggtagggtaccggtacgggtaacggaaccgaacgggaactaaacggtaattaaccgttacgttcggacggtaccggtaacggtacggttaacgttttaacggtacggggttacggttaggtaaaccgttaaacggtaccgggtaaacgtacgttaaccgg

SEQ ID NO: 257739 - DNA, 691 bp, Homo sapiens
  misc_feature: GYAE6OF02HK7IK.10.6.A06.1.454.CMB.1.raw
  modified_base (339)..(339): a, c, t, g, unknown or other
  misc_feature (339)..(339): n is a, c, g, or t
tcagcatagtagtgcacgaccggtgctcgatttagatctactgacagggggagagaggagccttagccctggattccaaggcctatccacttggtgatcagcacggagcaccgacgattcaccatggaactggggctccgctgggttttccttgtcgctattctagaaggtgtcctgtgtgaggtgcagctggtggagtcgtgggggaggccgtggtcgaaggccggggggtctcgtgagactgtcctgtgttgcctctggacttccctctcgaggtagtttcagcatacgaacgtcgggtcccgccgaggccgtaccggaggggaacggccgtagggnggtcggggtccgaccaaacctagtcagctaagttactttaccaagttacaattaacgtaacctacgacaacgtaaacttcgtagggtaggaacggtcccgtaccttacccaccgtactcctacccgaaggacggtaaccggaccgaccgaacggtaacctacgaacgttggtcggtaccgtagtaacaaacgtacggaaaccgacggtacccggtaggggaaccgaccgggaacgggtaacccgaacggaaacgtaaacggtattaacgttacgtagggtacggtcggaaggtaacgttacggtttaagtcgggttacggtagtaacgttaaggtacgggaacgtacgttag

SEQ ID NO: 257740 - DNA, 718 bp, Homo sapiens
  misc_feature: GYAE6OF02IR586.10.6.A06.1.454.CMB.1.raw
  modified_base (181)..(181): a, c, t, g, unknown or other
  misc_feature (181)..(181): n is a, c, g, or t
  modified_base (286)..(286): a, c, t, g, unknown or other
  misc_feature (286)..(286): n is a, c, g, or t
tcagcatagtagtgcacgaccggtgctcgatttagatctactgacgagggggagagaggagccttagccctggattccaaggcctatccacttggtgatcagcacggagcaccgacgattcaccatggaactgggctccgcttgggttttccttgtcgctattctagaaggtgtcctgtgngagtgcagcgtggtggagtcgtggggaggccgtggtacgaacgggccgggggtctcgtaggacgtacgtcgtccgtgttcgttcgtcctcgtggtacttcccgtntaccgtaggtacgtttcacgtacaagttacgtaacgtcgggtcccgccgtacggacccgtacggaacggggacgggccgtgggaagggttcgggtacgacctaaccgagtacgacgtacgtacgtttaccgttaccgtagttaaacacgttactaacgttaccgactaacgtaagtacgtaggtacgggaccggtaccgtcttaccaacttacgtacctaacgacgaacgaacggtaccgaccgtaacggtaactacgagttacgggtcgtacgaccgaaataacgtaacaacgaccggtaccggtagggaccgtacccggaggaacgtaaccgggactaaagtacttacgttacgagtaccggaacggtaagtcgttaacgtttaggtccggtaggttacgaccgttaacggacggtaaccgtagttacgg

SEQ ID NO: 257741 - DNA, 675 bp, Homo sapiens
  misc_feature: GYAE6OF02IL8C3.10.6.A06.1.454.CMB.1.raw
  modified_base (390)..(390): a, c, t, g, unknown or other
  misc_feature (390)..(390): n is a, c, g, or t
tcagcatagtagtgcacgaccggtgctcgatttagatctactgacagggggagagaggagccttagccctggattccaaggcctatccacttggtgatcagcacggagcaccgacgattcaccatggaactggggctccgctgggttttccttgtcgctattctagaaggtgtcctgtgtgaggtgcagctggtggagtcgtgggggaggcctggtcaaggccgggggggtctcgtgagactgtcctgtgttgcctcgtggacttccctctcgaggtagtttcagcatgaacgtcgggtccgccgaggcctccgaggggtacgggccgtgggacggtgggtcgacgaaccatacgagcgtagttactttccagttacattactactacgnaagaactcgtaggtaggaacggcccgtctttccaccgtactcctaccgaaggacgaacccggacgtacccgaagggtaacccttacgaaacgttcgggtacggaccgtacggaactaaaacgtcggaaaaccgcgggtaaccccggttgggggaaacccgtccgggaaagggtaacccgaacgggtaacgtaaaacgggtatttaaccgttacgttggtacgggacgtaaggtacgttacgtttaagtcgggtacggtattaacgtacggtaaggacctagtacg

SEQ ID NO: 257742 - DNA, 819 bp, Homo sapiens
  misc_feature: GYAE6OF02H5P9H.10.6.A06.1.454.CMB.1.raw
  modified_base (138)..(138): a, c, t, g, unknown or other
  misc_feature (138)..(138): n is a, c, g, or t
  modified_base (196)..(196): a, c, t, g, unknown or other
  misc_feature (196)..(196): n is a, c, g, or t
  modified_base (202)..(202): a, c, t, g, unknown or other
  misc_feature (202)..(202): n is a, c, g, or t
tcagcatagtagtgcacgaccggtgctcgatttagatctactgacagggggagagaggagccttagccctggattccaaggcctatccacttggtgatcagcacggagcaccgacgattcacatggactgggctccgntgggttttcctgtcgctattctagaggtgtcctgtgtgaggtgcagctggtgagtcgngggggngccgtggtcgaaggtccggggggtctcgtgagacctgtcctgtcggttcgccttcgttaggtacctttccctctcgtagggtacgtttacagacagtacggtaacgtcgggtcccgccgacggtcctaccgggtaaggggaccggccggtagggtacggttcggggtaccgaaccgtaaacccgtagtccgaacgtacctaacgggttaccttttaccggaacggtttaactaacttaacggttaaccgttaaccggtaaccgtaaggttaaccgttcggttaacgggttaacggggtaaaccggggtcccggtttaccgtttaaccccggaaccttaccgttacccgtaacccggaacggtaccggtaaacccgggacccgaaacccgggtaaacgggtaaaccctaacttaaaggttccggtacgggttaccgtacgtaaacgaaacgttaaccggaaacgttaccggtacccgggtaacggggtacgggacccggtacggaaccgaccggtaaacgaaagtacgtttactacggtcggtacggactaacggttacgttaacgtttaggccgggttagtacggtaacctagggtaacccgagttaccgtttacgg

SEQ ID NO: 257743 - DNA, 711 bp, Homo sapiens
  misc_feature: GYAE6OF02F3RC6.10.6.A06.1.454.CMB.1.raw
  modified_base (548)..(548): a, c, t, g, unknown or other
  misc_feature (548)..(548): n is a, c, g, or t
  modified_base (677)..(677): a, c, t, g, unknown or other
  misc_feature (677)..(677): n is a, c, g, or t
tcagcatagtagtgcacgaccggtgctcgatttagatctactgacgagggggagagaggagccttagccctggattccaaggcctactccacttggtgatcagcacggagcaccgacgattcaccatggaactgggctcgctggtttcctgtcgctattctagaagtgtctgtgtgagtgcagcgtggtggatcgtggggacggccgtggtcgaagggtcccggggggtctcgtggacgtacgttcgtccgtgttgttcgcctcgtcggacttcccgtctacgtaggtatttcgagactagtacgtacgtcgggtaccgccaaggtcctacggacgggacggtccgtggtaaggtcgggttccaccaaccggtactccggaacgtccaacggtttaccgttaccgtaacggttaacctacgttaacgtaaccgtacccggataacgtaaacgttcgttacgggttacggaaacccggggtcccgtacgttaccgtacctaactcccgttaacgacggaacaccgggactaacccgggaggtaaacccngttaacggttcgacggtaccgtaacgtacgtaaacgtaccggaaccgtacgcggttaccgggagtacccggaacgtaacgacggactacgaggtaacctgtaggtaccggcgtaaatgtcgtttaaggnggttacggtgtaacgtacggacgtacacttaccg

SEQ ID NO: 257744 - DNA, 679 bp, Homo sapiens
  misc_feature: GYAE6OF02I7X2X.10.6.A06.1.454.CMB.1.raw
  modified_base (159)..(159): a, c, t, g, unknown or other
  misc_feature (159)..(159): n is a, c, g, or t
  modified_base (178)..(178): a, c, t, g, unknown or other
  misc_feature (178)..(178): n is a, c, g, or t
  modified_base (184)..(184): a, c, t, g, unknown or other
  misc_feature (184)..(184): n is a, c, g, or t
  modified_base (587)..(587): a, c, t, g, unknown or other
  misc_feature (587)..(587): n is a, c, g, or t
  modified_base (620)..(620): a, c, t, g, unknown or other
  misc_feature (620)..(620): n is a, c, g, or t
tcagcatagtagtgcacgaccggtgctcgatttagatctactgacagggggagagaggagccttagccctggagttccaaggcctatccacttggtgatcagcaccggagcaccgacgattcaccatggaactgggctccgctgggtttcctgtcgctntctagaaggtgtcctgtgngaggtnccagtcgtggtggagtcgtagggggacggccgtggtcgaaggccggggggtcttcgtgacacgtcgtccgtgtgttcgctcgtggacttccctcgtacgacgggtagtttacgacgtcgagtacgtacgtcggtccgacccgtaggccgtaccggagggtacggtcgtgggtacggtcgggtaccgaccgtaaacctagtaccgagtccgtaacgttacgttccgtacttaccgaatacgtacgtacgacgagtaactcgtagtgggaaccggtccgacgtcaacccgtcaccttaccggagtaacgtccggaacgcgaaacggtactaccgtaattcggtcgtacgtacaacgtaagaccgaacgtacggaccggtacggagtaccggacgacgtaacgtanaacgtagttaccgtaccgttgggactaaccggnttaacgggttagttaccggttggacggtcggtatacggtaaccggtacgtacttaccgg

SEQ ID NO: 257745 - DNA, 528 bp, Homo sapiens
  misc_feature: GYAE6OF01DSMAN.23.26.C04.1.454.CMB.1.raw
  modified_base (229)..(229): a, c, t, g, unknown or other
  misc_feature (229)..(229): n is a, c, g, or t
  modified_base (348)..(348): a, c, t, g, unknown or other
  misc_feature (348)..(348): n is a, c, g, or t
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctcgatgtccaaggacatgagacagaccgccacactcacctgcacaggaacncaacaatgttggcaaccaaggagcagcttggtgcagcagcacagggccaccctccacactcctgtcctacaggaactaacgaacccggccctacgagggatctacgagagagtatttcngcatcgaggtcaaggaacncacgcctccngaccattactgactccagcctagacggacgaggctagactagttattgtttagctagtcggacaccgacgcctcactgcgttgggtcgttcggcgggacggaccaaggtcctacgtaccgtccgtaggtccaggcccgaaggtcctcccgg

SEQ ID NO: 257746 - DNA, 635 bp, Homo sapiens
  misc_feature: GYAE6OF01BERW4.23.26.C04.1.454.CMB.1.raw
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagccccctcgatgtccaaggacatgagacagaccgccacactcacctgcacaggaacgccaacaatgttggacaaccaaggagcagcttggttgcagcagcaccacgggccaccctcccacactcctgtcctacacggaactaacaaccggccctacgagggtactcctacgacgagagtattttctcgtacactccaggtcgaaggtaaaccgcgacgcctcccgtagaccctacttacgtcggtaaccttccgacgtcccgtaggacgggacgacgggctacggacttagttagtttaggtttagacgtaagtacgggaacctacccgagtccctacgaccgttggtaccggtttgggttacggttccggggaccgggacggggtaacccgaaggtcccgtacggtacccgtacccgttacgggtaccgaccggaccccggaaacgggtcccgtacccccggg

SEQ ID NO: 257747 - DNA, 534 bp, Homo sapiens
  misc_feature: GYAE6OF01AZUJ8.23.26.C04.1.454.CMB.1.raw
  modified_base (231)..(231): a, c, t, g, unknown or other
  misc_feature (231)..(231): n is a, c, g, or t
  modified_base (248)..(248): a, c, t, g, unknown or other
  misc_feature (248)..(248): n is a, c, g, or t
  modified_base (343)..(343): a, c, t, g, unknown or other
  misc_feature (343)..(343): n is a, c, g, or t
  modified_base (384)..(384): a, c, t, g, unknown or other
  misc_feature (384)..(384): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctcgatgtccaaggacatgagacagaccgccacactcacctgcacagggaacncaacatgtgcaacagancagctgtgcagcagcaccgagggccaccctcccacacctcctgtcctacaggaactaaccaaccggccctacagggactctcagagagtatttcngcactccaggtcaggaacgcacgccctcctgaccagttacncggactccgagcctaggacggtacgaggctagacttattattgttagctagtcgggactacgactcctacactggtcgttgggtcgttcgggacggacgggacaacggtcgtacggaccgtccgttaggccgagcccgaaggcgtcccgg

SEQ ID NO: 257748 - DNA, 500 bp, Homo sapiens
  misc_feature: GYAE6OF01BMBB2.23.26.C04.1.454.CMB.1.raw
  modified_base (205)..(205): a, c, t, g, unknown or other
  misc_feature (205)..(205): n is a, c, g, or t
  modified_base (342)..(342): a, c, t, g, unknown or other
  misc_feature (342)..(342): n is a, c, g, or t
  modified_base (398)..(398): a, c, t, g, unknown or other
  misc_feature (398)..(398): n is a, c, g, or t
  modified_base (426)..(426): a, c, t, g, unknown or other
  misc_feature (426)..(426): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctgatgtccaaaggcatgagacagaccncacactcacctgcacaggacgccaacaatgttggcaaccaaaggagcagcttggttgcagcagcacagggccaccctcccacactcctgtcctacaggaataaacaaccggcctcagggatctcagagagattttcngcatccagtcaggaaacgcagcctccctgaccatactgatccagcctgacgagagntgatattatgttagcatcgggacaccanccgtcactgcttgggtgttccgggcggagggtacccaaagcgtcgaccgtctaggtcagcccaaaggcgtcccg

SEQ ID NO: 257749 - DNA, 849 bp, Homo sapiens
  misc_feature: GYAE6OF01BBGCW.23.26.C04.1.454.CMB.1.raw
  modified_base (231)..(231): a, c, t, g, unknown or other
  misc_feature (231)..(231): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctcgatgtccaaggacatgagacagaccgccacactcacctgcacagggaacncaacaatgtggcaaccgaaggagcagcttggtgcagcagcaccgaggccaccctccacactcctgtcctacaggaactaaccgaacccggccctacgacgggactccgtacgaaggagtacgttactttttccgacggacctaacgttaccccgtaaaggggttacccgaaaacggggtaaaaacccggccgtaaccgggtaccccccgtttacccccgttaacggtaaacccccgttaacgttttaaaccccggttaccggggtaaccccttaccccgtaaacgggttaccccgttaacgggaaccggggtaaccggtaacggggtacctttaagggtaactttttaacgtttacgtttacgtccgtttacggtaccttaccgtaagttacgttacggtaaccgtaaggtaacgtttaacgggtttaacgtttaaccgggttttaggggtaaccggggggttttaccgggggggaacccggggggggttaaacccgttaaacggggggttacccgggttaaccccggggtttaccgggttaaaccggggttacccggtaaacccgggtaccccggttaaaacggggtcccccggttacccgggttaccccccccggg

SEQ ID NO: 257750 - DNA, 752 bp, Homo sapiens
  misc_feature: GYAE6OF01DFVTF.23.26.C04.1.454.CMB.1.raw
  modified_base (228)..(228): a, c, t, g, unknown or other
  misc_feature (228)..(228): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctcgatgtccaaggacatgagacagaccgcacactcacctgcacaggacnccaacaatgtgcaacaagagcagcttggtgcagcagcaccgacgggccaccctccacacctcctgtcctacgaggaactaaccgaacccggccctacgagggactctacgagagagtacttttctgacctactcccgaagggtaccgaaacgggaaaaccgccgtaacggtccccctttaccccgtacggaaccccttaacgtttaccgtacgggtaacccttacccgaacggtacccgtacgggaacggggaccggaaacgggtccttagggtaaccttttaagtttttaacgttttaggttttaacgaccgttaacggttacgggggaaccctaaacccgtaaccggtccccttaccgaaccggtttcggtaccgggttttcgggggtttcgggtttaccgggggaccggggtaaacggggtaaccccgtaaacgggtcccggtaccggtaccccgggttacccggttaacggggtacccgtaaccgggaccccgtaaacggggtcccgttaccccccgggg

SEQ ID NO: 257751 - DNA, 514 bp, Homo sapiens
  misc_feature: GYAE6OF01EDURX.23.26.C04.1.454.CMB.1.raw
  modified_base (227)..(227): a, c, t, g, unknown or other
  misc_feature (227)..(227): n is a, c, g, or t
  modified_base (338)..(338): a, c, t, g, unknown or other
  misc_feature (338)..(338): n is a, c, g, or t
  modified_base (356)..(356): a, c, t, g, unknown or other
  misc_feature (356)..(356): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctgatgtccaaggcatgagacagaccgccacactcacctgcacagggacnccaacatgtgcaacagagcagctgtgcagcagcaccagggccaccctcccacactcctgtcctacaggaataacaacccggccctcgagggactctacagagagtatttcngcatcaggtcaggaaacncacgcctcctgacctattactcggacctccagcctgacggacgaggctagacttattattgttagctagtacgggacaccgacgcctcacgtgcgttgggtgttcggcgggaggaccaggctcggaccgtccgtaggtacagcccaaggcctacccgg

SEQ ID NO: 257752 - DNA, 556 bp, Homo sapiens
  misc_feature: GYAE6OF01ECAYK.23.26.C04.1.454.CMB.1.raw
  modified_base (353)..(353): a, c, t, g, unknown or other
  misc_feature (353)..(353): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagccccccctgatgtccaaggacatgagacagaccgccacactcacctgcacagggaacgccaacaatgttggcaaccaaggagcagcttggttgcagcagcaccaggccacctcccacactcctgtacctacaggaactaacaacccggccctacgagggactctacagagtagtattttcngactatccgaggtccaaggaaaccgcaacgccctaccctcgaaccctacttacgtacggtactaccagccgtagacggacgacggctagactagttattgttacgctagtcggactaccgagcctcactgcgttgggtggtcgggcggacgggaccaaggctacggtaccgtccgtaggacacggccgaacggcctacccggg

SEQ ID NO: 257753 - DNA, 834 bp, Homo sapiens
  misc_feature: GYAE6OF01CL6H7.23.26.C04.1.454.CMB.1.raw
  modified_base (229)..(229): a, c, t, g, unknown or other
  misc_feature (229)..(229): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctgatgtccaaggacatgagacagaccgccacactcacctgcacagggaacnccaacaatgttggcaaccaaggagcagcttggttgcagcagcaccgagggcccaccctcccacacctcctgtcctaacacggaactaaaccgaacccggcccctacgaagggactccgtacgaagtagagtactttttcgagccacttcccgagggtaccaagggtaaaaccgccgaacgtccccttaccccgttacggtaacccctaacgtttaaccgttaccgggaaccccttccccgaacggtacccccgttaggggaaccggggtaacccgggtaaaccgggtcccgttacgggttaaaccgttttaaagtttttaacggttttacgggtttttaacgggtacccgttaacgggtttaccgggggaaacccctaacccggtaaccggttacccccttaacccggtaacccgtttcgggttccgggtttttcgggggtttacccgggttttacccggggggaccggggttaaaccggggggtaaccccgtaaaccggggttcccggttaacccgggtaacccccggtttacccggttaacggggttaccccgtaaccggggtaaccccccggtaaacggggtccccggtttaccccccgggg

SEQ ID NO: 257754 - DNA, 559 bp, Homo sapiens
  misc_feature: GYAE6OF01BHXJ8.23.26.C04.1.454.CMB.1.raw
  modified_base (227)..(227): a, c, t, g, unknown or other
  misc_feature (227)..(227): n is a, c, g, or t
  modified_base (351)..(351): a, c, t, g, unknown or other
  misc_feature (351)..(351): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctgatgtccaaggacatgagacagaccgccacactcacctgcacaggacncaacatgtgcaaccaaggagcagcttggtgcagcagcaccagggcccaccctcccacacctcctcgtccctacaggaaactaaaccgaacccggccctacagggactctacagagagtatttcngcatccgagtcaaggaaacgcagcctcctcgacctacttactacggacctccgacgcctggacggacgaggctagacttatttattgttagctagtggaccaccgacgtcctacacgtcgtacgttgggtacggttcggacgggacgggaaccgaggtcgtacggacccgtccgtacggtccgaacgtcccgaaggtccgtaccccgg

SEQ ID NO: 257755 - DNA, 542 bp, Homo sapiens
  misc_feature: GYAE6OF01DS9XC.23.26.C04.1.454.CMB.1.raw
  modified_base (225)..(225): a, c, t, g, unknown or other
  misc_feature (225)..(225): n is a, c, g, or t
  modified_base (245)..(245): a, c, t, g, unknown or other
  misc_feature (245)..(245): n is a, c, g, or t
  modified_base (255)..(255): a, c, t, g, unknown or other
  misc_feature (255)..(255): n is a, c, g, or t
  modified_base (336)..(336): a, c, t, g, unknown or other
  misc_feature (336)..(336): n is a, c, g, or t
  modified_base (358)..(358): a, c, t, g, unknown or other
  misc_feature (358)..(358): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagccccctgatgtccaaggacatgagacagaccgcacactcacctgcacaggacncaacaatgtgacaacaggancagcttggtncagcagcacgaggccaccctccacactcctgtcctacaggaactaacaaccggccctagacggatctcagagagtatttcngcactccgaggtcaaggaaacncacgccctcctacgacctattacgtcgactcgacgccgtaggacggacgacggctgtacttattagttgttagctagtacgggacaccgacgcctacacgtgtcgttgggtcggttcgggcgggacggaccaggtccgtacggtacccgttcgtacggtacagtcccgaaggtcccgtacccgg

SEQ ID NO: 257756 - DNA, 817 bp, Homo sapiens
  misc_feature: GYAE6OF01BSLK4.23.26.C04.1.454.CMB.1.raw
  modified_base (228)..(228): a, c, t, g, unknown or other
  misc_feature (228)..(228): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctgatgtccaaggacatgagacagaccgccacactcacctgcacagggacnccaacaatgtggcaaccaaggagcagcttggtgcagcagcaccagggcccaccctcccacacctcctgtccctacaaggaactaaccgaacccggtccctacgacgggtactcctacgaagagtacgtacttttcaggtacctaacgtcccgaagggttaccgaaacgggtaaaccgccgtaaccggtccccttaccccgtacggaaccccttaacgtttaaccgtacgggtaacccttacccgaacggtaccccgttaagggaacgggtaaccggtaacgggtaccgttacggtaaccgtttaaagttttaacgtttacgggtttttaacggaccgttaacggttaccgggggtaaccctaacccggtaaccggttaccccgttaccgtaaccgtttccgggttaccggttttacggggggtttaccgggtttacccggggggtaccggggtaaaccggggggtaaaccccgtaaacggggttccccgttaacccggggtaaccccccggtttacccgggttaaccggggttaccccgaaacccgggtacccccggtaaaaccggggtccccgttaacccccccgggg

SEQ ID NO: 257757 - DNA, 681 bp, Homo sapiens
  misc_feature: GYAE6OF01B8VN8.23.26.C04.1.454.CMB.1.raw
  modified_base (382)..(382): a, c, t, g, unknown or other
  misc_feature (382)..(382): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgccccctgatcgtaccaaggacatgagacacgaccgccacactcactgcacgaggaacgccaacaatgttacggacaaccgaaggagcagtcgttaggttgcagcacgccaaccgacggcccaccctcccactacctcctcgtacctaacaacggaactaacccgaacccggccctagacggacttcgaccgagaacgtagttattttcncgactacgtacgtacggtacgaacggaaaccgcacgtccctaccgtacgtacctaacgttaccgacggtacctccgtacgtaccgtaggaaccggtacggtacgtacgtacgtaacgtttaagtttagtttacgtttacgtacgtacggtaccggaacctaccgaccgtaccttacgaccgttcggttaccgggttggtaccgggttcgggaccgggacgggtacccgtaaggtccgtaccggtacccggtacggttacggtaccgacccgacccggtaaccggtcccggtacccccgg

SEQ ID NO: 257758 - DNA, 554 bp, Homo sapiens
  misc_feature: GYAE6OF01D0EPH.23.26.C04.1.454.CMB.1.raw
  modified_base (229)..(229): a, c, t, g, unknown or other
  misc_feature (229)..(229): n is a, c, g, or t
  modified_base (347)..(347): a, c, t, g, unknown or other
  misc_feature (347)..(347): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctgatgtccaaggacatgagacagaccgccacactcacctgcacagggaacnccaacaatgtgcaaccaagaagcagcttggttgcagcagcaccagggccaccctccacactcctgtcctacaggaataacaaccggccctacgagggactctcagacgagtattttcngcatccgaggtcaggaaacgcaagccctccctgacccattactaggacctccagcctggaggacgaggctgacttattattgtttagcatgggacctaccgagcctcactgcgtttgggtcggttcgggacgggtacgggaaccgaaggccgtacggtacccggtcccgtacgggtacacgggaccccgtaaggcccgtaccccggg

SEQ ID NO: 257759 - DNA, 760 bp, Homo sapiens
  misc_feature: GYAE6OF01ESG5Z.23.26.C04.1.454.CMB.1.raw
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctcgatgtccaaggacatgagacagaccgccacactcacctgcacagggacgccaacaatgtggcaaccaaggagcagcttggttgcagcagcaccgagggcccaccctcccacacctcctcgtacctacgaggaaactaaccgaacccggccctacgacgggactcctacgagagtacgtattttcgagcctatccgaagggtacaaagggtaaaaccgccgaacggtccccttaccccgtacggtaaccctaacgtttaaccgtacgggtaaccccttacccgaacggtacccgttagggaacggggtaaccggacgggtaccttacggtaaccgtttaagttttaacgtttaggttttaacggaccgtaaggttaccgggaacctaacccgtaacgtacccgttacgtaccgttcgggttacggtttacgggggtttaccggtttaccgggggaccggggtaacggggtaaccccgtaaacgggttcccgttacccggggtaaccccggttacccgggttaaaccgggttacccgaacccgggtacccccggtaaacgggtccccggttaaccccccggg

SEQ ID NO: 257760 - DNA, 672 bp, Homo sapiens
  misc_feature: GYAE6OF01BTPA7.23.26.C04.1.454.CMB.1.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (255)..(255): a, c, t, g, unknown or other
  misc_feature (255)..(255): n is a, c, g, or t
  modified_base (258)..(258): a, c, t, g, unknown or other
  misc_feature (258)..(258): n is a, c, g, or t
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
  modified_base (363)..(363): a, c, t, g, unknown or other
  misc_feature (363)..(363): n is a, c, g, or t
  modified_base (403)..(403): a, c, t, g, unknown or other
  misc_feature (403)..(403): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctgatgtccaaggacatgagacagaccgccacactcactgcacaggacncaacatgtgacaacgagancagcttgtncancagcacgaggccaccnccanacctccgtagtcctaacgaggtaaactaaccgaacccggcctacgaagggtactccgtacgaaggtacgtagttaacgtttttcncggacctaacttaccgaagggttacaaacgggtaaaaccnccgtaccgtacccttaccgtacgtaaccgtaacttaccgtacgtacctacgtacgtacgtacggacggaacggtacgtacgtaacgttaacttaacgtttaacgtttagtttacacgtaacgtaccggaacctaccgtaccgttacctacgtacgttcgtaccggtttgggtacggtaccgggacggtaaccggtacgaacggttccgtaaccgtaacccggtacggtaacggtacgtaacccggaacccgtaccggtcccgtacccgg

SEQ ID NO: 257761 - DNA, 719 bp, Homo sapiens
  misc_feature: GYAE6OF01C1N9I.23.26.C04.1.454.CMB.1.raw
  modified_base (255)..(255): a, c, t, g, unknown or other
  misc_feature (255)..(255): n is a, c, g, or t
  modified_base (290)..(290): a, c, t, g, unknown or other
  misc_feature (290)..(290): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgccccctgatcgtccaaggacatgagacacgaccgcacactcacctgcacgagggaacaccaacagtgtcgacaacgaaggancagtcttggtcgcagcacgcacgacggcccacccnccactcctcctcgtacctaacgaacggaaactaaaccgacccggaccgtacggaacggtactcgtaacgaagtaagtacgttacttttcgacgtactacgtaccggtaacggtaccggaaacggaacccgtacgaccgtaccctacccgtacgtaacctacgttacgacggtaccctaccgacggtaccgtaggaacgggtacggacggtaccgttagtaaccgtttaagttttacgtttacgtttaacggacgttaacggttaccgggaaaccctaccggtacgtacccgttacgtaccggttcggttacgggtttacggggttccggttacggggaacgggtaaaccgggtaccgtaaacggtccggttaacccggtacccgttacggtacggaccggtaccgaccggaccggtcccgtacccccgg

SEQ ID NO: 257762 - DNA, 661 bp, Homo sapiens
  misc_feature: GYAE6OF01CVB41.23.26.C04.1.454.CMB.1.raw
  modified_base (369)..(369): a, c, t, g, unknown or other
  misc_feature (369)..(369): n is a, c, g, or t
  modified_base (397)..(397): a, c, t, g, unknown or other
  misc_feature (397)..(397): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgccccctcgatgtccaaggacatgagacagaccgccacactcacctgcacagggaacgccaacaatcgttggacaaccaaggagcagcttggtgcagcagcaccgacgggcccaccctcccacacctcctcgtcctacgaggaactaaaccgaacccggccctacgacgggactcgtacgagacgtagtacttttcngactacgtaccgaggtacgaacggaacncgacgtccctccctcgaccctacgttaccgtcggtacctccgacgtccgtaggacggacgacggcgtacgtaacgtttatttagtttaggtttacgtcgtaagtaccgggaacctaccgtacgtacccgttacgtaccgttcggtccggtttcggggtacggtttaccggggaccgggtacggggaacccgtaacggtcccgttacggtaccccggttccggttacggtacccgtacggaccccgaagggtccccgtccccggg

SEQ ID NO: 257763 - DNA, 831 bp, Homo sapiens
  misc_feature: GYAE6OF01D6VIF.23.26.C04.1.454.CMB.1.raw
  modified_base (351)..(351): a, c, t, g, unknown or other
  misc_feature (351)..(351): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcaccgcccccctcgatcgtaccaaggacatgagacacgacccgaccacacctccacctcgacacgacgggaaccgaccaaactaagtggttacggaccaaaaccgaagggacgacgacggtcgtttgggttacgcgagccgacggccaacccggaccgggaccccaccccctccccgaaccncccgttcccgtaccgtaccctaacgaacgtaaacctaacccgaacccggccctacggacgggtacctacgtacgaacgacgtaacgttacttttacgcgaccttacgtacccgtacgggtaccgaacggtaacccgtccgaccgtccccgtacccgtacgtaacccttaacgttaccgtaccggtaaccctacccgtaccggtccgtaacggaacgggtaccggtacggtaccgttaacgttaactttagttttacgtttacggtttagtaccgtagggttaccggaaccctaccgtaccgttaccctacggttacgttcggttaccgggtttcgggttacccggggttaccggggaacccggggtaaccgggtaacccggtaaccggtcccgttaacccggggtaccccggtttaacccggttaccgggtaacccggaacccgggttaacccgtacgggttcccccggtaccccccggg

SEQ ID NO: 257764 - DNA, 648 bp, Homo sapiens
  misc_feature: GYAE6OF01ELTNY.23.26.C04.1.454.CMB.1.raw
  modified_base (228)..(228): a, c, t, g, unknown or other
  misc_feature (228)..(228): n is a, c, g, or t
  modified_base (245)..(245): a, c, t, g, unknown or other
  misc_feature (245)..(245): n is a, c, g, or t
  modified_base (255)..(255): a, c, t, g, unknown or other
  misc_feature (255)..(255): n is a, c, g, or t
  modified_base (280)..(280): a, c, t, g, unknown or other
  misc_feature (280)..(280): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgccccctgatgtccaaggacatgagacagaccgccacactcacctgcacaggaacncaacatgtgcaacagancagcttggtncagcagcacacggccaccctccacnctcctcgtcctacaggaactaacgacccggccctacgacgggactctacagagagtatttctgcatccaggtacaaggaaacgcacgtccctccgtacgtaccctagtttaccgtacgggtaccctaccgacggtccgtacggacggggaccgacgggtcgtacgtaacgtttaatttaagtttgtttaagtcgtaacggttacgggaacctaacccgtacgtaccttaccgtacgttacggttccggtttagggttcgggttaccggggaccggggaacgggtaacccgaacggtccggttaccggtaccccggttacccggttacggtacgaaccggtaccccgtaaacggtcccgtaacccccgg

SEQ ID NO: 257765 - DNA, 745 bp, Homo sapiens
  misc_feature: GYAE6OF01BTBAT.23.26.C04.1.454.CMB.1.raw
  modified_base (229)..(229): a, c, t, g, unknown or other
  misc_feature (229)..(229): n is a, c, g, or t
  modified_base (277)..(277): a, c, t, g, unknown or other
  misc_feature (277)..(277): n is a, c, g, or t
  modified_base (305)..(305): a, c, t, g, unknown or other
  misc_feature (305)..(305): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgccccctgatgtccaaggacatgagacagaccgccacactcacctgcacagggaacnccaacaatgtggacaaccgaaggagcagcttggttgcagcagcaccgngggccaccctccacacctcctgtcctanacggaataaccgaaccggccctacgacgggtactccgtacagtaacgagttactttttcgcgtacctactaccgaagggttacaaacgggaaaaccgccgaacggtcccccttacccgtaacggaaccccttaacgtttaacccgtacgggtaacccttacccgaaccggtaccgttacgggaacgggaaccggtacgggtacccgttacggtaaccgttttaagttttaacgttttacgggttttaacgaccgttaacggttaccggggaaccctaacccggtaaacgtccccgttacgtaacccgttcgggttaccggtttcgggggttcggtttaccggggaccggggtaacgggacccgtaaacggtcccgtaccggtacccggttaccgttaacgggtccgaacggaccccgtaacgggtcccgtaccccccggg

SEQ ID NO: 257766 - DNA, 641 bp, Homo sapiens
  misc_feature: GYAE6OF01E292E.23.26.C04.1.454.CMB.1.raw
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctgatgtccaaggacatgagacagaccgccacactcacctgcacgagggaaccgccaacaatgttcggacaaaccaaggagcagcgttggtgcagcagcaccgacgggcccaccctcccacacctcctcgtaccctacaacggaactaaaccgaacccggccctacgacgggactcgtacaggagagtatttcagcactcaggtacaaggaacgcacgccctcctacgacctacttacgtcggacctccgacgtcctaggacgggacgacggtctacgtacttatttagtttgtttacgacgtagtacgggaacctaccgacgtcctcgacgttcggtcggttgggttcggttaccgggacggggtaaccgggaacgtaacgggtccgttaccgggtaaccccggtttccggtaacgggtacccgaaccggtaccccggtaaagggtccccgttacccccggg

SEQ ID NO: 257767 - DNA, 738 bp, Homo sapiens
  misc_feature: GYAE6OF01CS9TD.23.26.C04.1.454.CMB.1.raw
  modified_base (232)..(232): a, c, t, g, unknown or other
  misc_feature (232)..(232): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctcgatgtccaaggacatgagacacgaccgccacactcacctgcacagggaacnccaacaatgttggacaaccaaggagcagcttggtgcagcagcaccgacggcccaccctcccaccacctcctacgtacctacgacggaaactaaacccgaacccgcccgtacgacgggactcctacgaagagagttacttttacgcgtactactaccgacgggtacgaaacggaaaccgcgtacgccctaccctacgaaccctaacgttaaccgtacggtaccctccgaacgtacccgtaggacgggacggacggtacgtacgtaaccgtttaatttaagtttacgggtttaacggacgtaacggttacgggaaaccctaaccgaccggttacccttaccgtaccgttcgggtccggttttcgggggttaccgggttaccgggggcggggtaaaccggggtacccgtaaaccggggtcccggttacccgggtaacccggtttaccccgggtacgggtttaacccggaccgggttaacccccggaacggggttcccgtaccccccggg

SEQ ID NO: 257768 - DNA, 803 bp, Homo sapiens
  misc_feature: GYAE6OF01BCWUE.23.26.C04.1.454.CMB.1.raw
  modified_base (256)..(256): a, c, t, g, unknown or other
  misc_feature (256)..(256): n is a, c, g, or t
  modified_base (391)..(391): a, c, t, g, unknown or other
  misc_feature (391)..(391): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctgatgtccaaggacatgagacagaccgccacactcacctgcacgagggaacgccaacaatgttggacaaccaaggancagcttggttgcagcagccaccgacgggcccacccctcccacaccttccctcgtaccctaacgaacggaaactaacccgaaccccgggccctacgaacgggacttccgtacgaagagtacgttaactttttccgngacctacttacccgaagggttaccgaaagggtaaaacccgccgtacggtacccccttccccgtacgtaaccccttaacgtttaaccgtccgggaacccttacccgaacggtcccgttagggaacggggtaaccggacgggtacccgttacggtaacctttaagttttacgttttacgggttttaacggtaccgtaacggttacggggaaccctaacccggtaaccgtacccgttaccgtaccgttcgggttccggttttacgggggttcgggtttacccgggggaaccgggggtaaccgggggtaacccggtaaacgggtcccggttaaccggggtaacccccggttaccgggttaacccgggttaccggaacccgggtaccccggtaaccgggtcccgttaccccccgggg

SEQ ID NO: 257769 - DNA, 858 bp, Homo sapiens
  misc_feature: GYAE6OF01BAV9P.23.26.C04.1.454.CMB.1.raw
  modified_base (570)..(570): a, c, t, g, unknown or other
  misc_feature (570)..(570): n is a, c, g, or t
  modified_base (591)..(591): a, c, t, g, unknown or other
  misc_feature (591)..(591): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctcgcagtcgtcaggtcggtccaggcacggcctgactccaccgtcccccctagtacgtcgtaccgaaaggacctagtacggaacgaaccgaaccggaaccccggaccctaaccgaaccgttacccaaaccgtcggaacccgaaccggaaaccgggggaaacccaacctaaactaacggttcggttaccgggaaccaaaaccggaagggacgtaccgtacgtaccgtttagggttacggacgaacgcgacggaccgtaacccggaccgggtaccccacccgtacccacctaccctccgttaccgttaaccgaacgtaaccggtaaaaccgtaacccggaaccccgggtcccgtaacggaacggtaccgttaaccaggtaagtaaccgtagtaccgttttcacgactaccgtacgtacggtaccgaaggaacccnctaccgccctcgactaacctnttaaccgacgttaccaccgtaggtaccgaggacggacggtacgacctagttaaccttgtttaaacgttgtaacgcggtaacgttaccgggaccctaacgtaccgttccgtaaccttacgggttaccgttacgggttcgggttaacgggttacccggggaaccggggtaaccggttacgaaccgggtttcggaacccggtttacccgggaacggtaccggttaaccggaaccccgggtaaccggttccggaacccggttacccccggg

SEQ ID NO: 257770 - DNA, 697 bp, Homo sapiens
  misc_feature: GYAE6OF01EBSTZ.23.26.C04.1.454.CMB.1.raw
  modified_base (240)..(240): a, c, t, g, unknown or other
  misc_feature (240)..(240): n is a, c, g, or t
  modified_base (273)..(273): a, c, t, g, unknown or other
  misc_feature (273)..(273): n is a, c, g, or t
  modified_base (289)..(289): a, c, t, g, unknown or other
  misc_feature (289)..(289): n is a, c, g, or t
  modified_base (422)..(422): a, c, t, g, unknown or other
  misc_feature (422)..(422): n is a, c, g, or t
tcagacgcgagtatcacgaccggtgctcgatttagtctagcgactttgggtttggggtccaaacagagcttcagcaagcatagtgggaatctgcaccatgcctggggctctgctcctcctcgaccctcctcactcactctgcagtgtcagtggtccaggcaggcctgactcacgcccccctgatcgtaccaaggacatgacgacacgaccgccacacctcacctgaccacgacgggaacnccaaacaagtgttacggaccaaccgaagggacncgagccgtttgggttnacgagcacgaccaccgacgggcccacccctcccacctaccttcctacgtcctaacgaaggaacctaaccgacccggcctacgacggactctacgagagtatatttcagactataccgaggtacgaacggaacnccgaccggtccctacccgtacgtaaccgtaacgttaccgtacgtacctacccgacgtaccgtacggaacgggacgacggtacgtacgtaacttttacgtttagtttacgttacgtacgttacggtacggtaacctaaccgtaccgtcccgtacctacggttccgtacgggtttcgggtacgggttccgggaacggggtaccggaaccggtcggtaccgtaccggaccccggttacggtaccggtaccgaacccggtcccggtaacggtcccccgg

SEQ ID NO: 257771 - DNA, 654 bp, Homo sapiens
  misc_feature: GYAE6OF01C8IVA.23.26.C04.1.454.CMB.1.raw
  modified_base (228)..(228): a, c, t, g, unknown or other
  misc_feature (228)..(228): n is a, c, g, or t
  modified_base (566)..(566): a, c, t, g, unknown or other
  misc_feature (566)..(566): n is a, c, g, or t
tcagacgcgagtatcacgaccggtgctcgatttagtctagcgactttgggtttggggtccaaacagagcttcagcaagcatagtgggaatctgcaccatggcccggggctctgcctcctcctcgaccctctcactcactctgcagtgtcaggtcggaccaggcaggcctgacctcaccgccccctgatcgaccaaggactagagacgacacgaccgccacactcaccngaccacgacggacaccaagtagttgacgaacaaacgaggtacgcaggtcgtttaggcacgaacgcgacgaccgaccggtacggcccctaccacccgactacctccgtacactacgaacgaactaccgaccgtctagacgctacgagtacgagtacgtatttcgacgtactagtacgaacggtacgaaacgtaccgacgtacccgtacccgtacgtactaaaccgtacgtaccgtaccggtacgtaccgacgtacggaacgtacgggaccgaggttaccgtagtaacctttagttatttacgtagtaacgtacggtaacgaccgtaccacgacccgttntacggttcggtacggtcggtcgggaacggtccgggacacgtaggccgtacggtaccgacggtacgtcgacgtcgtccgcgtaccccgg

SEQ ID NO: 257772 - DNA, 676 bp, Homo sapiens
  misc_feature: GYAE6OF01D1O7M.23.26.C04.1.454.CMB.1.raw
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctgatcgtccaaggacatgagacacgaccgccacactcacctgacacgagggaccnccaanatgtagacaaccaaggagacagtcgttggtgcgagcgagccaaccgacgggaccccacccgtcccacgtacctcctcgtacctaacgaacggtaactaaccgaacccggtccctacgacggtactaccgtagacgtaagtacgttacttttcgtcgactaccgttaccgaacgggtaccgaaacggtaaaccgccgtaaccgccccgttacccgtaccgtaacctacgttaccgtaccggtaccctaccgacgtccgtacggacgacggagtctacgtacttattagtttgtacgacgtagtacggacctaaccgcgtctacgtacgttcggtcggttgggttcggtaccgggcgggtaaccgggtacgtacggtaccgtccggtaaccgttacccggtaggaccggaacccgcccggtaacggcccgtaccccggg

SEQ ID NO: 257773 - DNA, 783 bp, Homo sapiens
  misc_feature: GYAE6OF01BGEB7.23.26.C04.1.454.CMB.1.raw
  modified_base (231)..(231): a, c, t, g, unknown or other
  misc_feature (231)..(231): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctcgatgtccaaggacatgagacagaccgccacactcacctgcacagggaacnccaacaatgttggacaaccaaggagcagcttggttgcagcacgcaaccgacgggccccacccgtcccacacctccctcgtcctaacaacggaaactaaacccgaacccggccctacgaacgggacttcctacgaacgaggtagttacttttctacgtctaacgtccgaaggtaccgaaacgggaaacccgcaacggtccctaccccgtagaaccctaacgttacgtacgggtaccctaccgacgtcccgtaggacgggtaccggacggtccttaaggtaacctttagttttacgtttacggttttacgaccgttaacggttacgggaaccctaaccgtaccggttcccgttaccgtaacgttccgggttccggttttcggggggttacggtttaccccgggggtacgggggtaaccgggtaacccgttaaacggggttaccccggtaccggggttaacccccggtttaccgggttaaacccggggttccccgtaaaaccccggggttaacccccggtaaaccgggttcccccggtttaaccccccccggggg

SEQ ID NO: 257774 - DNA, 706 bp, Homo sapiens
  misc_feature: GYAE6OF01DPBL8.23.26.C04.1.454.CMB.1.raw
  modified_base (549)..(549): a, c, t, g, unknown or other
  misc_feature (549)..(549): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgccccctcgatcgtccaaggacatgagacacgaccgccacactcacctgcacgacggaacgaccaacaatggttacggacaaaccgaaggacgacagtcgttggttgacagcacgccaaccgacgggacccaccccgtcccacctacctccgtcgtacctaacgaacggaaactaaacccgaacccggtaccctacgacgggtactaccgtacgaagtaaggtagttacgttttcgcgtactacgtaccgacggtacgaaacggaaaccgtcaaccgtccctacccgtaccgaaccttaacgttaccgacggtaccctaccgacgtaccgtaggacggtacggacgtcgtacgtacttaagtttagttagttacgtntacggtacggaccctaccgacgttccctacgtacgttaggtccgtttggggtccggttaccggggacgggtaaccggtaaccgtacggtccgtacccggtaccgttaccggtaccggtacgacccgggaccccggtaaggtcccgttaccccccggg

SEQ ID NO: 257775 - DNA, 705 bp, Homo sapiens
  misc_feature: GYAE6OF01CWZBC.23.26.C04.1.454.CMB.1.raw
  modified_base (254)..(254): a, c, t, g, unknown or other
  misc_feature (254)..(254): n is a, c, g, or t
  modified_base (269)..(269): a, c, t, g, unknown or other
  misc_feature (269)..(269): n is a, c, g, or t
  modified_base (319)..(319): a, c, t, g, unknown or other
  misc_feature (319)..(319): n is a, c, g, or t
  modified_base (418)..(418): a, c, t, g, unknown or other
  misc_feature (418)..(418): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgccccctgatgtccaaggcatgagacagaccgccacactcacctgcacaagggacaccaacatgttaggacaaccgaaggancagtcttggtcgcancacgccaccgacgggccccacccctccgacctacctcctacgtaccctanacggtaaactaacccgaccgccctacgagggtactcgtacacggtagacgttacttttacgacgtacacgttaccgaggttaaccgaacgggtaaaccncgaaccgtcccttaacccgacgtaaccctacgttaccgtacggtaacccttccgacgtaccgtggaacgacggacgtcgtacgtaactttacgttaacttttaggttaactacggtacgttacgggaaccctaccgacgttacccgtacgtacgttacggttcgttaggggttccgggtacggggacggtaacgggtaacccgaggttcccggttaccggtaacccgggttccgttaaccgggaaccgacccgggttaacccgaaccggttcccggtaacccccggg

SEQ ID NO: 257776 - DNA, 779 bp, Homo sapiens
  misc_feature: GYAE6OF01B8AN6.23.26.C04.1.454.CMB.1.raw
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgccccctgatgtccaaggacatgagacagaccgccacactcactgcacgaggaacgccaacagtgtcggacaaccgaaggagcagcttggttgcagcagcaccgagggcccacccgtccccacgacctcctcgtaccctaacgacggaaactaaccgaaccccggtccctacgaacggtactccgtacgaagagttacgtacttttcgtacgactacgtaccgaggttaaccgaacggtaaaccgccgaacgtccctacccgtacgtaaccctactttaaccgtcggtaccttacccgagtacccgagtaacgggtacggacgtaccgtgttaaaccttacgttttaacgtttcgtttaacggaccgttaaaggttaccggggaacccctaaaccggtaccgttcccgtaccgttaacggttccgggtttccgggtttacggggtttaccgggttaacccgggggaccgggggttaaaccggggtaccccggttaaaaccggggtccccgggttacccgggttaaaccccgggttcccgggtttaaccggtacccgggaaaccccggtccccggtaaacccggggttccccgggtaccccccccggg

SEQ ID NO: 257777 - DNA, 774 bp, Homo sapiens
  misc_feature: GYAE6OF01EMV90.23.26.C04.1.454.CMB.1.raw
  modified_base (145)..(145): a, c, t, g, unknown or other
  misc_feature (145)..(145): n is a, c, g, or t
  modified_base (254)..(255): a, c, t, g, unknown or other
  misc_feature (254)..(255): n is a, c, g, or t
  modified_base (348)..(348): a, c, t, g, unknown or other
  misc_feature (348)..(348): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtntcagtggtccaggcaggcctgacctcacgcccccctgactgtaccaaggacatcgagacacgaccgccacactcactgcacacggacacaacaatgtaggcaacaaggnnagcttggttgcagacacgcaaccgacgggcccacccgtacccacacctccttcgtacctaacgaacggaaactaacccggaacccggtacccncgtaacgggtactccgtacgagtaacgtaacgttacgtttccgtacgacgtactaccggtacgtaacgaaacggaaacctccggacctaccccttaccgaccgtaactacgttacgtaccgtcctaccgacgtccgtacgggaacggtacgacgcgttaacgtaactttaagtttacgtttcgttaacggtacgtaacgtacgggtaaccctaaccggtacccgtacccgttaccttaacggttccggttaacgggttttcgggggtaccgggttttaaccgggggacccggggtaaaccgggtaaaccccgtaacggtaccccggtttaacccgggtaaccccgtttaaccccggggttaacggtaccccggtaaaccgggtacccccggttaaaaccggggtcccccggtttaaccccccgggg

SEQ ID NO: 257778 - DNA, 753 bp, Homo sapiens
  misc_feature: GYAE6OF01AV3TN.23.26.C04.1.454.CMB.1.raw
  modified_base (226)..(226): a, c, t, g, unknown or other
  misc_feature (226)..(226): n is a, c, g, or t
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
  modified_base (244)..(244): a, c, t, g, unknown or other
  misc_feature (244)..(244): n is a, c, g, or t
  modified_base (248)..(248): a, c, t, g, unknown or other
  misc_feature (248)..(248): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctgatgtccaaggacatgagacagaccgcacactcacctgcacaggacncaanatgtgcacagncantgtncagcagcacaggccacctccacactcctcgtcctacaggaactaaccgaacccggtcctacgagggtactccgtacacggaagtacgtactttttacgcgtactaacgttacccgaagggttaccaaacgggaaaccgcgtaaccgggtaccccttaccccgtaacggtaacccttaacgtttaacccgtcgggtaaccccttacccgtaaccggtacccgttaacgggaacgggtaacccggtaacgggtacccgttaacggttaacctttaacgttttaacgttttacgggttttaacggaaccgttaaacgggttaccggggaaaccctaacccggtaaccggtaccccgttaccgtaaccgtttcggttacccgggtttcggggtttaccgggttcccggggtaaccggggtaacgggtacccgtaaagggtcccgttacggtacccggttaccgtaaccgggtaccgtacccggacccgtaacgggtccgttacccccgg

SEQ ID NO: 257779 - DNA, 805 bp, Homo sapiens
  misc_feature: GYAE6OF01CKSPM.23.26.C04.1.454.CMB.1.raw
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
tcagacgcgagtatcacgaccggtgctcgatttagtctagcgactttgggtttgggggtccaaacagagcttcagcaaggcatagtgggaatctgcaccatgcccggggctctgctcctcctgaccctcctcactcactctgcagtgtcagtggtccaggcaggcctgactcacgccccctgatcgtccaaggacatgagacgagaccgaccacactcacctgcacgaggaacnccaanaatgttaggacaaccgaaggacgcagtcgttggttcgcagcagtcaccgacggtcccacccctccacacctccgtcgtaccctacgaaggtaactaaccgaacccggccctagaacgggactccgtcgaacggacgtagtacttttcgacgtctaaccgtccgtacggtaccgaacgggaaacccgcgtaaccgtccccgttaccccgtaccgtaacccgttacgtttaacccggtaccgggtaaccccttacccggaaccggtaccggttacgggaaccgggtaccggtaaccgggtaccgttaaggtaaccgttttaacgttttaacggttttaacggttttaacgaccgttaacgggtttccggggaaacccttaacccggaccggttacccctaaccggtaccgttcgggtttaccgggtttaggggttccgggttaccgggggaccggggtaaaccgggaaccggtaaccgggttaccggttcccggtaaacccgggtttcccggtaacgggttacccgaaccgggttaccccggtaaacgggtcccccgttacccccggg

SEQ ID NO: 257780 - DNA, 689 bp, Homo sapiens
  misc_feature: GYAE6OF01ANKZ2.23.26.C04.1.454.CMB.1.raw
  modified_base (325)..(325): a, c, t, g, unknown or other
  misc_feature (325)..(325): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
  modified_base (343)..(343): a, c, t, g, unknown or other
  misc_feature (343)..(343): n is a, c, g, or t
  modified_base (360)..(360): a, c, t, g, unknown or other
  misc_feature (360)..(360): n is a, c, g, or t
tcagacgcgagtatcacgaccggtgctcgatttagtctagcgactttgggtttggggtccaaaacagagcttcagcaagcatagtgggaatctgcaccatgcccggggctctgctcctcctcgaccctccccactcactctgcagtgtcagtggtccaggcaggcctgacctccacgcccccctcgactcgtcccgaaaggacatgaacggacacggacccgccacacctccaccctcgaccgaacgaacgggaaccgaccaaacaagttgttacggaccaaccgaggacgcgtagtcgtggtgcagcagcaccgcggcccaccnccacnctccncgtccaanacgactaacgaccgccncgtaggactcgacgagtagacgttacgtttcgacgtctaccgtacgtaagggtaaccgacggaaaccgtcccgaaccgttcccctaccggttaccgacccttaacgttaccgtaccgggaccctacccgaccgtcgtaccgggaacggtcggaacgtcgtaactacgttatttacgtttaggtacctcgtaaggcccgtaacgaccgtacgtaccgtcctagggttacgttcgggttacgggtggtacccgggaacgggacggtaccgaccgtcggtacgtacccgtacggtaccgtacggccgaccgtacggtcccacccgttccccg

SEQ ID NO: 257781 - DNA, 726 bp, Homo sapiens
  misc_feature: GYAE6OF01A15SN.23.26.C04.1.454.CMB.1.raw
  modified_base (256)..(256): a, c, t, g, unknown or other
  misc_feature (256)..(256): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctctcactcactctgcagtgtcagtgtccaggcaggcctgactcacgccccctgatcgtaccaaggacatgagacacgaccgcacactcacctgacacgagggaacacaacagtgtagacaaccgaaggacnctagtcgttggtcgcacgcgacgaccgaccgacgggacccctacccctacccacctaaccctccgtcgtaaccctaacgaacggtaacctaaacccgaccccggtacccgtacgacgggtacctacgtaacgaaggaacgtattacgtttcgacgtactacgtaccgaacggtaccgaaacggaaccgaccgtaaccggtacccttacccgtaggtaacccttacggttaccgtaaccgggtacctaccggtaacggccggaaggtaccgggaacgtacgtaccgtacgtaactttaaggttttacgtacggttacaccgtagtaccggactaccgtcgtcccttaagtcggtgttaaccgggtttcgggtcggtaacggggaccgggtaacggaccgtacgggtccttaccggtacccggttaccggtaacggaccgtacccggacgttaaccggtcccgttaccccgg

SEQ ID NO: 257782 - DNA, 760 bp, Homo sapiens
  misc_feature: GYAE6OF01BWPE8.23.26.C04.1.454.CMB.1.raw
tcagacgcgagtatcacgaccggtgctcgatttagtctagcgacttttgggtttggggtccaaacagagcttcagcaagcatagtgggaatctgcaccatgcccggggctctgctcctcctgaccctcctcactcactctgcagtgtcagtggtccaggcacggtcctgactccaccgcccccctgatcgtaccgaaggacagtgacgacacggaccgccacactccactcgacacgacgggaaccaccaacgagttcggtacgaccaacgaaggacgccagtcgttaggttcgacgagcgacgacccgaccggaccggtcccccaccctcccacctaccttccgtaccgtaccaacggaacggtaaaacctacccggtaacccggacccgtacgaacgggtactacttaccggaagtacgttaacgttcttttcgcgaccgtactccggtacggtaaccgaaaccggaacgaccgtacccgtcccgtacccgtacgtaacccgttacgttaccgtaccggtacccgtaccggtacgtaccgtacgggacgggtacggtaacgtcgttaactacgtttaacgtttacgttagtttacgtacgtacggtacccggtactaacgtccgtccgtctagtccggtttgggttacgggttcgggtacggggacccgggtacgggtacccgaggtcccggtaacccggttcccggttacccggtacggtaccccggtacgccccgggaacgtcccggttacccccg

SEQ ID NO: 257783 - DNA, 828 bp, Homo sapiens
  misc_feature: GYAE6OF01B2Z4H.23.26.C04.1.454.CMB.1.raw
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcaggtggtccaggcaggcctgactcacgccccctgatcgtccaaggacagtgagacgagaccgccacacctcacctgaccgaacgacgggaaccaccaaacaagttcgttacggaaccaaaaccgaaagggacgacgaaggtcgtttcgggtgaccgaaggccaacggacccgaacccggaaccggggtacccccacccccgttaccccaacctaacccttcccgttacggttaacccctaacgaaacggtaaaacctaaacccgaaccccggtaccctacggtacgggaactccgtaacgaaggaacgtacgttacttttcgacgacctacgttacccgaagggtacgaaaacggtaaaccgccgtaccggtaccccttcccgtaacgtaaccttacgttaaccgtcggtaaccctccgaacgtacccgtagggaaccgggtacggtacggtaccgttagttaaccgtttaagttttaacgtttacggtttaacgaccggttaaggttaccgggtaacctacccgtaacggttccctaacgtaccgttcgggttacgggtttgggttaccgggttacgggacggggtaaccggtaccggtaacggtcccggtaaccggtacccggttaaccggttacgggtaccgaacccgggtaccggaacggttccccgttaccccggg

SEQ ID NO: 257784 - DNA, 667 bp, Homo sapiens
  misc_feature: GYAE6OF01CRLSH.23.26.C04.1.454.CMB.1.raw
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (298)..(298): a, c, t, g, unknown or other
  misc_feature (298)..(298): n is a, c, g, or t
  modified_base (355)..(355): a, c, t, g, unknown or other
  misc_feature (355)..(355): n is a, c, g, or t
  modified_base (385)..(385): a, c, t, g, unknown or other
  misc_feature (385)..(385): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctgatgtccaaggacatgagacagaccgccacactcacctgcacaggacncaacatgtganaacagagcagcttgtgcagcagcaccgcggcccaccctcccacacctcctgtaccctanacggaaactaaccaacccggccctacgacggatcctacgagacgtagtaacttttcngacacttaccgagggtacaaacgggaaccncgtaacgccctaccttacggaccctaactttacgacggtaccctaccgaacgtcccgtaggaccgggaacggtaccgtacgtacgtaacgttttaacgtttagtttacgggttttagaaccgttaggtaccgggaacctacccgtagtaccccgttactacgtccggttacggtttcgggttacggttacggggacggtaccgggaccgtaacggtcccgtacggtacccgtacccggtaacggttacccgaacgtacccgtaagggtccctacccccgggg

SEQ ID NO: 257785 - DNA, 633 bp, Homo sapiens
  misc_feature: GYAE6OF01CEZXE.23.26.C04.1.454.CMB.1.raw
  modified_base (231)..(231): a, c, t, g, unknown or other
  misc_feature (231)..(231): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgccccctcgatgtccaaggacatgagacagaccgccacactcacctgcacgagggaacnccaacaatgttggacaaccaaggagcagcttggttgcagcagcaccagggcccacccgtcccacacctcctgtacctacaggaaataaccgaaccggccctcgagggactactcagagtagacttttcgtgcatcccgaggtcaaggaaacgcacgtcctccctagacccatttaccgtaggtacctccgaacgtccgtacggacggacggaacggtctacggtacttaattagtttacgtttagacgtaaggttcgggaacctaccgtacgcccttacgacgtcgtcggtttcgggtacggttccgggacgggaccggggtaaccaacgggtcccgtacggtaccccggttaccgttacgggtaccgaccggaccccgggtaaggcccgttaccccccggg

SEQ ID NO: 257786 - DNA, 634 bp, Homo sapiens
  misc_feature: GYAE6OF01CRXBM.23.26.C04.1.454.CMB.1.raw
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
  modified_base (271)..(271): a, c, t, g, unknown or other
  misc_feature (271)..(271): n is a, c, g, or t
  modified_base (531)..(531): a, c, t, g, unknown or other
  misc_feature (531)..(531): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgccccctgatcgccaaggacatgagacagaccgccacactcacctgacacgacgggaacaccaanaatggtacgacaacgaaggancgagtcgttggtncagcagcaccgacggtcccaccctacccactacctcctacgtacctaacgaaggaaacctaacccgaacccggtccctacgacggtactcacgaagaacgtagttactttacgcgacgtactaccgtaaggaccgaaacggaacgcaccgtccctaccgtacgacctacgttacacggaacctccgacgtaccgaggaacgggacgtaggactacgtacgttacgtttagttacgttcacgtaggtacggaccaccgtcnctacacgttcggtacgttgggtacgttcggggaacgggtccgaaacgtggtccgtaacggtaccgtacgtacggtaccgaccggacccgacgtccgtacccgg

SEQ ID NO: 257787 - DNA, 649 bp, Homo sapiens
  misc_feature: GYAE6OF01E3TK4.23.26.C04.1.454.CMB.1.raw
  modified_base (230)..(230): a, c, t, g, unknown or other
  misc_feature (230)..(230): n is a, c, g, or t
  modified_base (254)..(254): a, c, t, g, unknown or other
  misc_feature (254)..(254): n is a, c, g, or t
  modified_base (289)..(289): a, c, t, g, unknown or other
  misc_feature (289)..(289): n is a, c, g, or t
  modified_base (363)..(363): a, c, t, g, unknown or other
  misc_feature (363)..(363): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctgatgtccaaggacatgagacagaccgccacactcacctgcacagggaccnccaacatgtcggacaaccaaggancagcttggtgcacgcagcaccgacgggcccacccncccacacctcctcgtacctacgaacggaactaaaccaaccggccctcgacgggatctcaagagagtacttttcngctataccgaggtaccgaacggaaccgcaacgcccttcccacgacctacttaccgtcggtactcccgacgtccgtaggacggtacggacggtcgtacgtacttagttttaatttgttaacgtccgaagtacggggacctaacccgtacgcccttacgtacgtcggttccggttggggtttcgggtccgggtacggggaacgggtacccgaacggtccgtccggtaacccggtaccggttaaccgggtcgaacccgggtacccgtaacggtcccgttaccccccggg

SEQ ID NO: 257788 - DNA, 700 bp, Homo sapiens
  misc_feature: GYAE6OF01CI373.23.26.C04.1.454.CMB.1.raw
  modified_base (210)..(210): a, c, t, g, unknown or other
  misc_feature (210)..(210): n is a, c, g, or t
  modified_base (243)..(243): a, c, t, g, unknown or other
  misc_feature (243)..(243): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtgtccaggcaggcctgactcacgccccctgatcgtccaaggcatgagacacgaccgccacnctacaccgtgacaacgagggtaaccgaccaaanaagttcgttggaccaaccgaaggacgcaagtccgttggttcgacagcagtccacccgacgggtccctaccccgtaccctaccacctccctcgtaccgtaacgaacggtaactaaacccgaacccgggtcctacgtaacgggtactccgtacgagtacgtacggtacttttacgtcgtacgacgttcgacggtacgaacggaaccgccgtacgacccctccgtacgacctaacttaccgcgtacctcgaacgtcgaggaacggacgtacggctagtaacttattacgttagttacgactaggttcggaacctaccggtacctcgtactcgtacggttcgttacgggtccgttaccgggaccgggtacggaaccggtaacggtcccgttaccggtaaccccgtttaccggaacgggtacccaacccggacccggtaaacggtccccgttaccccccggg

SEQ ID NO: 257789 - DNA, 728 bp, Homo sapiens
  misc_feature: GYAE6OF01DWRTK.23.26.C04.1.454.CMB.1.raw
  modified_base (279)..(279): a, c, t, g, unknown or other
  misc_feature (279)..(279): n is a, c, g, or t
  modified_base (309)..(309): a, c, t, g, unknown or other
  misc_feature (309)..(309): n is a, c, g, or t
  modified_base (420)..(420): a, c, t, g, unknown or other
  misc_feature (420)..(420): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtcggtccaggcaggcctgactcaccgccccctgatcgtaccgaaggacatgagacgacgaccgccacactcacctgcacgaggacacaacagtgtcgacaacgaaggcgcagtcgttggtcgactagacncgaccaccgaccggaccccaccctcccacnccttccgtcgtacctacgaacgaaactaacccgacccgtccacgacggtactacgtacgaagaggtattactttcgcgtacgtacgtaccggtaggtacgaaacgggaacnccgaccgtacccctaccgacgtaaccttagttaccgtcgtaaccctaccggtacgtacccggtaggaaccgggtaccggtacggtacgtacggttaactttaagtttaccggttttagttaacgacggttaacggtaccggtacccgtaaacccgtccgtaccttacgtaccggtttggttccgggttttacggggtacgggttaccgggacggggtaaccggtaacgtaccgggtacgttcccggttaaccgtaccggttacggtaccgtaaccggaccccggttaacggtcccgttaacccccggg

SEQ ID NO: 257790 - DNA, 756 bp, Homo sapiens
  misc_feature: GYAE6OF01EZKO7.23.26.C04.1.454.CMB.1.raw
  modified_base (213)..(213): a, c, t, g, unknown or other
  misc_feature (213)..(213): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctcgaccctcctcactcactctgcagtgtcagtggtccaggcacggcctgactccgaccgtccccctgatcgacaaggacatagagacacgaccnccacactccactcgacacgacggaaccacaactagtgtacggacaaccgaaggacgcagtacgttggttacgcagcacgccaaccggaccggccccacccctacccacctacctccctacgtaccctaacgaacggtaacctaacccggaacccgtcccgtaacgaggtactccgacgaagtaacgtagtttactttcgacgtactacgtaccgtaacggtaccggaaacggaaaccgtacccgtaccgttaccccgttaccgtaaccgtaacccgttacgttaaccggttaccggaacccctaccgtaccggtacggtaaccgggaaccggtaaccggtacggtaccgttacgttaaccgttttaagttttacggtttagtttaacggacttaaccggttaccgggaaccctaaccgtacccggttactaccgttaccggttcgtttacgggttcgggttacggtaccggggtacggtaccggaccgtacggtccgtaccgtaccgttcgacggtaccgaccgcccgtagcccgtaccccgg

SEQ ID NO: 257791 - DNA, 785 bp, Homo sapiens
  misc_feature: GYAE6OF01AY99Q.23.26.C04.1.454.CMB.1.raw
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgacctcaccgcccccctgatcgtaccaaggacatcgagaccacgaccgccacactccacctcgacacgacgggaaccaccaaactaatggtcgaccaaccgaagacgcagtcgttggtcgacagacgacgacaccgaccgggtaccccaccccgtcccaacctcccttcccgttcgtacccgtaacgtaacggaaacctaaacccgaaccccggtccctacggtacgggtaacctcgtacgtaagaacgtaacgttcttttacggtctactaacgtacccgtaggtaaccgaaccggtaaccgtcgaccgttacccctaccgtaccgtacccgttaaacgtttacccggacgttaacccgtaccgtaaccggtaccggttaacgggacgggaacggtaacggtacccgttaacgttactttaagtttacgttacgtttacggacgttaacggtaccggtaacacccggttaaccgtccgttacgtacgttaccggttgggtttacccgggttacgggtccggggtaaccgggtaccgggtaaccgacccggtacggtacccggtacccggtaccggttacgtaccgtaccgacccggtaacggtcccgttaacccccggg

SEQ ID NO: 257792 - DNA, 756 bp, Homo sapiens
  misc_feature: GYAE6OF01CCIUB.23.26.C04.1.454.CMB.1.raw
  modified_base (230)..(230): a, c, t, g, unknown or other
  misc_feature (230)..(230): n is a, c, g, or t
  modified_base (235)..(235): a, c, t, g, unknown or other
  misc_feature (235)..(235): n is a, c, g, or t
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (260)..(260): a, c, t, g, unknown or other
  misc_feature (260)..(260): n is a, c, g, or t
tcagacgcgagtatcacgaccggtgctcgatttagtctagcgactttgggtttggggtccaaacagagcttcagcaagcatagtgggaatccgcaccatgcccggggctctgctcctcctgaccctcctcactcactctgcagtgtcagtggtccaggcaggctgactcacgcccccctgatgtaccaaggacatgagacagaccgccacactcacctgcacgagggacnccaanatgtgacaacagancagtnttggtncagcagcaccgacggcccaccccgtccaactcctacctcgtacctaacgaggtaaactaaaccaaccccgggtcctaccgaagggtaactcgtaccgaagtacggaacgtttacttttcgtacgactaacgtcccgtaagggtaccgaaagggtaaaccgcgaacggtcccctacccgtacgacctaacgttacgtacggtactcccgtaacgccggtagaacgggtaaccgacggtacgtaagtacgtttaactttagttttacggttaactcgtaaacggttacggtaacccctaaccggtaaccgtacccgttaaccgttaccgttacgggttacgttttagggggttcgggttaacccggggacggggtaaccgggtaaacccggaagttacccgggttaaccggtaacccccgggttcgtttaaaccggggttcccgggaaaccgtaaccccggtaaaccgggtcccccgttaaccgggtccccccccggg

SEQ ID NO: 257793 - DNA, 785 bp, Homo sapiens
  misc_feature: GYAE6OF01B0HIL.23.26.C04.1.454.CMB.1.raw
tcagacgcgagtatcacgaccggtgctcgatttagtctagcgactttgggtttgggggtccaaaacagagcttcagcaagcatagtgggaatctgcaccatgcccggggctctgctcctcctgaccctcctcactcactctgcagtgtcagtggtccaggcaggcctgactcaccgccccctgatcgtaccaaggacatgagacacgaccgaccacactcacctgacacagacgaaccacaaactagtgtacgaaccaaacgaaggacgtctaggttcgttggtacgacgacgacgaaccgacccgaacccggaccggaccccctaccccgtacccaccttacccgttcccgtaaccgtaaccgtaaaacggaaaccgtaaaccgtaaaccccggaaccccggtacccgtaacgggaacgtacctacgtaacgtaacggtaacttacggtttactttccgaacgttaccgtaacggtaacccgggtaacgggtaaacccggaacccggtaaccctcccgttaaccctccgttaacccgtaaccgttaacttaccgtaccgaccgtacccttacgggcggtaacgggtaacggacgggttaaccgacgtttactttagtttaacgtttagtttaccgggttacgtaccgaacggttaccggaaccgtacctaaccgttacgttaccgtacggttaggtccgggtttacgggtcggtaccgggacggtacgtaccgacggtcgtacggtaccgtcgtacgaccgaccgtaccgtcccgtcgtccccg

SEQ ID NO: 257794 - DNA, 888 bp, Homo sapiens
  misc_feature: GYAE6OF01EM3I9.23.26.C04.1.454.CMB.1.raw
tcagacgcgagtatcacgaccggtgctcgatttagtctagcgactttgggtttggggtccaaacagagcttcagcaagcatagtgggaatctgcaccatgcccggggctctgactcctcctgaccctcctcactcactctgcagtgtcaggtcgtccaggcaggcctgactcacgccccctgatgtaccaaggacagtgacgacagaccgccacaccgtccacctgaccgaacgacggggtaaccaccaaaacgtagttacggttacggaaccaaaaccgaaagggaacgtccgtaaggtaccgtttgggtacacgaacgacctaaggacccaacccggaccggggaccccctaaccccgttaccccgaacgtacccgtttcccgttaccgtaaccccgttaacgaacggtaaaacttaaacccggaaccccggtccttaacgacgggtacttacgtaccgaagtacggtacgtttattttccgagtaccgtactacccggttaacggtacggaaacggtaaacccgtccgtaaccgttccccgttaccggtaacgttaaccctaagttaaccgttacggaaccccgttaccgaccggtaccgttacggaagggaacccggttacgggttaccgtaacgggtttaaccttaacgttttaaggtttacgtttaacgtaacgtaaccgggtttaacggaacccgtaaccgttaccgttacccgtaccgttaacgttcggttaccggggtttacggggttaccggttttaccggggggaaccgggttaaaccggggtaacccgaacgggttcccggttaccggtaacccgggttcccgaaacgggtttccgaaacccgggtacccgtaaacgggttccctaacccccgggg

SEQ ID NO: 257795 - DNA, 741 bp, Homo sapiens
  misc_feature: GYAE6OF01A7JHO.23.26.C04.1.454.CMB.1.raw
  modified_base (215)..(215): a, c, t, g, unknown or other
  misc_feature (215)..(215): n is a, c, g, or t
  modified_base (240)..(240): a, c, t, g, unknown or other
  misc_feature (240)..(240): n is a, c, g, or t
  modified_base (496)..(496): a, c, t, g, unknown or other
  misc_feature (496)..(496): n is a, c, g, or t
  modified_base (599)..(599): a, c, t, g, unknown or other
  misc_feature (599)..(599): n is a, c, g, or t
  modified_base (636)..(636): a, c, t, g, unknown or other
  misc_feature (636)..(636): n is a, c, g, or t
tcagacgcgagtatcacgaccggtgctcgatttagtctagcgactttgggtttgggtccgaaacagagcttcagcaagcatagtgggaatctgcaccatgcccggggctctgctccgtcctgaccctcctcactcactctgcagtgtcagtggtccaggcaggcctgactcacgccccctgatgtccaaggacatgagaccacgacccgccaacncctcacctagccacgacgggaaccnccaataagttggtacgaccaaacccgaaggcgcgacgtcgtttgggttacgccgaagccgacgtccgaccccgaaccgggtcccccgaccctacccacgacctttcccgtcgtaccctaaacgaacggtaaaaccctacccgaaccccggtcccgtacgtaacggggtctacctacggtaacgaacgggttactttaacgttttccacggacctaacgtaacccgggtacgggttaaccgaaaggggtaaaccccncggtaaccccgttcccttacccgtacgtaaccctcgttaccgtccgttaccggaccccgtaccgacccggtaccgtacgggaaccgtacgggcgttaacggtnttacgtttactagttctccgaagtcctagtactagtnacgtagttgttaaggtcgttacggtaggggtccgttaccgggggtacggtaccggtaagccggtaacgttccgacggttacgaccgcccgtaggtccctcccggg

SEQ ID NO: 257796 - DNA, 772 bp, Homo sapiens
  misc_feature: GYAE6OF01BNRRH.23.26.C04.1.454.CMB.1.raw
tcagacgcgagtatcacgaccggtgctcgatttagtctagcgactttggggtttggggtccaaacagagcttcagcaagcatagtgggaatctgcaccatgcccggggctctgctcctcctgaccctcctcactcactctgcagtgtcagtcggtccgaggcacggcctgactacaccgtcccccctcgattcgtaccgaaggacagtggacgaccgacgaccgccaccactcacctgccaacgacgggaaccaccaaagtagtgtacggaccaacgaaggacgacgagtcgttggtcgacacgacgacgaccgaccggaccggccccaccctacccacctacctccgtccgtaccgtaacgaacgaaccgtaacccgacccgtccgacgacggtctacgacgagtagtacgttacgtttcgacgtactacgtaccggtacgacgaacggaaccgcgtaccgtacccgtaccgtacgtaacccgttacgttaccgtaccgtaccgtaccgtacggtaccggtacggaacgggtacggtacggtccgtttaacgttacgttttaagtttacggtttaggttacgtaccggttaacgggtaccggtacccgtacccgtaccgttaccgttaccgttacggttccgggttcgggtttacgggttaccgggtaccggggacgggtacccggtaaccggtacggtcccggttacccggtacccgttaaccggtaccggtaccgacccggtcccggtaccggtccccggtacccccgg

SEQ ID NO: 257797 - DNA, 721 bp, Homo sapiens
  misc_feature: GYAE6OF01DIAOL.23.26.C04.1.454.CMB.1.raw
  modified_base (581)..(581): a, c, t, g, unknown or other
  misc_feature (581)..(581): n is a, c, g, or t
tcagacgcgagtatcacgaccggtgctcgatttagtctagcgactttgggtttggggtccgaaacagagcttcagcaagcatagtgggaatctcgcaccatgcccggggctctgcctcctcctgtaccctcctcactcactctgcagtgtacagtggtccaggcacggcctgacctaccaccgcccccctgacttcgtaccaacggacctagtagacgaccaccgacccgccacctaccgtccaccgtcgacgaacgacgggtaaccgaccaaacgaacgttggttacgacaacccggaaggacgtccgaagtccggttaggttacgaccgacgaccgaccggaccaccccggacggcccctacccctccgaacctccgttcccgtacgtaccctaacggaacggtaactaacccggacccggtccacggaacggtactcgtacgagtacgtagttactttcgacgtcgaacgtccgaaggtccgaacgaaccgtcgacccgtaccctacgtaaccgtacctacgttacctacggacctaccgcgtaccgaggacgtacggtcgagtacgttattacgttnttacgtatacgtgtacgtaccgacgtcgtactccgcgttacggtcgttgggttccgtaacgggaccggtacgggaccctaagggtcgttaccggacccttacggtacgacgaccgtccggtaccggtcccctaccccggg

SEQ ID NO: 257798 - DNA, 908 bp, Homo sapiens
  misc_feature: GYAE6OF01EZTXU.23.26.C04.1.454.CMB.1.raw
tcagacgcgagtatcacgaccggtgctcgatttagtctagcgactttgggtttggggtccaaacagagcttcagcaagcatagtgggaatctgcaccatgcccggggctctgctcctcctcgaccctcctcactcactctgcagtgtctaggtcggtccgaggcgacggcctgactccaccgtcccccctgacttcgtaccgaaggacagtcgaacgaccgacgacccgaccacgtacctaccacctcgaacgaaccgaacgggaaccaaccgtaaacgtaacgttcggttacggaaccaaaccggaacggacgacggtacggttcggtttcggtacgaccgacgtacgaccggacccgaaacccggacccgggtacccccaaccccctaccctaacccgtccccgttacccgttaccgtacccggtaaaccgaaaccggtaaaaccgtaaccccgggtaaccccggtaacccgtaccgggaacggttaccctacggtaaccgtaacggtaaacgtttacgtttacgtttaccgtacggtaccctaccggtaccggttaaccgggtaaccggaaccggtaaacctccggtacccttccccgtaaccgtaacctacccgttaacgttacccggtacgtacccgttacccgacggtaccggttaaggaccggtacggtacgtacgtagttaacgtttacgtttaagttaccggttagtaacgttaccgggtaaccgtaaccgtacccgtacgttaccgttacgtacgggtttccgggttaacggttcggggtttaacccgggaacggggtttaccgggaacccgggttagtaccccgggttcgtaacccgggttccgtaacgggtacccgggtacgaaccccggttacggtcccggcccgttacccccgg

SEQ ID NO: 257799 - DNA, 765 bp, Homo sapiens
  misc_feature: GYAE6OF01D4F93.23.26.C04.1.454.CMB.1.raw
tcagacgcgagtatcacgaccggtgctcgatttagtctagcgacttttgggtttggggtccaaaacagagcttcagcaagcatagtgggaatctgcaccatgcccgggctctgctcctcctgaccctcctcactcactctgcagtgtcagtggtccaggcaggcctgactccacgcccccctgatcgaccaaggacagtgacgacacgacccgaccacacctcactcgacaacgacggaaccaccaataagtgtacgaacaaaccgaaggagactaaggttcgttaggttcacgacgcgacgaccgaccgacgggaccccctacccgtcccaaccgtaccctccgtcgtacctacgaacggtaaactaaacccgaacccggccctacggaaggactacgtacgaggtaagtacgtttacgtttacagtacctacgtacgtaggtaaccggaacggaaaccgcgtaaccgcccttacccgtacgtaaacccttatttaccggtaccggtaccctaaccggtacgtaccggtacggaacgggtacccgtagggtaccttagttactttaacgtttagtttacggttacgtacgtacggtaaccggtacctaccgttaccgtactaccgttacggttacggttcgggttaggggttcccgggtacgggtaccgggaacgggtaacccgaagggttccccgtacggtaaccccggttaccgtcggtaaccccgaccgggtaacccggttcggtaccccgttaccccggg

SEQ ID NO: 257800 - DNA, 854 bp, Homo sapiens
  misc_feature: GYAE6OF01E0NJ5.23.26.C04.1.454.CMB.1.raw
tcagacgcgagtatcacgaccggtgctcgatttagtctagcgactttgggtttggggtccaaacagagcttcagcaagcatagtgggaatctgcaccatggcccggggctctgctcctcctgaccctcctcactcactctgctagtgtcagtcgtccaggcaggcctagactcacgccccctgactcgtaccgaaggctagtacggaacgaccgaacgacccgaccaactacctccaaccgtcgaccgaaccggaacggggaaccaccaaagtacgttcggtacgaaccaaaccggaaggacggacctaggtccggtttaggtcgcgaacgacgacgacccgaaccggaccggtcccctaaccccgtaccccgtaactacccgttccggttactacccgaaaccggtaaggtaaaccttaaccccgggaacccgtccgtaaacggttcgggaacttccgtaacgaagtacggtactttacgtttcagtacgtacgttaccggacgtaacggaaaccgacgtcccgaactccccggttacaccgtaaacgtacgttaccggtacgtaacccgtaccgagtacccgggttaacggacgggtaacgtacgttacgttaacggttaaccttttaattttacggtttcgggttaacgagtttaaccgggtaaccgaacccggtctaacccggttccccttagtaccggtttacggtaccggggttttcggggttaccggacccggggtaaccgggtaaaccggtacccttaaccggggtcccgtttaccggaaccccgggtttaagtacccgggtaacccgaaccgttacccgggtaccggttccccgtaacccccggg

SEQ ID NO: 257801 - DNA, 958 bp, Homo sapiens
  misc_feature: GYAE6OF01CL1MH.23.26.C04.1.454.CMB.1.raw
  modified_base (258)..(258): a, c, t, g, unknown or other
  misc_feature (258)..(258): n is a, c, g, or t
tcagacgcgagtatcacgaccggtgctcgatttagtctagcgactttgggtttggggtccaaacagagcttcagcaagcataggtgggaatctgcaccatgcccgggctctgctcctcctcgaccctcctcactcactctgcgagtgtcgaggtcggtccgacggacgacggccgtcgacctccgacccgtccccccgtacgtacgtcggtaccgaaggacagtaggaacgacgaccgacccgaccacacctctaccncgaccgaaccggaacggaaccgacctaaaacgtacgtacggttaacggaaccaaaccggaagggacgacgtacggtcggtttacgggtaccgacgacggacgaccggaccaaccggaacccgggaccccctaccccctaccctaccgtaccgttcccctaccggttaccgtaacgaaaccgttaaaccaacccggaaccccgtaccgtacggaacggtacttcgaaacggacgtacggttaacgtttacgttccgtaacgtaccgtacgtaccggtaaacggtaacgtaaacgggtaaccctacggtaaccggttacccctaaccgggtactaaccccgttaacggtaaccggttaccgtacccgtacccggtaaccgggttaaccgaacggggtaaccggaacggtacccggttaacgtttaacgtaaccgtttttagtttacggttaaaccgggtttcgaccggtttaaacggcggaaaccccttacgacccgggtttaacccctaaggttccggttacggggttaccgggttttacggggggtacccgggtttccgggggaaaccggggtcggggttaaaccccggtacggtttaacccgggttacccccgggtttaaccgggtttaccggaacccgggttaacccgaaaaccgggttccccgggtttacccgggccccccgtttaaccccccgggg

SEQ ID NO: 257802 - DNA, 882 bp, Homo sapiens
  misc_feature: GYAE6OF01DFLLY.23.26.C04.1.454.CMB.1.raw
  modified_base (139)..(139): a, c, t, g, unknown or other
  misc_feature (139)..(139): n is a, c, g, or t
  modified_base (145)..(145): a, c, t, g, unknown or other
  misc_feature (145)..(145): n is a, c, g, or t
tcagacgcgagtatcacgaccggtgctcgatttagtctagcgactttgggtttgggtccaaacagagcttcagcaagcatagtgggaatctgcacatgcccgggctctgcctcctcctcgaccctcctcactcactctnctagtntacgagtcggtccaggcacggccttgacctccgaccgtcccccgtagagttacgtaccgaacggtactagtacggaacgaaccgaccgtaacccgaccaacctaccgtaccgtacccgtacgaccgaaccggaaccggggtaaccctaaccgtaaacgtaacggtttcggttaccggaaaccaaaaccgggaaggtaccggtaccgtaggtttaccggtttagggtacgaccgaacggtaccgaaccgaaccccgaccggaacccggtccccctaacccccgtactaacccgtaccttacctaccgtacccgttaaggacggtaaaccaacccggtaccggtacccgtagtaacccggtctaccgtacggtaagtaacgtttaacgtttaccttttacgacgtacgttaccgtaccggtaacggttaccgaacgggtaaaccctccgtaaccgttcccgtaccgttaacgtaccgttaacgtacgtacgtacccgtcgtaaccggtacggtacggacgaccggtcgttaacgtacgttaacgtttagtttacgttacgtaacggtactaccggtaccggaacctacgtaccgtccgtacgttcggtaccggttagggtttccgggtaccggtacgggaccgggtaaccgtaacggtcccggttacggaacccgggtttacccgttaccgggtacgtacccggaccgggttaacgcccgggttacccctacccccggg

SEQ ID NO: 257803 - DNA, 942 bp, Homo sapiens
  misc_feature: GYAE6OF01ELJ5T.23.26.C04.1.454.CMB.1.raw
  modified_base (109)..(109): a, c, t, g, unknown or other
  misc_feature (109)..(109): n is a, c, g, or t
tcagacgcgagtatcacgaccggtgctcgatttagtctagcgactttgggtttggggtccaaacagagcttcagcaagcatagtgggaatcgtgcaccatgcccggggntctgctcctcctgaccctcctcactcactctgctagtcgtcgacggtcggtccacggtccgacggtcctagacctaccacgtccccccgtagacttcggtacccgaagggacagtacgacgacgacgacccgacacctaccgtacacctcgacgacgaacgggaaccgactaactaagtggttcggacctaaacgaagggacgacgtacggtccgtttagggtcgacgaacgaccgacgaccgtaacccggaccgggaaccccctaccccgtacccaccgtaccgttcccgttaccgtacccgtaacggaaacggtaaaccgtaacccgtaaccccggtcccgtaaccgtagggtaacctaccgaaccgtaaggtaaccggttacgttacgttttacgtaccgtaacgttaccgtaccgtaacgggtaaccggaaaccggtaaaccggtaaccgtaccccggttaccccttccggttaaacccggttaaccttaacgggtttaaccccgtacgggttaaccccctaccggtaaccggtacccggttaacggggaaccggggtaaccgtacgggtttaacctaaccggttttaaaccgttttagttttaacggtttttacggtaacgtaaacgggttcggtaaacccgggtacttacccggtaaccggttaacccgtttacttaaccgggtttcgggttaccgggtttaccggggtttaccggttaccggggaaccgggttaaacgtcccggtaaacggttcccgggttacccgtaacggttcccgttacggaacccctacgggtacccggtaacggttcccgtaccccccggg

SEQ ID NO: 257804 - DNA, 882 bp, Homo sapiens
  misc_feature: GYAE6OF01EZU64.23.26.C04.1.454.CMB.1.raw
  modified_base (226)..(226): a, c, t, g, unknown or other
  misc_feature (226)..(226): n is a, c, g, or t
tcagacgcgagtatcacgaccggtgctcgatttagtctagcgactttgggtttggggtccaaaacagagcttcagcaagcatagtgggaatctgcaccatggcccggggctctgccttcctcctcgaccctcctcactcactctgctgtgtcgagtcggtccgaggcaggcctgacctcaccgccccctgatcgtaccgaaggacagtagacgacgaacggacccnccaactactccgacctgaccgaacggaacggggaaccactaaacgtaacgttggttacgaaccgaaacgaacgggacgtacgtacgttacgtttgggtcacgtacggctacgacccgtaacccggaccggaccccccacccgttacccctaacgtacccgttcccgttaccggttaccaacggaacgggtaaaacctaacccggaccccggttaccgacggacggttacaccgtaggaaagtaacgttacgttttaactttacgcgtacttacgtacccggtagtaaaccgaacggtaaccggcccttaaccgtccctaaccgttaaccgtaccttagttaccggtacccgacttacccggagttacccgggaggtaaccgggcggtaacggttctttaacccgggtaattttaacggtttttagggttttaacgtacgtaaccgggttaaggtaaccggacccttaaccggtccgttaccgtccgtttaccgggtggttttaaacccgggggtttcgggggtaaccggttccgggggaaacccggggtaggttaacccggtaccgggtacccggtttaacccggggtacccttaccgggttaaccgggcccgggtaaacccgaacccggtcccggggttccccgttaccccccgg

SEQ ID NO: 257805 - DNA, 701 bp, Homo sapiens
  misc_feature: GYAE6OF01A9ZGA.23.26.C04.1.454.CMB.1.raw
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgccccctcgatcgtaccaaggacatgagacacgaccgccacactccacctgaccacgacgggaaccgaccaacaagtggttacggaccaaaccgaaggacgcacggtcgttaggtcgacagcacgaccgacccgacgggcccctaccccgtacccacctaccttccgtcgtaccctaacgaacggtaaactaacccgaacccggtcctacggaacggtactccgacgagacgtacgttactttcacggtctaccgtacgtacggtaacgaacggaaaccgtcctaaccgtcccgtacccgtacgaacctacgttaccgtacggtaccctccgaccgtacggacggtacgggaacggtacggtactacttacgttatttacggtttcgttaagctacggtacggaccctaccgtacgtacccgtacgtagttccggttcgttaggggttccggtacgggtacgggacggtacccgaggtccgtaccggtacccgttcggtacgaccggacgaccgccggtcctccccggg

SEQ ID NO: 257806 - DNA, 695 bp, Homo sapiens
  misc_feature: GYAE6OF01ER2FA.23.26.C04.1.454.CMB.1.raw
  modified_base (255)..(255): a, c, t, g, unknown or other
  misc_feature (255)..(255): n is a, c, g, or t
  modified_base (278)..(278): a, c, t, g, unknown or other
  misc_feature (278)..(278): n is a, c, g, or t
  modified_base (292)..(292): a, c, t, g, unknown or other
  misc_feature (292)..(292): n is a, c, g, or t
  modified_base (389)..(389): a, c, t, g, unknown or other
  misc_feature (389)..(389): n is a, c, g, or t
  modified_base (421)..(421): a, c, t, g, unknown or other
  misc_feature (421)..(421): n is a, c, g, or t
  modified_base (538)..(538): a, c, t, g, unknown or other
  misc_feature (538)..(538): n is a, c, g, or t
tcagacgcgagtatcacgaccggtgctcgatttagtctagcgactttgggtttgggtccgaaacagagcttcagcaacgcaagtacgtgggaatcctcgcaccatgcccggggctctgctcctcctcgaccctcctcacctcactctcgcatagtcagtggtccaggcacggtcctgacctccacgccccccttagatcgtaccgaaaggacactacggacgacagacccgccacactcactgaccacgaggacncagaactgacgcaaccgagacgnacgtcgttggtacncagcagctacgacggccacctcactcacgtcgacctacgagaactaaccgaccgtccctgaaggtccacgtacgaagaggtaacgttcgttttcganaccgtacttccgagggtaccaagggaaacccncacggtccccttaccgactacccgtaagttaccgtacgggtacctaaccgtcgtaaccgttacggaacgggtaacgttcgggtactacggttaaccttatttaagttacgggtaaancgtacgttaaaccggccgttacgaacccggtccaaccgttcgtacgggttacggttagggtacccgtaggggtaaccgaccgggttacgaacggttccgtaccgtaccgggtacctaacgggtaccacccggaccgtttaaccgggcttcccccggg

SEQ ID NO: 257807 - DNA, 751 bp, Homo sapiens
  misc_feature: GYAE6OF01C6H9B.23.26.C04.1.454.CMB.1.raw
  modified_base (108)..(108): a, c, t, g, unknown or other
  misc_feature (108)..(108): n is a, c, g, or t
  modified_base (239)..(239): a, c, t, g, unknown or other
  misc_feature (239)..(239): n is a, c, g, or t
tcagacgcgagtatcacgaccggtgctcgatttagtctagcgactttgggtttgggtccaaacagagcttcagcaagcatagtggaatctgcaccatgccccccgggntctgctcctctcgaccctctcactcactctgcagtgtcgagtggtccaggcacggtcctagacctccaccgcccccctagactacgtaccaaaggtacagtgaacgacacgacccgacctacactccacgnaccgaacacgggaacaccaacagttcgtacgacaacggaggacgacagtccggttgtcgagacgcgacgcctaacggacccgccccaacccctcccaacctaccttcccgtacgtacctaaccgaacggaaactaaaccccggcccgtaccgaggtaaccggactttcggaacaacgggttaactgttaccgtttcacgtactaccgtacggtaacggtacgaacgacgtaccgccgtccctacgtcctaacttacgtaccgtacgtacccgtacgacgacggtacgaacggtacgggaccgtacgtacgtaactttaacgtttagtttacgtacgttacgtaacgtacggtaaccgtaacgtacccgttacacgtccgttaacggttcggttacgggtacgggtaccgggtaacgggaacccggtagtaccgggttcccgtaaccgggtacccgttaccgggtaacggttaccccgaccggtaacccggtaccggtaaccccgtccccggg

SEQ ID NO: 257808 - DNA, 587 bp, Homo sapiens
  misc_feature: GYAE6OF02F9Z1X.23.26.C04.1.454.CMB.1.raw
  modified_base (355)..(355): a, c, t, g, unknown or other
  misc_feature (355)..(355): n is a, c, g, or t
  modified_base (376)..(376): a, c, t, g, unknown or other
  misc_feature (376)..(376): n is a, c, g, or t
  modified_base (450)..(450): a, c, t, g, unknown or other
  misc_feature (450)..(450): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctcgatgtccaaggacatgagacagaccgccacactcacctgcacagggaacgccaacaatgttggcaaccaaggagcagcttggttgcagcagcaccgagggcccaccctcccacacctcctgtcctacaggaactaaccaacccggccctacagggactctcagagatattttcngcatccaggtacaaggaaacncacgcctccctagacccattactcggtacctccgagcctaggacggacgaggctgaacttattattgtttacgntagtcgggaccaccgacgtcctcgacttggtaccgtttggggtcgttccggggacgggtaacgggtacccaaggtccgttacggaccccggttccgtaacgggttccaacggtaccccgtaagggcccgttacccgg

SEQ ID NO: 257809 - DNA, 508 bp, Homo sapiens
  misc_feature: GYAE6OF02GI6IQ.23.26.C04.1.454.CMB.1.raw
  modified_base (230)..(230): a, c, t, g, unknown or other
  misc_feature (230)..(230): n is a, c, g, or t
  modified_base (299)..(299): a, c, t, g, unknown or other
  misc_feature (299)..(299): n is a, c, g, or t
  modified_base (351)..(351): a, c, t, g, unknown or other
  misc_feature (351)..(351): n is a, c, g, or t
  modified_base (371)..(371): a, c, t, g, unknown or other
  misc_feature (371)..(371): n is a, c, g, or t
  modified_base (426)..(426): a, c, t, g, unknown or other
  misc_feature (426)..(426): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctcgatgtccaaggacatgagacagaccgccacactcacctgcacagggaacnccaacaatgttggcaaccaaggagcagcttggttgcagcagcaccagggcccaccctcccacacctccngtcctacaggaataacaacccggccctcagggatcctcagagagtattttcngcatccaggtcaaggaaacncagccctcctgaccattactggacctccagcctgacggacgaggctgacctattnttgttagcagtgggacacgagcctcactgcgttgggtgttcggcggaggaccagctgccgtcaggtcacgcctaggctcccg

SEQ ID NO: 257810 - DNA, 758 bp, Homo sapiens
  misc_feature: GYAE6OF02G01E0.23.26.C04.1.454.CMB.1.raw
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctcgatgtccaaggacatgagacagaccgccacactcacctgcacagggaacgccaacaatgttggcaaccaaggagcagcttggttgcagcagcaccagggcccaccctccacacctcctgtcctacaggaaactaaccaacccggccctacgaagggactccgtacaaggaagacgtatttttcgtggacctaacttccgaagggttacaaagggaaaaccgcctaacggtcccctacccctacgaaccctaacgttttacccgtacgggaaccttcccgaacggtcccgtagggaacgggaccggtaacgggtcctaggtaaccttaagttttaacgtttacggttttaacgaccgtaacggttacggggaaccctaacccggtaacggtaccccttacgtaaaccgttcggtccggttttacgggggtttcggttttacccggggggaaccggggtaaccgggggtaaccctaaacggggtacccgttaaccgggtaacccccgggtttacccggttaacggggtttacccgaaccgggtaccccccggtaaacgggggtccccttaccccccgggg

SEQ ID NO: 257811 - DNA, 605 bp, Homo sapiens
  misc_feature: GYAE6OF02I9F3T.23.26.C04.1.454.CMB.1.raw
  modified_base (212)..(212): a, c, t, g, unknown or other
  misc_feature (212)..(212): n is a, c, g, or t
  modified_base (227)..(227): a, c, t, g, unknown or other
  misc_feature (227)..(227): n is a, c, g, or t
  modified_base (250)..(250): a, c, t, g, unknown or other
  misc_feature (250)..(250): n is a, c, g, or t
  modified_base (263)..(263): a, c, t, g, unknown or other
  misc_feature (263)..(263): n is a, c, g, or t
  modified_base (271)..(271): a, c, t, g, unknown or other
  misc_feature (271)..(271): n is a, c, g, or t
  modified_base (283)..(283): a, c, t, g, unknown or other
  misc_feature (283)..(283): n is a, c, g, or t
  modified_base (371)..(371): a, c, t, g, unknown or other
  misc_feature (371)..(371): n is a, c, g, or t
  modified_base (404)..(404): a, c, t, g, unknown or other
  misc_feature (404)..(404): n is a, c, g, or t
tcagacgcgagtatcacgaccggtgctcgatttagtctagcgactttgggtttggggtccaaacagagcttcagcaagcatagtggaatctgcaccatgcccggggctctgctcctcctgaccctcctcactcactctgcagtgtcagtggtccaggcaggcctgactcagccccctcgatgtccaaggacatgagacagaccgccacactnacctgcacagggacnccaacaatgtagcaaccaaggancagcttgtcacancagcacgnggccacctccanactctgtcctaacaggaataaccgaaccgccctagaggattccacagagagtattttcgcgactacttacgaaggtcaaacggaaccncgaacgtccctacctacgaacctaatttaccgnggtaccctcgaacgtcctaggaacggacgacggtctacgaacttattagtttgttacgctagtcgggtaaccaaccgacgtcctacgaactcgtcgtttacgggtcgttacgggtaccgggaacgcccgtaaaggtccgttacgggaaccccgttacggttacggtaccgaccggaacccgtaagggtccttacccccggg

SEQ ID NO: 257812 - DNA, 550 bp, Homo sapiens
  misc_feature: GYAE6OF02I435H.23.26.C04.1.454.CMB.1.raw
  modified_base (231)..(231): a, c, t, g, unknown or other
  misc_feature (231)..(231): n is a, c, g, or t
  modified_base (357)..(357): a, c, t, g, unknown or other
  misc_feature (357)..(357): n is a, c, g, or t
  modified_base (468)..(468): a, c, t, g, unknown or other
  misc_feature (468)..(468): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctcgatgtccaaggacatgagacagaccgccacactcacctgcacagggaacnccaacaatgttggacaaccaaggagcagcttggttgcagcagcaccagggcccaccctcccacacctcctgtcctacaggaactaaccaacccggccctacgagggactctcagagagtattttcngcatccgaggtcaaggaaacgcacgcctccctagacctattactggacctcgacgcctagacggacgaggctcgactatttattgttagctagtcgggacaccagtccctnactgcgttgggtgttcgggacggcggtaccaaggtctacggtaccgtaccgtaggtaccacggacccgaggtccgtacccgg

SEQ ID NO: 257813 - DNA, 524 bp, Homo sapiens
  misc_feature: GYAE6OF02FWOHX.23.26.C04.1.454.CMB.1.raw
  modified_base (344)..(344): a, c, t, g, unknown or other
  misc_feature (344)..(344): n is a, c, g, or t
  modified_base (362)..(362): a, c, t, g, unknown or other
  misc_feature (362)..(362): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagccccctcgatgtccaaggacatgagacagaccgccacactcacctgcacagggaacgccaacaatgttggcaaccaaggagcagcttggttgcagcagcaccagggccacctcccacactcctgtcctacaggaataacaaccggccctcagggatctcagagagattttcngcatccagtcaggaaacncagcctcctgaccatactggactcagcctgaggacgaggctagactattattgtttagcagttgggacaccagtcctcactgccgttgggtgttcggcggtagggaccaacggtctcggtaaccgtccgttagggtccacggcccgtaacggcctaccccgg

SEQ ID NO: 257814 - DNA, 551 bp, Homo sapiens
  misc_feature: GYAE6OF02HYOO7.23.26.C04.1.454.CMB.1.raw
  modified_base (354)..(354): a, c, t, g, unknown or other
  misc_feature (354)..(354): n is a, c, g, or t
  modified_base (394)..(394): a, c, t, g, unknown or other
  misc_feature (394)..(394): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctgatgtccaaggacatgagacagaccgccacactcacctgcacagggaacgccaacaatgttggcaaccaaggagcagcttggtgcagcagcaccagggcccaccctcccacacctcctgtcctacaggaactaaaccaaccggccctacgagggactctacagagagtattttcngcatccaggtcaaggaacgcacgcctcctgacctattacnggactccagcctgaggacgaggctagaccttattattgttagctagtcgggacaccgagtcctcactgtcgttggggtcgttcgggcgggtaacgggacccaaggtccgtacggacccgttcgtacgggtccaacggacccgacggtccctacccgg

SEQ ID NO: 257815 - DNA, 527 bp, Homo sapiens
  misc_feature: GYAE6OF02IUQSC.23.26.C04.1.454.CMB.1.raw
  modified_base (230)..(230): a, c, t, g, unknown or other
  misc_feature (230)..(230): n is a, c, g, or t
  modified_base (351)..(351): a, c, t, g, unknown or other
  misc_feature (351)..(351): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctcgatgtccaaggacatgagacagaccgccacactcacctgcacagggaacnccaacaatgttggcaaccaaggagcagcttggttgcagcagcaccagggcccaccctcccacactcctgtcctacaggaactaaccaacccggccctcagggatctcagagagtattttcngcatccaggtcaaggaaacgcacgcctccctgaccattactggactccagcctgacggacgaggctgacttattattgttagctagtcgggacaccgagccctcactgcgttgggtcgttcggcggacggaccagctacggaccgtcgtacggtccacggacccgaggcctcccgg

SEQ ID NO: 257816 - DNA, 527 bp, Homo sapiens
  misc_feature: GYAE6OF02HHHWV.23.26.C04.1.454.CMB.1.raw
  modified_base (264)..(264): a, c, t, g, unknown or other
  misc_feature (264)..(264): n is a, c, g, or t
  modified_base (348)..(348): a, c, t, g, unknown or other
  misc_feature (348)..(348): n is a, c, g, or t
  modified_base (366)..(366): a, c, t, g, unknown or other
  misc_feature (366)..(366): n is a, c, g, or t
  modified_base (387)..(387): a, c, t, g, unknown or other
  misc_feature (387)..(387): n is a, c, g, or t
  modified_base (443)..(443): a, c, t, g, unknown or other
  misc_feature (443)..(443): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctgatgtccaaggacatgagacagaccgccacactcacctgcacagggaacgccaacaatgttggcaaccaaggagcagcttggttncagcagcacagggccaccctcccacactccctgtccctacaggaaataacaaccggcccctcagggatctcagagagattttcngcatccgagtcaggaacncagccctcctgacctattacngactcagcctgaggacgagctgactattattgttagctagtgggacaccgagcctnacgtgcgttgggtgttcgggcgggtaacgggaccaggccgtaggacccgttccgtaggtcccacggacccgtaggccgtcccgg

SEQ ID NO: 257817 - DNA, 521 bp, Homo sapiens
  misc_feature: GYAE6OF02GPIED.23.26.C04.1.454.CMB.1.raw
  modified_base (228)..(228): a, c, t, g, unknown or other
  misc_feature (228)..(228): n is a, c, g, or t
  modified_base (247)..(247): a, c, t, g, unknown or other
  misc_feature (247)..(247): n is a, c, g, or t
  modified_base (343)..(343): a, c, t, g, unknown or other
  misc_feature (343)..(343): n is a, c, g, or t
  modified_base (372)..(372): a, c, t, g, unknown or other
  misc_feature (372)..(372): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgattcagcccccctgatgtccaaggacatgagacagaccgccacactcacctgcacaggaacnccaacatgtgcaacaggancagcttggtgcagcagcaccagggcccaccctcccacactcctgtcctacaggaataaccaaccggccctcgagggatcctcagagagtattttcngcatccaggtcaggaacgcacgcctcccngaccattactggacctccagcctgacggacgaggctgacttattattgttagctagtcgggacaccgagtcctcactgtcgttgggtcgttcgggcggacgggaccaggcgtcgacccgtccgtaggtccacggcccgaggcctcccgg

SEQ ID NO: 257818 - DNA, 616 bp, Homo sapiens
  misc_feature: GYAE6OF02FZZ44.23.26.C04.1.454.CMB.1.raw
  modified_base (252)..(252): a, c, t, g, unknown or other
  misc_feature (252)..(252): n is a, c, g, or t
  modified_base (280)..(280): a, c, t, g, unknown or other
  misc_feature (280)..(280): n is a, c, g, or t
  modified_base (326)..(326): a, c, t, g, unknown or other
  misc_feature (326)..(326): n is a, c, g, or t
  modified_base (334)..(334): a, c, t, g, unknown or other
  misc_feature (334)..(334): n is a, c, g, or t
  modified_base (360)..(360): a, c, t, g, unknown or other
  misc_feature (360)..(360): n is a, c, g, or t
  modified_base (389)..(389): a, c, t, g, unknown or other
  misc_feature (389)..(389): n is a, c, g, or t
tcagacgcgagtatcacgaccggtgctcgattttagtctagcgacttttggggttttgggggtcccaaacagagctttcagcaagcatagtggggaatctgcacccatgccccgggggctctgctccctcctgacccctccctcactcactctgcagtgtcagtgggtcccagggcagggcctgactcagcccccccctgatgtcccaaggacatgagacagacccgccacactcacctgcacaggggaacncccaaacaaatgttggcaaaccaaggancagcttggttgcagcagcacagggcccacccctccccacacctccngtccctanaggaaataaaccaacccggccccctnacgggactcctcaagacgagattttttcngtcatccaggtcaaggaaacgtcagcctccctgacctatactggactccacgtctgaggtacgagctgactagttactttgtttagctagttacgggacctaccgagtccctctacgtcgtacgttggggttcgttccgggtacgggtacgggtacctaaggtccgttacggtacccggttaccgtacggttcccgacggtaccccggtaacggtcgttaccccggg

SEQ ID NO: 257819 - DNA, 510 bp, Homo sapiens
  misc_feature: GYAE6OF02G10RH.23.26.C04.1.454.CMB.1.raw
  modified_base (347)..(347): a, c, t, g, unknown or other
  misc_feature (347)..(347): n is a, c, g, or t
  modified_base (364)..(364): a, c, t, g, unknown or other
  misc_feature (364)..(364): n is a, c, g, or t
  modified_base (383)..(383): a, c, t, g, unknown or other
  misc_feature (383)..(383): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctcgatgtccaaggacatgagacagaccgccacactcacctgcacagggaacgccaacaatgttggcaaccaaggagcagcttggtgcagcagcaccagggccaccctcccacactcctgtcctacaggaataaccaaccggccctacgagggatctcagagagatttcngcatccagtcaggaacncagcctcctgaccattacnggactccagcctgacggacgaggctgactattattgttagcagtgggacacgagcctcactgcttgggtgttcggacggaggaccaaggtcctaggaccgtcgtaggtccacggcccaggctcccgg

SEQ ID NO: 257820 - DNA, 637 bp, Homo sapiens
  misc_feature: GYAE6OF02GW61I.23.26.C04.1.454.CMB.1.raw
  modified_base (353)..(353): a, c, t, g, unknown or other
  misc_feature (353)..(353): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctcgatgtccaaggacatgagacagaccgccacactcacctgcacaggaacgccaacaatgttggacaaccaaggagcagcttggtgcagcagcaccagggcccaccctcccacactcctgtcctacaggaactaaccaaccgggccctcgagggactcctcagagagtattttcngactatccaggtacaaggaacgcaacgcctccgtacgacctattacctggacctccaacgcctagacggacgacgctgtactatttattgttacgctaagtcgggaaccaccgagtccctacgtacgtcgttaccggtttggggttcggttaccggggtaccggggtaacggggtaaccccgtaacgggtacccggttaaccgggtaaccccggtttacccggttaaccggggttaccccggtaaccggacccccggtaacggggtccccgttaccccccgggg

SEQ ID NO: 257821 - DNA, 588 bp, Homo sapiens
  misc_feature: GYAE6OF02HLY3Q.23.26.C04.1.454.CMB.1.raw
  modified_base (230)..(230): a, c, t, g, unknown or other
  misc_feature (230)..(230): n is a, c, g, or t
  modified_base (353)..(353): a, c, t, g, unknown or other
  misc_feature (353)..(353): n is a, c, g, or t
  modified_base (377)..(377): a, c, t, g, unknown or other
  misc_feature (377)..(377): n is a, c, g, or t
  modified_base (474)..(474): a, c, t, g, unknown or other
  misc_feature (474)..(474): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctcgatgtccaaggacatgagacagaccgccacactcacctgcacagggaacnccaacaatgttggcaaccaaggagcagcttggttgcagcagcaccagggccaccctcccacactcctgtcctacaggaactaaccgaacccggccctacagggatctacagagagtattttcngcattccaggttcaagggaaaccncacgtcctccctacgaccctaattaccgtgggaaccttccacgtccctggacggacgaggctacgacttattattggtttagactagttgggaaccnccgaagccctacgacgtgtcgtttggggtcgttccggggtacggaacggggaccaacggtccgttacggacccgttaccgtacgggtccacggtacccgaacgggcctccccgg

SEQ ID NO: 257822 - DNA, 514 bp, Homo sapiens
  misc_feature: GYAE6OF02HF6XV.23.26.C04.1.454.CMB.1.raw
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctcgatgtccaaggacatgagacagaccgccacactcacctgcacagggaacgccaacaatgttggcaaccaaggagcagcttggttgcagcagcaccagggccaccctcccacactcctgtcctacaggaataacaaccggccctcagggatctcagagagattttctgcatccaggtcaggaaacgcagcctcctgacctattaactggactccagcctgaggacgaggctgacttattattgtttagcagtggacaccgagcctcactgtcgttgggtcgttcggcgggagggaccaagctgaccgtccgtaggtccagcccgaaggctcccgg

SEQ ID NO: 257823 - DNA, 540 bp, Homo sapiens
  misc_feature: GYAE6OF02HYI8Z.23.26.C04.1.454.CMB.1.raw
  modified_base (227)..(227): a, c, t, g, unknown or other
  misc_feature (227)..(227): n is a, c, g, or t
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
  modified_base (253)..(253): a, c, t, g, unknown or other
  misc_feature (253)..(253): n is a, c, g, or t
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
  modified_base (427)..(427): a, c, t, g, unknown or other
  misc_feature (427)..(427): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctgatgtccaaggacatgagacagaccgccacactcacctgcacaggacncaanatgtgcaacagncagcttggtncagcagcaccaggcccaccctcccacactcctgtcctacgaggaactaaccgaacccggccctacgagggactctacagagagtatttcngcatccgagtcaggaacncacgccctcctcgacctattactcggactccgacgcctgaggacgagctagacttattattgttanctagtcggacacgacgcctcgactcgtcgttcgggttgttccgggacgggaagggtaccaaggtccgtacgtaccggtccgtacggtccaaccggacccgaggtccctcccgg

SEQ ID NO: 257824 - DNA, 514 bp, Homo sapiens
  misc_feature: GYAE6OF02H6CFJ.23.26.C04.1.454.CMB.1.raw
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
  modified_base (254)..(254): a, c, t, g, unknown or other
  misc_feature (254)..(254): n is a, c, g, or t
  modified_base (343)..(343): a, c, t, g, unknown or other
  misc_feature (343)..(343): n is a, c, g, or t
  modified_base (406)..(406): a, c, t, g, unknown or other
  misc_feature (406)..(406): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctgatgtccaaggacatgagacagaccgccacactcacctgcacaggaacncaacatgtgcacagncagcttggtncagcagcaccagggcccacctccacacctcctgtcctacacggaactaaccgaacccggcctacgagggactctcagagtagtatttcngcactccgaggtcaggaaacgcacgcctcctcgacctattactgactccagcctgacggacgngctgacttattatgttagctagtcggacacgagcctcacgtgtcgttgggtgttcggcgggacggaccagtcgtcgaccgtcgtacggtccacggccacggctcccgg

SEQ ID NO: 257825 - DNA, 850 bp, Homo sapiens
  misc_feature: GYAE6OF02IFIOO.23.26.C04.1.454.CMB.1.raw
  modified_base (232)..(232): a, c, t, g, unknown or other
  misc_feature (232)..(232): n is a, c, g, or t
tcagacgcgagtatcacgaccggtgctcgatttagtctagcgactttgggtttggggtccgaaacgagagcttcagcaagcatagtgggaatctgcaccatgcccggggctctgctcctcctgaccctctcactcactctgcagtgtcagtggtccaggcaggcctgactcacgcccccctgatgtccaaggacatgagacagaccgccacactcacctgcacgagggaacnccaactaatgttaggacaaccgaaggagtcaagcgttggtcgcagcagcaccagggcccaacccctcccgaacacctcccgtgtacccctaacgaacgggtaaacttaaaccgaaccccgggtaccccttacgaacggggtaacttcccgtaacgaaacggtaagggtaaccgttaacgttttttccgaaggtacccaaacgttaccccgtaaaggggtttacccgaaaacgggggttaaaaccccgccgtaaacggtccccccgttaacccgttaccggaaacccgttaaacgttttaaacccggtaccggggtaaccttaaccccgtaacgggtaccccgttacgggaaaccggggtaaccggaacgggttaccgttacggaaaccgtttaaattttaagggtttaccggtttttaacgggaccttaacggggtttaccggggaaacccttaacccggaacggtttaccccgtacgtaaaccgttcggttaccggttttacggggtccgggtttaacgggtccggggaacgggtaaccctaaggtccgttaccggaacccgggttaccgtacgggtacccgtaaccggacccgtaacgggtaccctacccccgggg

SEQ ID NO: 257826 - DNA, 627 bp, Homo sapiens
  misc_feature: GYAE6OF02HT41Z.23.26.C04.1.454.CMB.1.raw
  modified_base (252)..(252): a, c, t, g, unknown or other
  misc_feature (252)..(252): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctcgatgtccaaggacatgagacagaccgccacactcacctgcacaggaacgccaacaatgttggcaaccaaggngcagcgttggtgcagcagcaccagggcccaccctcccacactcctgtccctacaggaactaaccgaacccggccctacgagggactcctacgagaagagtattttcgtagactaatcccaaggtacaagggaaaccgcgacgccctaccctagaaccctagtttaccgtacggacctccgaacgcctaggacggtaccggagggtctaggtaaccttagtttatttaggtttaagacgtaagttacgggaacctaccgtacgcccttacgacgtcgtcgttggggttcgttacggggtcggaacgggaacctaacggccgttacggtacccggtccgtacgggtaccgacggtaccccgacggtccgtaccccgg

SEQ ID NO: 257827 - DNA, 523 bp, Homo sapiens
  misc_feature: GYAE6OF02JCA91.23.26.C04.1.454.CMB.1.raw
  modified_base (354)..(354): a, c, t, g, unknown or other
  misc_feature (354)..(354): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctgatgtccaaggacatgagacagaccgccacactcacctgcacagggaacgccaacaatgttggcaaccaaggagcagcttggttgcagcagcaccagggccaccctcccacacctcctgtcctacgaggaactaaccgaacccggccctacgagggactctcagagagtatttcngcatccaggtcaggaaacgcacgccctcctgaccattactgactccacgcctgaggacgaggctagactattattgttagctagtcgggaccaccgacgcctcacgtgtcgttgggtgttcggcgggaggaccaagcgtcgaccgtcgtaggcacgcccgaggctcccg

SEQ ID NO: 257828 - DNA, 548 bp, Homo sapiens
  misc_feature: GYAE6OF02JCZBR.23.26.C04.1.454.CMB.1.raw
  modified_base (356)..(356): a, c, t, g, unknown or other
  misc_feature (356)..(356): n is a, c, g, or t
  modified_base (391)..(391): a, c, t, g, unknown or other
  misc_feature (391)..(391): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctcgatgtccaaggacatgagacagaccgccacactcacctgcacagggaacgccaacaatgtggcaaccaaggagcagcttggtgcagcagcaccgagggcccaccctccacacctcctgtcctacaggaaactaaccgaaccggccctacacgggactcctcaggagagtattttcngactatccaggtccaggaaaccgcaacgcctcccncgaccattactcggtactccagcctgacggacgaggctgactattatgtttagctagtcgggacaccagcctacactgtcgttgggttcgttcgggacggtacgggaaccagcgtacgaccgttcgtacgggtccacggcccgtaaggcctacccgg

SEQ ID NO: 257829 - DNA, 566 bp, Homo sapiens
  misc_feature: GYAE6OF02GDDXZ.23.26.C04.1.454.CMB.1.raw
  modified_base (353)..(353): a, c, t, g, unknown or other
  misc_feature (353)..(353): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccatcgatgtccaaggacatgagacagaccgccacactcacctgcacagggaacgccaacaatgtggcaaccaaggagcagcttggtgcagcagcaccagggccaccctcccacacctcctgtcctacaggaactaaccgaaccggccctacgagggactctacagagagtattttcngcatccgaggtacaaggaacgcacgcctcctgacctattactgacctccacgccgtgacggacgacggctagtacttatttagtttagtttagcgtagtcgggaaccaccgtacgtccctcaacgtgtcgttcggggtcggttccgggcgggtacggtaccgaaggtccgtacggtaccgtccggtacggtaccgacggtacccgaggtcccg

SEQ ID NO: 257830 - DNA, 723 bp, Homo sapiens
  misc_feature: GYAE6OF02JUXS3.23.26.C04.1.454.CMB.1.raw
tcagacgcgagtatcacgaccggtgctcgatttagtctagcgactttgggtttggggtccaacagagcttcagcaagcatagtgggaagtctgcaccatgcccggggcgtctgctcctcctgaccctcctcactcactctgcagtgtcagtggtccaggcaggcctgactcagcccccctcgatgtccaaggacatgagacagaccgccacactcacctgcacagggaacgccaacaatgttaggcaaccaaggagcagcttaggttgcagcacgcaccgacgggcccaccctcccacgtactcctcgtcctacgacggaactaaccaaccggccctcgaacggggtaactcctccgaaggacgtacggtacttttactcggcctacgttaccgaggttaccgaacgggtaaaccgcgtaacgtccctacccgtacgaccgtactttaccgtcggaaccttcccaggtccctagaacggtaccggacggtccgtacgtaacgttatttacgttcgttttaagacctaggtacggggaaccaccgtacgtacccgtcaaccggttcgaccggttttacgggttcggttacccgggtaccgggggtaacggggttaacccgtaaacggttcccggtaacggttaaccccccgggtttaacccggtacggggtttaaccccggaaccggtaaccccccgggtaagggtcccgttaaccccccgggg

SEQ ID NO: 257831 - DNA, 529 bp, Homo sapiens
  misc_feature: GYAE6OF02GMH9F.23.26.C04.1.454.CMB.1.raw
  modified_base (374)..(374): a, c, t, g, unknown or other
  misc_feature (374)..(374): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctcgatgtccaaggacatgagacagaccgccacactcacctgcacagggaacgccaacaatgttggcaaccaaggagcagcttggttgcagcagcaccgagggcccaccctcccacactcctgtcctacaggaataaaccgaacccggccctcgagggatcctacagagagtattttctgcatccaggtcaggaacncagccctcctgacctattactggacctccagtcctggaggacgaggctagacttattattgtttagctagtgggacaccgagcctcactgcgttgggtcgtcggcgggaggaccagtcgtacgaccgtcgtacggtcacggccgaggcctcccgg

SEQ ID NO: 257832 - DNA, 677 bp, Homo sapiens
  misc_feature: GYAE6OF02I79KI.23.26.C04.1.454.CMB.1.raw
  modified_base (233)..(233): a, c, t, g, unknown or other
  misc_feature (233)..(233): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctgatgtccaaaggacatgacgacagaccgccacacctcaccctgcacagggaacnccaacaatgttagcaacaaggagcagcttggtgcagcagcaccgaggccaccctccacactccctagtccacgacgaaactaaccgaaccggccctagagggtactctacgacgtagagtacttttcaggtcaacttccgaggtacaacggaaacgtcaagccctaccctacgtaaccctaagttaccgaggtacctccgtaacgccgtacgaaggaccgtaggcctaggtaaccttaagtttactttaggtttaacgactacgtacggggtaccaaccgtacgtaccgtacgtacgtttcggtaccgtttagggggttacgtttaccgggggaccgggggtaacctaaacggggtttaccggaacccgggtttacggtacggggttaaccaaccggggtaccccgaaacgggttcccgtacccggtcccccggtttaacccgg

SEQ ID NO: 257833 - DNA, 520 bp, Homo sapiens
  misc_feature: GYAE6OF02JKAXV.23.26.C04.1.454.CMB.1.raw
  modified_base (227)..(227): a, c, t, g, unknown or other
  misc_feature (227)..(227): n is a, c, g, or t
  modified_base (326)..(326): a, c, t, g, unknown or other
  misc_feature (326)..(326): n is a, c, g, or t
  modified_base (351)..(351): a, c, t, g, unknown or other
  misc_feature (351)..(351): n is a, c, g, or t
  modified_base (371)..(371): a, c, t, g, unknown or other
  misc_feature (371)..(371): n is a, c, g, or t
  modified_base (383)..(383): a, c, t, g, unknown or other
  misc_feature (383)..(383): n is a, c, g, or t
  modified_base (432)..(433): a, c, t, g, unknown or other
  misc_feature (432)..(433): n is a, c, g, or t
  modified_base (440)..(440): a, c, t, g, unknown or other
  misc_feature (440)..(440): n is a, c, g, or t
tcagacgcgagtatcacgaccggtgctcgatttagtctagcgactttgggtttggggtccgaaacagagcttcagcaagcatagtgggaatctgcaccatgcccggggctctgctcctcctgaccctcctcactcactctgcagtgtcagtggtccaggcaggcctgactcagcccccctgatgtccaaggcatgagacagaccgcacactcacctgcacagggacnccaacaatgtggcaaccaaggagcagcttggtgcagcagcaccagggtcccaccctcccacactcccgtgtccctacaggaataaaccacccggccctnaagggactctacagagagattttcngcatccaggtcagggaaccncagccctccgtnacccattaccgtgactccagtcctggagcgagctgactattatgtttannatggacncgagcctcactgcgttgggtcgttcggcggtacggacaggcctggacccgtcgtaggtccagcccggaggtcctacccgg

SEQ ID NO: 257834 - DNA, 756 bp, Homo sapiens
  misc_feature: GYAE6OF02H96QQ.23.26.C04.1.454.CMB.1.raw
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctgatgtccaaggcatgagacagaccgccacactcacctgcacaggaacgcaacatgtgcacaaggagcagcttggtgcagcagcaccgaggcccaccctcccacactcctcgtcctacgaaggaactaaccgaacccgggtccctacgtacggggtttactaggtccgtcctttctcgtggtccttaccgttaagtcctgggacctaaaccgtaccggtccccttcccgtacggaaccctaacttccgttacccgttccgggtacccctacccgtaaccggtcccgtacggtaacccggtacgggtaacgggtaccgttacggttaacttttaacgtttaacgttttacggtaccgttacggttacctttaccgtaacttacgtacgtaccgtaacggttaagttaacggttaaggttacgttttagggtaccggggtttaccgggggtaccgggggggtaaccggtaacggggttaccgggtacccgggttaccgggttaacgggttacccgtaaccgggtaccccggtaaccgggttcccggtacccgggttacccccccgtgggtttaacccccg

SEQ ID NO: 257835 - DNA, 602 bp, Homo sapiens
  misc_feature: GYAE6OF02HJEHG.23.26.C04.1.454.CMB.1.raw
  modified_base (227)..(227): a, c, t, g, unknown or other
  misc_feature (227)..(227): n is a, c, g, or t
  modified_base (356)..(356): a, c, t, g, unknown or other
  misc_feature (356)..(356): n is a, c, g, or t
  modified_base (376)..(376): a, c, t, g, unknown or other
  misc_feature (376)..(376): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctgatgtccaaggacatgagacagaccgcacactcacctgcacaggacnccaacatgtggacaaccaaggagcagcttggttgcagcagcaccgagggcccaccctcccacactcctcgtcctacaggaactaaccgaaccggccctacgagggactctacgaagtagagtattttcngcagtccaggtcaggaaacncacgtcctccctacgacctaacttacgtacggacctcacgtccgtaggacggacggacggtctacgtaacttatttacgtttagttacgacgtagtcgggaaccaccgacgtcctcgtacgtgtccggttgggtcgtttcgggaccggggtaacgggaccgtaacggtcgtaccggtacccggttaccgtacgggtacctaccggaccgtacggtcctaccccggg

SEQ ID NO: 257836 - DNA, 727 bp, Homo sapiens
  misc_feature: GYAE6OF02F23DS.23.26.C04.1.454.CMB.1.raw
  modified_base (228)..(228): a, c, t, g, unknown or other
  misc_feature (228)..(228): n is a, c, g, or t
  modified_base (247)..(247): a, c, t, g, unknown or other
  misc_feature (247)..(247): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctgatgtccaaggacatgagacagaccgccacactcacctgcacgaggacncaacaatgtgcaacaggancagtcttggtgcagcagccaccgacgggcccaccccgtcccacctacctcctcgtaccctaacgaggaaactaaacccaacccggccctacgaagggtactccgtacgaacggtacgtacgttacttttcgacgtactactaccggtaaggtaccgaaacgggaacctacgaaccggtcccttacccgtacgtaaccctaacgttccgtaccggtaccgttaccgacggtaccgtacgggaacgggtaccggtacggtaccgttacggtaacctttagtttaacgtttacggtttaacgacgttacggtacgggtaaccctaaccgtaccgtacccgttcgtaaccggttcgttacgggttccggggttcgggttacccggggaacggggtaacgggtaacccgtacgggtccgtacccggtacccggttccggaccgggttaccgacccggtacccggtaccggtcccttacccccggg

SEQ ID NO: 257837 - DNA, 710 bp, Homo sapiens
  misc_feature: GYAE6OF02FU3UU.23.26.C04.1.454.CMB.1.raw
  modified_base (231)..(231): a, c, t, g, unknown or other
  misc_feature (231)..(231): n is a, c, g, or t
  modified_base (363)..(363): a, c, t, g, unknown or other
  misc_feature (363)..(363): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctcgatcgtccaaggacatgagacagaccgccacactcacctgcacagggacnccaacaatgttgcaaccaaggagcagcttggttgcagcagcaccgagggcccaccctcccacacctcctcgtccctaacgaggaactaaaccgaacccggtccctcgaggactctacaagagagtactttcncgactactccgaggtacaacgggaaaccgccaacgtccctcccgtagaaccctaacgttaccgtacggacctaccgacgtacccgtaggaacgggtacggaacgggtaccgtacggtaacttaacgttttaagttttaggtttacgacgtaaggttacgggtaacctaaccgtaccggtaccctaccgtaaccgttcggttaccggttttacgggggttccgggttccggggtaccggggtaacggggtaacccggtaaacgggtcccggttaacgggtaccccggttacccggttaacgggttacccggaaccggtaccccggtaaacggtcccgttacccccggg

SEQ ID NO: 257838 - DNA, 539 bp, Homo sapiens
  misc_feature: GYAE6OF02FXB4W.23.26.C04.1.454.CMB.1.raw
  modified_base (253)..(253): a, c, t, g, unknown or other
  misc_feature (253)..(253): n is a, c, g, or t
  modified_base (356)..(356): a, c, t, g, unknown or other
  misc_feature (356)..(356): n is a, c, g, or t
  modified_base (447)..(447): a, c, t, g, unknown or other
  misc_feature (447)..(447): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctcgatgtccaaggacatgagacagaccgccacactcacctgcacagggacgccaacaatgttggcaaccaaggancagcttggttgcagcagcaccagggccaccctcccacacctcctgtcctacaggaataaccaacccggccctacgacgggactcctacagagagtattttcgngctagtccaggtcaaggaaaccgcaacgccctccctgacctattactgacctccacgtcctagacggacgagctagactattattggttanctagtacggacaccgacgtcctacacgtgtcgttgggtcgtcggcggaggaccagcgtagaccgtcgtacggtcgacgccgaggcctcccgg

SEQ ID NO: 257839 - DNA, 783 bp, Homo sapiens
  misc_feature: GYAE6OF02HZ7RZ.23.26.C04.1.454.CMB.1.raw
  modified_base (228)..(228): a, c, t, g, unknown or other
  misc_feature (228)..(228): n is a, c, g, or t
  modified_base (247)..(247): a, c, t, g, unknown or other
  misc_feature (247)..(247): n is a, c, g, or t
  modified_base (364)..(364): a, c, t, g, unknown or other
  misc_feature (364)..(364): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctgatgtccaaggacatgagacagaccgccacactcacctgcacagggacncaacatgtgcaaccaaggncagcttggtgcagcagcaccagggcccaccctccacactccgtgtacctacgaggaaactaaccgaacccgggccctacgaacgggtactccgtacaggagtacgtactttttccgnggtacctaacgttcccgaagggttaccgaaacggggtaaaccgtaccgaccgtcccgttaccccgttacggaacccgttaaacgttttaaccgtacggtaacccgttccgaaaccggtcccgtacggtaaacgggaaccggaacgggtaccgttaacggtaaaccgtttaagtttaacgttttacgggttttaacgtaccgttaacggttacggggtaaaccctaacccgtaacggtacccttaaccgtacggttacggttacggttttacgggggtttacggttacccggggtaccgggggtaaaccgggtaacccgtaaacgggtcccgttaaccgggtaaccccggtttacccggttaacggggttacccgtaacccggggtaacccccgtaacgggtaccccgttacccccgggg

SEQ ID NO: 257840 - DNA, 699 bp, Homo sapiens
  misc_feature: GYAE6OF02GD37L.23.26.C04.1.454.CMB.1.raw
  modified_base (229)..(229): a, c, t, g, unknown or other
  misc_feature (229)..(229): n is a, c, g, or t
  modified_base (234)..(234): a, c, t, g, unknown or other
  misc_feature (234)..(234): n is a, c, g, or t
  modified_base (248)..(248): a, c, t, g, unknown or other
  misc_feature (248)..(248): n is a, c, g, or t
  modified_base (257)..(257): a, c, t, g, unknown or other
  misc_feature (257)..(257): n is a, c, g, or t
tcagacgcgagtatcacgaccggtgctcgatttagtctagcgactttgggtttggggtccaaacagagcttcagcaagcatagtgggaatctgcaccatgcccgggctctgctcctcctgaccctcctcactcactctgcagtgtcagtggtccaggcaggcctgactcacgccccctgatcgtccaaggacatgagacagaccgccacactcacctgcacgagggacnccaanatgtgcaacaggancagctggtncagcagcacaggccacccgtccacacctcctggtacctaacgacggaaactaaccgaacccggtccctacggaacgggtactccgtacgaaggaacgtaacgttactttttaccgacggacctacgtaccccgtaaggtacaaaccgggtaaaccgccaacgtccccgttacccgtacgtaaccctaagtttaccgacggtaacctaccgtacgggtaccttacgggaaacgggtaccgaacgggtaccgtttaacggaacccgttttaagtttaacgttttacgggtttaacgacgtaacggttacggggtaaccctaaccgtaccgtacctaccgtacgttcggtacgttcgggttacgttcgggacgggttaaacggccgtaaacggtccgtacgtaccggtccgtacggttaccgacgccgtaacggccttacccggg

SEQ ID NO: 257841 - DNA, 654 bp, Homo sapiens
  misc_feature: GYAE6OF02F4MY4.23.26.C04.1.454.CMB.1.raw
  modified_base (234)..(234): a, c, t, g, unknown or other
  misc_feature (234)..(234): n is a, c, g, or t
tcagacgcgagtatcacgaccggtgctcgatttagtctagcgactttgggtttggggtcctaaacagagcttcagcaagcatagtgggaatctgcaccatgcccggggctctgctcctcctgaccctcctcactcactctgcagtgtcagtggtccaggcaggcctgactcacgcccccctgatgtccaaggccatgagacagacccgcctacactcacctgcacgagggaacnccaaactaagtgttcggaccaaaccgaaaggagcaagcttggttcgcagctagcaaccgtacggcccaacccgtccacacctccctgtacctaacgaggaaactaaaccgaccccggcctaccgaagggtctccgtacgaagacgaagttacttttacgcgactaactcccgaaggtccaaaggaaaccgtccaaggtccctcccgtagaacctacgttactcggtacctccgacgcctaggaccggaacgaggtcctaagtacgttaattacgtttcgttaagactaggtacggaacctaccgtacgtcctacgtactacggtcgtttcgggtacgttcggaccgggtaacggaaccgtacggtccgtaggtacccgttacgtacggtacgaccggacccgtaacggcccttaccccgg

SEQ ID NO: 257842 - DNA, 691 bp, Homo sapiens
  misc_feature: GYAE6OF02FVIFR.23.26.C04.1.454.CMB.1.raw
  modified_base (213)..(213): a, c, t, g, unknown or other
  misc_feature (213)..(213): n is a, c, g, or t
  modified_base (230)..(230): a, c, t, g, unknown or other
  misc_feature (230)..(230): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctgatgtaccaaggacatgagacagaccgcacacncacctgcacagggaacnccaacaatgttggacaaccgaaggacgcagtcgttggttgacagcagccaccgacggacccaccctacccgactacctcctcgtacctacgaacggaactaaaccgacccgcctacgaacggactccgtacgaggagtacgtattttcgacggtctacgtacctaagggtacgaacgggtaaaccgccgtaaccgtcccttaccccgtaacgtaccctagtttaaccgtacggacccgttaccgacgtcccgtaggaccggaacggacggtacgtacgtaaaccgtttattacgtttacggttacgtacgtacgtacgggaacctaccgaaccggttccttaaccaccgttaggtaccgttggggttccggttacgggaccgggtaaccggtaaccggtacgtaccggtaccggtcccgttacggtacggtacccgaccggaccgtacggtccgtccccgg

SEQ ID NO: 257843 - DNA, 669 bp, Homo sapiens
  misc_feature: GYAE6OF02IRN6C.23.26.C04.1.454.CMB.1.raw
  modified_base (377)..(377): a, c, t, g, unknown or other
  misc_feature (377)..(377): n is a, c, g, or t
tcagacgcgagtatcacgaccggtgctcgatttagtctagcgactttgggtttgggggtccaaacagagcttcagcaagcatagtgggaatctgcaccatgcccggggctctgctcctcctgaccctcctcactcactctgcagtgtcagtggtccagggcaggcctgactcacgcccccctcgatgtccaaggacatgagacagaccgccacactcacctgcacagggaacaccaacaatgttacggacaaaccgaaggagacagcgttggtgacagcagcaccgacgggcccaccctcccacactcctcgtcctacgaaggaactaaaccgaacccggcctacgagggactacctcgaggaagacgtacttttcncgtactactaccgaaggtacaagggaaacgcgacgtcccgtacccgtacgaaccctaacgttacgtacggtacctaccgacgtaccgtaggaacgggtacggagggtccgtagtaactttaactttagtttacgtttaagtacgtagtaccgggaactaccgacgtacccttacgacgttacggtcgtttcggggttacggttccggggtacgggtacgggtaccgtaagggtccgttacggtacccgttccgtaggtaccgtacggtaaccggccccggtaaggtccccgg

SEQ ID NO: 257844 - DNA, 512 bp, Homo sapiens
  misc_feature: GYAE6OF02FSCRQ.23.26.C04.1.454.CMB.1.raw
  modified_base (231)..(231): a, c, t, g, unknown or other
  misc_feature (231)..(231): n is a, c, g, or t
  modified_base (252)..(252): a, c, t, g, unknown or other
  misc_feature (252)..(252): n is a, c, g, or t
  modified_base (262)..(262): a, c, t, g, unknown or other
  misc_feature (262)..(262): n is a, c, g, or t
  modified_base (351)..(351): a, c, t, g, unknown or other
  misc_feature (351)..(351): n is a, c, g, or t
  modified_base (369)..(369): a, c, t, g, unknown or other
  misc_feature (369)..(369): n is a, c, g, or t
  modified_base (404)..(404): a, c, t, g, unknown or other
  misc_feature (404)..(404): n is a, c, g, or t
  modified_base (415)..(415): a, c, t, g, unknown or other
  misc_feature (415)..(415): n is a, c, g, or t
  modified_base (421)..(422): a, c, t, g, unknown or other
  misc_feature (421)..(422): n is a, c, g, or t
  modified_base (434)..(434): a, c, t, g, unknown or other
  misc_feature (434)..(434): n is a, c, g, or t
  modified_base (440)..(440): a, c, t, g, unknown or other
  misc_feature (440)..(440): n is a, c, g, or t
tcagacgcgagtatcacgaccggtgctcgatttagtctagcgactttgggtttgggggtccaaaacagagcttcagcaagcatagtgggaatctgcaccatgcccggggctctgctcctcctgaccctcctcactcactctgcagtgtcagtggtccaggcaggcctgactcagcccccctgatgtccaaggacatgagacagaccgccacactcacctgcacagggaacncaacaatgtggacaacaaggncagcttggtncagcagcaaccagggcccaccctcccacactcctgtcctacaagaactaaccaaccggcctcgaaggatacctcaagacgagtatttcngcatcgagtcaggaaacncacgctccagaccatactgactcagcctgagacgngctgactattnttgtannagtggactaccngtccanctgtgttggtgtcggacggacggaccaggtcctacgtaccgtcgtacggtaccacggacccaggcctcccgg

SEQ ID NO: 257845 - DNA, 511 bp, Homo sapiens
  misc_feature: GYAE6OF02IY36R.23.26.C04.1.454.CMB.1.raw
  modified_base (226)..(226): a, c, t, g, unknown or other
  misc_feature (226)..(226): n is a, c, g, or t
  modified_base (340)..(340): a, c, t, g, unknown or other
  misc_feature (340)..(340): n is a, c, g, or t
  modified_base (358)..(358): a, c, t, g, unknown or other
  misc_feature (358)..(358): n is a, c, g, or t
  modified_base (378)..(378): a, c, t, g, unknown or other
  misc_feature (378)..(378): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagccccctgatgtccaaggacatgagacagaccgccacactcacctgcacaggacnccaacaatgtgcaacagagcagcttggtgcagcagcacaggccaccctccacactcctgtcctacaggaataaccaacccggccctacagggactcgtcagagacgtattttcngcatccaggtcaggaacncagcctcctgaccattacgnggactccgagcctgacggacgaggctgactattattgtttagctagtggacacgagcctcactgcgttgggtcgttcggcggagggaccaggtctaggacccgtcgtacggtccacggcccaggtcctcccgg

SEQ ID NO: 257846 - DNA, 793 bp, Homo sapiens
  misc_feature: GYAE6OF02GIPTK.23.26.C04.1.454.CMB.1.raw
  modified_base (227)..(227): a, c, t, g, unknown or other
  misc_feature (227)..(227): n is a, c, g, or t
  modified_base (231)..(231): a, c, t, g, unknown or other
  misc_feature (231)..(231): n is a, c, g, or t
  modified_base (233)..(233): a, c, t, g, unknown or other
  misc_feature (233)..(233): n is a, c, g, or t
  modified_base (242)..(242): a, c, t, g, unknown or other
  misc_feature (242)..(242): n is a, c, g, or t
  modified_base (250)..(250): a, c, t, g, unknown or other
  misc_feature (250)..(250): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctgatgtccaaggacatgagacagaccgcacactcacctgcacaggacncaanangtgcacagncagctgtncagcagcacaggcccaccctccacacctcctgtacctacgaaggaactaaaccgaacccggccctacgaacgggactaccgtacgaagagtacgtacttttcgagactacgtcccgaaggtccgaaacgggtaaaaccgccgtaacggccccttccccgtaacggtaacccgttaaacgtttaacccgtacggtaacccgttacccgaagggtaccccgttagggaaccgggtaaccggaacgggtaccccgttaggtaaaccctttaagtttacgttttacgggtttacgacgttaaggttaccgggggtaaccctaacccggtaacgttaccccgtaccgtaccggtttacggttccggtttacgggggtttaccgggtttacccggggtaacccggggggtaaccgggggtaaaccccctaaaggggttaccccggttacccggggttaacccccgggttttacccggttaaaccggggttaccccgtaaacccggggtaaccccccggtaaccggggttcccccggttaaccccccggg

SEQ ID NO: 257847 - DNA, 722 bp, Homo sapiens
  misc_feature: GYAE6OF02IE9N5.23.26.C04.1.454.CMB.1.raw
  modified_base (227)..(227): a, c, t, g, unknown or other
  misc_feature (227)..(227): n is a, c, g, or t
  modified_base (360)..(360): a, c, t, g, unknown or other
  misc_feature (360)..(360): n is a, c, g, or t
  modified_base (386)..(386): a, c, t, g, unknown or other
  misc_feature (386)..(386): n is a, c, g, or t
tcagacgcgagtatcacgaccggtgctcgatttagtctagcgactttgggtttgggtccaaacagagcttcagcaagcatagtgggaatctgcaccatgcccggggctctgctcctcctgaccctcctcactcactctgcagtgtcagtggtccaggcaggcctgactcagccccctgatgtccaaggacatgagacagaccgccacactcacctgcacagggaacnccaacaatgttagacaaccaaggagcagcgttaggtgcagcagcaccaggccaccctcccacactccctgtacctacgaaggaactaaccgaacccggtccctacgagggactctacgagagacgtatttcgngactacgtccgagtacgaacggaacncgacgccccttaccgtacgaaccctagttaaccgtacggtaccttaacccgacgggtacccttagggaacgggtaccggaacggttacgtacggttaaacctttaagtttaacgtttacgggttttaagtaccgttaacggtacgggtaacctaacccggtaacgttaccccttacgtaaaccgttcggttaccgggttttaggggttaccggtttaccggggtaccggggtaaacggggtaaccccggtaaaggtcccggttaaccggacccggttttacccggaacgggtacccgtaccgggtaaccccgtacggggtacccgttacccccggg

SEQ ID NO: 257848 - DNA, 691 bp, Homo sapiens
  misc_feature: GYAE6OF02H7H16.23.26.C04.1.454.CMB.1.raw
  modified_base (230)..(230): a, c, t, g, unknown or other
  misc_feature (230)..(230): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctcgatgtccaaggacatgagacagaccgccacactccacctgcacaggacncaacatgtgcaacaggagcagcttggtgcagcagcaccgaggcccaccctcccacacctcctcgtacctacgaagaaactaaccgaacccgtcctacgacggactctacgagaagtagtattttcgtcgactacgtaccgtaggtacgaacgggtaaacgccgaaccgccccttacccgtacgtaaccctaacctttaacgtccggtaaccctccgaaccgtccgtaggacgggaaccggacggtaccgtaacgttacctttaagtttagttttacggtttaagaccgttacggtacgggtacctaaccgaccgtacccttaccgtaacggttcggttacggtttccggggttacggttccggggtacggggtaaccgggtaaccgtaacggtccgttaccggtacccggttaccgttaacggtcccgtaccggacccggtaccgggtccctacccccggg

SEQ ID NO: 257849 - DNA, 611 bp, Homo sapiens
  misc_feature: GYAE6OF02F21GR.23.26.C04.1.454.CMB.1.raw
  modified_base (231)..(231): a, c, t, g, unknown or other
  misc_feature (231)..(231): n is a, c, g, or t
  modified_base (253)..(253): a, c, t, g, unknown or other
  misc_feature (253)..(253): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctgatgtccaaggacagtgagacacgaccgccacactcacctgcacgaggacnccaacatgtgacaaccaaggancagcttggtgcagcagcaccgacggcccaccccgtccacactccctgtacccgtacacgtaaactaacccaacccggccctacgaacgggtactcgtacgagacgtacgtacttttacgcgactacgtaccgtacggtacgaacggaaaccgctaacgccctcctacgactactacgcgactcgacgcctagacggacgagtctagacttagtttacttgttacgctaggtacggacaccgacgtcctacctacgttcgtcgttagggttcggtacgggcggaacgggtaccggaacgtaccgttccggaaccggttccgttacgggaccgaccggtaccccggaggcccgtccccgg

SEQ ID NO: 257850 - DNA, 821 bp, Homo sapiens
  misc_feature: GYAE6OF02ICONO.23.26.C04.1.454.CMB.1.raw
tcagacgcgagtatcacgaccggtgctcgatttagtctagcgactttgggtttgggggtccaaacagagcttcagcaagcatagtgggaatctgcaccatgcccggggctctgctcctcctgaccctcctcactcactctgcagtgtcagtggtccaggcaggcctgactcacgcccccctgatgtaccaggacatgagacagaccgaccacacctcacctgcacgagggaaccgaccaaacaagtgttggacaaccgaaaggagcagcgtttaggtgcagcagccacacgggcccacccctaccacctcctccgtacgtacctacgacggaaactaacccgaaccgcccctacgagggtactccgtacgaagagtagttatttcacggactacgtaccacggttacaaacgggtaaacgcctaccgccccttacccgtaccgtaacccttaacgttaccgtacggaacccttccgaacgtacccgtagggtaaccgggaccggtaagggtccgtttaacggtaacctttaacggtttttaacgttttaacgggttttaacggtccgttaaaacggggttacccgggaaccgtaaaccccgttaaccggtaccccgtttacccttaaccgggttccggttaaccgggttttcgggggttaccggggtttacccggggggtaaccggggggtaaccgggtaaaccccggtttaagggaccccggtttacccgggtaaaccccggtttcccgggtttaacgggtaccccgggttaaacccggtaccccgggtaaccgggtttccccggtaacccccccggggg

SEQ ID NO: 257851 - DNA, 784 bp, Homo sapiens
  misc_feature: GYAE6OF02JHVPH.23.26.C04.1.454.CMB.1.raw
  modified_base (275)..(275): a, c, t, g, unknown or other
  misc_feature (275)..(275): n is a, c, g, or t
  modified_base (292)..(292): a, c, t, g, unknown or other
  misc_feature (292)..(292): n is a, c, g, or t
  modified_base (330)..(330): a, c, t, g, unknown or other
  misc_feature (330)..(330): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcgaccgcccccctgatcgtacccgaaggacatcgaagacacgaccgccaacactcacctgcacgaacgggaccaccaacgaacgtgtacggaccaaccgaaggacncgagtcgttggtcgacnggacacgaccgaccgacggccccaccccgtcccaaccnccttccgtacgtaccctacggaaacggtaacctaaacccgacccggtaccctacgaacgggtactacgacggtaaggacttacgttaactttcgacggtacctaacgttaccggaaggtaacccggaacgggaaaccctcgaaccgtcccctacccgtaacggtaacctaacggtttaacccgtcggtaccctaccggtacggaccgtagggaccgggtaaccaacggttcttaaacggtacctttaagtttacggtttaccgttacggaactttacgggtacccgggtaacctacccggtacttaccctcggttaacgttccgggttgtttaccggggtttcggaacgggtacccggggtaacggtaaccgaccgttaccggttaaccggaccccggtttacggtaaccggttccgaaccccgggaacccgttcggacccccgttaacccggg

SEQ ID NO: 257852 - DNA, 868 bp, Homo sapiens
  misc_feature: GYAE6OF02IKTJC.23.26.C04.1.454.CMB.1.raw
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctgatgtccaaggacatgagacagaccgccacactcacctgacacgacgggaaccgccaaacaagttggttacggaccaaacccgaaagggacgaccgaacggtcgtttacgggttcgaccaaggccaacggacccaacccggaacgggggaccccctaaccccccgttccccaaccgtacccgttcccgttacggttaccccgtaaccgaacgggtaaactaaacccgaacccgggaccccttacgaacggggtactccgtacgacgacggtagttaacttttcgtacgactaacgttacccgtaagggttaccgaaacgggtaacccgacgtaaccggtaccccttaccccgttacgtaaccccgtaacgtttaaccggttaccgggtaacccttacccggtaaccggtccccggttaagggtaacccggggtaaccggtaacgggttacccgttaacggttaaacccgttttaagtttttaacggttttaacggtttttaacggaccgttaaggttaccggggtaaccctaaacccgtacggtaccccgttaccgtaaccgttaccgggtcgggttttacggggttcgggttaccggggtacgggtaaccgggtacccgtaacggtccgtacggtacccggttaccgtacggtaccgaaccggtacccgtacgggtccctaccccgg

SEQ ID NO: 257853 - DNA, 567 bp, Homo sapiens
  misc_feature: GYAE6OF02H93GB.23.26.C04.1.454.CMB.1.raw
  modified_base (227)..(227): a, c, t, g, unknown or other
  misc_feature (227)..(227): n is a, c, g, or t
  modified_base (231)..(231): a, c, t, g, unknown or other
  misc_feature (231)..(231): n is a, c, g, or t
  modified_base (242)..(243): a, c, t, g, unknown or other
  misc_feature (242)..(243): n is a, c, g, or t
  modified_base (250)..(251): a, c, t, g, unknown or other
  misc_feature (250)..(251): n is a, c, g, or t
  modified_base (261)..(261): a, c, t, g, unknown or other
  misc_feature (261)..(261): n is a, c, g, or t
  modified_base (336)..(336): a, c, t, g, unknown or other
  misc_feature (336)..(336): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctgatgtccaaggacatgagacagaccgccacactcacctgcacaggacncaanatgtgcacagnnagctgtnnagcagcacgnggccaccctccacactcctgtcctacgacgaactaaccgacccggcctcgaggactcacagacgagtactttcgngacatcgagtcaggaacgctacgcctccgacgacctattacgcggtacctccacgcctaggacggacgacggtctagtacttaagttattagttacgtacgtagttcgacgtacgtaccgtcctctacgcgttcgttcgggtcggttacggccgggtagggacccgtaagcccggttacgtacccggtacctacgggtaccaccggtacccgtaacggtcccgttacccgg

SEQ ID NO: 257854 - DNA, 746 bp, Homo sapiens
  misc_feature: GYAE6OF02H12MP.23.26.C04.1.454.CMB.1.raw
  modified_base (233)..(233): a, c, t, g, unknown or other
  misc_feature (233)..(233): n is a, c, g, or t
  modified_base (254)..(254): a, c, t, g, unknown or other
  misc_feature (254)..(254): n is a, c, g, or t
  modified_base (264)..(264): a, c, t, g, unknown or other
  misc_feature (264)..(264): n is a, c, g, or t
tcagacgcgagtatcacgaccggtgctcgatttagtctagcgactttgggtttgggggtccaaacagagcttcagcaagcatagtgggaatctgcaccatgcccggggctctgctcctcctgaccctcctcactcactctgcagtgtcagtggtccaggcaggcctgactcacgcccccctgatgtccaaggacatgagacacgaccgccacactcacctgcacacgggaacnccaacatgtgacaacaaggancagcttggtncagcagcaccgaggcccaccctcccacacctcctcgtcctaacgaaggaaactaaccgaacccggccctacgacgggtactcctacgaggagtaacgtacttttcagcctaacgtaccgtaagggtaccaaacggggtaaacccgccgtaaccggtaccccttacccgtacggtaaaccctaacgttttaacccgtacgggtaacccttacccgaacggtacccgttacgggtaaaccggggaccggtaacgggtcccgttaacggttaaaccgtttaacgttttaacggttttacggttttaacgaccgttaacgggttacgggaaccctaaccggtacgtacccttacgacgttcggtaccggtttggggttacggttccggggtacgggtaaccggggaaccgtaagggtccgttacggtacccggttaccggtacggtacccggtaaccggtacccggtacgggtccgtacccccggg

SEQ ID NO: 257855 - DNA, 740 bp, Homo sapiens
  misc_feature: GYAE6OF02JA3NU.23.26.C04.1.454.CMB.1.raw
  modified_base (261)..(261): a, c, t, g, unknown or other
  misc_feature (261)..(261): n is a, c, g, or t
  modified_base (374)..(374): a, c, t, g, unknown or other
  misc_feature (374)..(374): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccagacaggcctgactcacgcccccctgatgtccaaggacatgagacacgaccgccacactcacctgcacgacggaaccgccaacaatgttcggacaaccgaaggacncagtcttggtcgcagcagccaccgaggcccaccctcccacacctcctcgtacctacgaggtaacaaccaacccggcctacggaacgggtactcctacacgagtactagtttcncgactacgtcgaaggtacgaaacgggaaccgccaacgtcccctacccgtacgaaccctagttaccgacggttacctaccgacggtaccgtaggaaccgggtccgtaacggtaccgttagtaccgtttaaattttaccggtttaggttttaaccgcgttaaacggttaccgggtaacccgtaacccgtcgggtaacccttaccgaacggtttacgggttccgggtttttacgggggtacggtttaccggggaccggggtaaaccggggttaacccaacgggttcccggttaaccggttacccgggtaccggtttaaccggtacccggaaccggtaccccgggtaaccgggttcccgttacccccggg

SEQ ID NO: 257856 - DNA, 660 bp, Homo sapiens
  misc_feature: GYAE6OF02FK4HX.23.26.C04.1.454.CMB.1.raw
  modified_base (228)..(228): a, c, t, g, unknown or other
  misc_feature (228)..(228): n is a, c, g, or t
  modified_base (370)..(370): a, c, t, g, unknown or other
  misc_feature (370)..(370): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcagcccccctgatgtccaaggacatgagacagaccgccacactcacctgcacagggacnccaacatgttcggacaaccaaggagcagtacttggttgcagcagccaccacgggcccaccccgtcccactacctccgtcgtccctaacgaggaactaacgaacccggccctacgagggactctcaggacgagtacttttcgngctagtaccaggttaccgaacgggaaaccgtcgaacggtcccttaccccgtacgtaaccctacgttaacgtcggtacctacccgtaacgcctacggacgggtaccggacggtaccgtagtaaccgtttaatttacgtttaggtttacgtactacggttacggaccaaccgtacgtccctacgtaccgttacgttccgttggggttcgtaccgggtacgggaccggtaccgaacgtccgtacgtacccgtacgtaccggtaccgacggtacccgtacggtaccgtccccgg

SEQ ID NO: 257857 - DNA, 789 bp, Homo sapiens
  misc_feature: GYAE6OF02GU7VB.23.26.C04.1.454.CMB.1.raw
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctgatgtccaaggacatgagacagaccgccacactcacctgcacaggaacnccaacatgtgcaacagncagcttggtgcagcagcaccgagggcccaccctcccacacctcctcgtcctaacgacggaaactaaacccgaacccggcccctacgaacgggtactccgtacgaaggtaagtaacgttactttttacgacggtacctaaacgttcccgaaacgggttccgaaaacggggaaaaacccgtccgtaaacccggtccccttaccccgtaacggtaaccccttaacgttttaacccggtacgggtaaccccttacccgaaccgggttaccccgtacgggtaaccggggtaaccgggtaacgggtaccgttaacggtaacgtttaagttttaacgttttacgggttttacggaaccgttaagggttaccgggtaaccctaacccggtacgtaccccgttaccgtaaccgttcggttccggtttagggggttccgggtttaccggggtacggggtaacggggtaacccaacgggtaccggttaaccggttacccggtaccggttaacgggtcccgaacccggtacccgaccgggtccgtaccccccggg

SEQ ID NO: 257858 - DNA, 648 bp, Homo sapiens
  misc_feature: GYAE6OF02FGYI6.23.26.C04.1.454.CMB.1.raw
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtagtcagtggtccaggcaggcctgactcagcccccctgatgtccaaggacatgagacagaccgccacactcacctgcacaggacgccaacaatgttcggacaaccgaaggagcagcgttggttgcagcagcaccagggcccaccctcccactacctcctcgtcctaacacggaactaaaccgaaccggccctacgagggactctacgaagaggacgtagttttcacggactacgtcctaaggtcaacggaaaccgtcacggcccttacccgtcgtaacctacttaacgacggtacctaccgacgtcccgaggacggaaccggtacggtccgtaggtaacgttactttaatttaggttagaccgtaggtacgggtaacctaccgtacgtacccgtactacgtcggttccgttaggggttccgtacggggaccgggtaacgggacctaacggccgttaccggacccgtcgtacggtccgaccggacccggtaaggtcctaccccggg

SEQ ID NO: 257859 - DNA, 659 bp, Homo sapiens
  misc_feature: GYAE6OF02IZCXF.23.26.C04.1.454.CMB.1.raw
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
  modified_base (215)..(215): a, c, t, g, unknown or other
  misc_feature (215)..(215): n is a, c, g, or t
  modified_base (225)..(225): a, c, t, g, unknown or other
  misc_feature (225)..(225): n is a, c, g, or t
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
  modified_base (252)..(252): a, c, t, g, unknown or other
  misc_feature (252)..(252): n is a, c, g, or t
  modified_base (255)..(255): a, c, t, g, unknown or other
  misc_feature (255)..(255): n is a, c, g, or t
tcagacgcgagtatcacgaccggtgctcgatttagtctagcgactttgggtttggggtccaaacagagcttcagcaagcatagtgggaatctgcaccatgcccgggctctgctcctcctgaccctcctcactcactctgcagtgtcagtggtccaaggcaggtcctgactcacgccccctgatgccaaggacatgagacngaccgcanactcacngcacaggacnccaanatgtgcaacaggncagctagtnacngcatcaccgaggcccaccgtccacactcctgtacctaagaagtaaactaaccgaacccggtacctcgaacgggtactccgtacgaaggaagtacgtattttaccgagacctacttaccggaagttacccaaagggtaaaccggctaaccgtcccgtacccgtacgtaaccctaacgttaacgttaccggaaccttaccgaacgtaccgtacggacggaacgtacggacttagaacgtttattacgttagtttacgacgtacgtggaacctaccgtacgaccttcgaactcggttacgttacggggttacgtccgggtaaccggtaacggtacgaacggtcccgtaacggtaccccgttacggtacggttaccacggtaaccccgtaacgggtccctaccccggg

SEQ ID NO: 257860 - DNA, 648 bp, Homo sapiens
  misc_feature: GYAE6OF02HB7P8.23.26.C04.1.454.CMB.1.raw
  modified_base (393)..(393): a, c, t, g, unknown or other
  misc_feature (393)..(393): n is a, c, g, or t
  modified_base (420)..(420): a, c, t, g, unknown or other
  misc_feature (420)..(420): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctcgatgtccaaggcatgagacacgaccgccacactcacctgcacgacgggaacgccaacaactggttacggaccaaaccgtaagggacgacacgtcctttgggttagccagcgagccaccgagggcccaccccgtcccacacctaccctcgtaccctacgacggaaactaaccaacctcgcccacgagggactctacgagagtagtacttttcngtctactccgtaggtaccaagggaacnctacgtcctcccgtacgacctattaccgtacgtacctccgagcctaggacggagtacggctacgtactagttacgttagttacgactagtcgggaacctaccgacgtcccgtactacgttcgtccgggtttcggttacggttccggggaacgggtaccgggtaccgtaacggtccgtacggtacccgttaccggtacgtaccgaaccggtacccgtaacggtccccgg

SEQ ID NO: 257861 - DNA, 708 bp, Homo sapiens
  misc_feature: GYAE6OF02G06V4.23.26.C04.1.454.CMB.1.raw
  modified_base (379)..(379): a, c, t, g, unknown or other
  misc_feature (379)..(379): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctgatgtccaaggacatgagacagaccgccacactcacctgcacgaggacgccaacaatgttggacaaccaaggagcagcttggttgcagcagccaccgagggcccacccctccccacacctcctcgtacctaacgacggaaactaaacccgaacccggtccctacgaagggactcctaccgaagacgagttacttttcgngactacgtcccgaaggtacgaacgggaaaaccgcgaaccggtccctaccccgtacggtaaccctaactttaaccgtacggtaccttaccgacgtacccgttaagggaccgggtaacggacggtacgttacggtaacttaacgtttacgtttaggtttaacgtacgtaaggttacgggaaccctaaccgtaccgtacccttaccgtaacgttcgtccggtttggggttcgggttcgggaccggggtaaccgggaaccggtaacggtccggttacggacccggttaccggttacgggtaccgacggtaccccgaacggtccctaccccggg

SEQ ID NO: 257862 - DNA, 598 bp, Homo sapiens
  misc_feature: GYAE6OF02GG5EJ.23.26.C04.1.454.CMB.1.raw
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctcgatgtccaaggacatgagacagaccgccacactcacctgcacagggacgacaacaatgtcggcaaccaaggagacagcttggttgcagcagcaccgacggcccaccctcccacacctccctcgtcctacacggaactaaccaaccggtccctcgaggactctacagagagtatttcgtgctatccaggtacaacggtaaccgcacgtccctcctacgacctatacgtcggacctaccacgtcgtagacggacggtacgcgtagtacttattagtttacgttagtactacggttcggaccaccgtacgaccttacacgttcgtcgttcgggtggttaccgggacggggtaacggtaccggacgtccgtacgtaccggtaccgttacggaccgaccggcccgtacggtccgtaccccgg

SEQ ID NO: 257863 - DNA, 752 bp, Homo sapiens
  misc_feature: GYAE6OF02GICY2.23.26.C04.1.454.CMB.1.raw
  modified_base (210)..(210): a, c, t, g, unknown or other
  misc_feature (210)..(210): n is a, c, g, or t
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
  modified_base (262)..(262): a, c, t, g, unknown or other
  misc_feature (262)..(262): n is a, c, g, or t
tcagacgcgagtatcacgaccggtgctcgatttagtctagcgacttttgggtttggggtccaaacagagcttcagcaagcatagtgggaatctgcaccatgcccggggctctgctcctcctgaccctcctcactcactctgcagtgtcagtggtccaggcaggcctgactcaccgcccccctgatcgtccaaggacatgacgacagaccnccaacactcacctgcacgagggaaccncaaanatgtaggacaaccgaaggancagcgttggtcgcagcagccaaccgtacggaccccacccccgtaccccactacccttacctcggtaaccccgtaagaacggtaaaaccttaaaaccccggaaccccggtccccttacggaacgggaccttaccgtaacgaaggaagtacgttaacgtttttcgacgacctaacgtaccgtaaggtaaccgaaacggtaaccgtaccaaccggttccctacccgtacgtaaccctaacgttaccgtaccggtacctaccgtacgaccgtacgggaacggtacggtacggtaccgtacgtaacgttaacgtttaacgtttaggttaacgtaccgaaggtacggtaacctaccgtacgtaccgtctaccgtcggtcggtttacgggttcgggttacgggtaccgggaacggtaaccgtacggtccgttaaccgacccgggttacgtaccgggtacctaaccggtacccggttaacggccccgttaacccccgg

SEQ ID NO: 257864 - DNA, 643 bp, Homo sapiens
  misc_feature: GYAE6OF02FT4HF.23.26.C04.1.454.CMB.1.raw
  modified_base (230)..(230): a, c, t, g, unknown or other
  misc_feature (230)..(230): n is a, c, g, or t
  modified_base (359)..(359): a, c, t, g, unknown or other
  misc_feature (359)..(359): n is a, c, g, or t
tcagacgcgagtatcacgaccggtgctcgatttagtctagcgactttgggtttggggtccaaaacagagcttcagcaagcatagtgggaatctgcaccatgcccggggctctgctcctcctgaccctcctcactcactctgcagtgtcagtggtccaggcaggcctgactcagccccatcgatgtccaaggacatgagacagaccgccacactcacctgcacgagggacnccaacaatgtgcaaccaagagcagcttggttgcagcagcaccgagggcccaccctcccacacctcctgtcctaacgagtaaactaaaccaacccggccctacgaacgggactctacagagatattttcngtactatccgaggtacaggaacgtcacgcccttacccgtacgaacctacttaccgacggtacctaccagtcccaggaacggacgacggtcgtagtaaccgttatttactttcgtttaacggactaaggttcgggaacctaaccgtacgtacccgttcgtaacgttcgttcggtttggggttccggttaccggggaccgggtacgggtaacccggaacggtaccgttaccgggtaacccggttaccggttaacgggttaccaaccggtcccgtaacggtccccgg

SEQ ID NO: 257865 - DNA, 684 bp, Homo sapiens
  misc_feature: GYAE6OF02IWCYI.23.26.C04.1.454.CMB.1.raw
  modified_base (245)..(245): a, c, t, g, unknown or other
  misc_feature (245)..(245): n is a, c, g, or t
  modified_base (437)..(437): a, c, t, g, unknown or other
  misc_feature (437)..(437): n is a, c, g, or t
  modified_base (520)..(520): a, c, t, g, unknown or other
  misc_feature (520)..(520): n is a, c, g, or t
  modified_base (613)..(613): a, c, t, g, unknown or other
  misc_feature (613)..(613): n is a, c, g, or t
  modified_base (663)..(663): a, c, t, g, unknown or other
  misc_feature (663)..(663): n is a, c, g, or t
tcagacgcgagtatcacgaccggtgctcgatttagtctagcgactttggggtttggggtccaaacagagcttcagcaagcatagtgggaatctgcaccatgcccgggctctgctcctcctgaccctcctcactcactctgcagtgtcagtggtccaggcacggcctgactcacgcccccctacgatcgtccgaacgacatcgagacgacgaccgccacactcacctgcacgacggaacgcccaanatgtcggaccaaccgaaggacgcaggtaccgttggttacgtccacgccgacgaccaccggaccgggtaccccaaccctacccgacccacctccgtacgttacccgaacgtaacggaaaccttaaacccgaccccggtaccctaccggtaacgggtacctaccacgtaagacggtaacgttcgtttttaccgnggtactacgtaccgtacggtacgaacggtaacccgaccgtacgtacccgtacctacgaaccgtagttaacccgtcggtaaccnccgaacgtccgtacgtaacggacgacggttacctaggtaccttatttacgttacggtttacgacgttacggacggtacctacggctacccgtnaccgttcgtcgttgggacgtacggcgacggtacagtcgacgacgtaccgngacgcgaccgtagcctacccg

SEQ ID NO: 257866 - DNA, 699 bp, Homo sapiens
  misc_feature: GYAE6OF02G0JDK.23.26.C04.1.454.CMB.1.raw
  modified_base (384)..(384): a, c, t, g, unknown or other
  misc_feature (384)..(384): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctcgatgtccaaggacatgagacagaccgccacactcacctgcacgaggaacgaccaacaatgtggaccaaaccgaaggagcgagtcgttggtgcagcagccaccgacggacccaccctcccaccaccttcctcgtaccctaacgaacggaaactaaaccgaaccccggccctacggaggactcctacaaggagtacgttatttcncgactacgtaccgaggtacgaacgggaacgccgaccgcccgtcccgtacgtacctaacttacgtacgtacctaccgtacgtaccgtacggacggaaccggacggtaccgtacgtaactcgtttaaaaaaaaaaaaaagtttgtttaacgtacgtacggtacggtaccgtaaccgtacgtaccgttacgtacgtacgttcgttgggttacgggttacgggtaccggggtaacgggtaaccggtacggtaccggtaccggtaacccggtaccggttacggtaccgtaccggtacccggtaccggtccggtaccccgg

SEQ ID NO: 257867 - DNA, 822 bp, Homo sapiens
  misc_feature: GYAE6OF02JS08D.23.26.C04.1.454.CMB.1.raw
  modified_base (544)..(544): a, c, t, g, unknown or other
  misc_feature (544)..(544): n is a, c, g, or t
tcagacgcgagtatcacgaccggtgctcgatttagtctagcgactttgggtttggggtccaaacagagcttcagcaagcatagtgggaatctgcaccatggcccggggctctgctcctcctgaccctcctcactcactctgcagtgtcagtcggtccaggcaggcctgacctcacgccccctgatcgtaccaaggacagtagagacacggacccgccacaactcacctcgcaacgacgggaaccaccaaactaagtcggttacggaaccaaaccgtaaggaacgtaccgaaggtccgtttacgggttgaccgacgaccgaagcccgaaacccggaaccggggtaccccctaaccccccgtacccaacccgacccgtttacccgtaccgttaccccgtaaaccggaacggttaaaacccaaacccgtaaaccccgggtccccgtaggtaaaccgggtcttaacccgtacgaacgggtaacgtacgttacgtttttcccacggtacctacgtacccgtaacggggaacccgtaaaccggggtaaanaacccgttacccgtaccccgttccccggtaaacgtaaacccttaaccgggttaacccgtaccgggtaaccccttaacgaacccggtaccggttacgggaaacggtaccggtaccggtaccgttagtaacccgtttaagtttagtttaaccggttaacgtcgtaacggtcgtaacgtaccgacgtccttacgtcgtagttcgttggtacgtccgggaaggcgtaacgcgtacgtccggacgttacgaccggagtacccgacggtaccggtctaccccgg

SEQ ID NO: 257868 - DNA, 779 bp, Homo sapiens
  misc_feature: GYAE6OF02HN2R5.23.26.C04.1.454.CMB.1.raw
  modified_base (266)..(266): a, c, t, g, unknown or other
  misc_feature (266)..(266): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgccccctgatcgtaccgaagacatgagacacgaccgccacactcacctgacacgagggaaccacaacagtcggtagacctaaaccgaaaggganacgaacgtcgttagggttgaccgtagacgtaacggccaaccgaccggggtaccccaaccccgttacccaaccgtacctcccgttacgttaccccgtaacgaacgggtaaaaccttaaacccggaacccggtaccctacggaagggtacctacgtacgaaggtaaccgtagttacttttacgagacctacttaccggaacgtacgtaaacgggaaccgtccgaacgtccccgttaccgacgtaacctacgttaccgtacgtaccctaccgacgtacgtacggaaacggtccggtacgactacgttaactagtttaacgttagttacgctaacggtacgggtaacctaccggtaacctccgttacgtaacgtacgttacgggttaggggtttaccgggttaccgggtaaccggggaacggttacccggtaacgggtccgttaacccgggtacccgtttaacgggtaccgtacccggaacccgggaacccgttaacgggtcccgttaacccccggg

SEQ ID NO: 257869 - DNA, 786 bp, Homo sapiens
  misc_feature: GYAE6OF02GGMU3.23.26.C04.1.454.CMB.1.raw
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctgatgtaccaaggacatgacgacagaccgccacactcacctgcacgacgggaacnccaanatgtcgacaaccgaggacgcagtcgttggttgccgacgtcacggcaaccgacggggtacccaccccgtcccaacctaccttcccgtccgtaccgtaacgaacggtaactaaacccgaacccgggtcccctacggacgggtactccctacgaacgaggtaacgtttactttcgtgtacctacgtacgaacgggtacgtaaacgggaaaccgcctacgccctacccgtacgtaccgtaacttaaccggtacggaacccgttacccgacgggttacccgtacgggaaacgggtaccggtacggtaccgttagttaaccttaacggttttacgttttaacggttacggttaacgtacgttaaccggggtaaccctaccgttaccgtacccgttacgtactttcgggtaccgggtttccggggtttaaccgggtcggggttacccggggtaaccgggaacccggttaacgggtcccggttaaccgggaccgggtttacccggtacgggtaacccgtaacgggtacccaccgggtttacccgtaccccccggg

SEQ ID NO: 257870 - DNA, 830 bp, Homo sapiens
  misc_feature: GYAE6OF02HTXB8.23.26.C04.1.454.CMB.1.raw
  modified_base (219)..(219): a, c, t, g, unknown or other
  misc_feature (219)..(219): n is a, c, g, or t
  modified_base (245)..(245): a, c, t, g, unknown or other
  misc_feature (245)..(245): n is a, c, g, or t
tcagacgcgagtatcacgaccggtgctcgatttagtctagcgactttgggtttggggtccaaacagagcttcagcaagcatagtgggaatctgcaccatgcccgggctctgctcctcctgaccctcctcactcactctgcagtgtcagtggtccaggcaggcctgactcacgcccccctggatcgtaccgaaggacagtggaagaccagacccgccacnctaccaccgtgaccacgagggaaccncaactaactgttggacaaccgaaggagtaccgagtccgttaggttcgacgagcacggccaccgacgggccccacccgtcccaacgacctcccgttactaccctaacgaaacggtaaacctaaacccgtaaccccgggcccctaacgaacggggtacctttaccgaactaacgggacgtaacggttactttttaccgacggtaccttaaccgtacccggtaaggttaacccgaaacggggtaaaccgtccgaacccggttcccgttacccgtacgttaacctacgtttaccggacggtaccctaccgtacgaccgttacgggaacggtacggacggtcttacggtaacctttaagtttagtttacggttacgtacgtaacgttaccggaacctaaccggtacgtacccttacgtacggttaccggttcgtttacggggtaccggtttaaccgggggtaccggggtaacccggggtaaccggtaggttaccccggttaccgggttaaccccccggttccgggttaaccggtacccggtaaaccccggggtacccgtttaacccggggtccccgttacccccccgggg

SEQ ID NO: 257871 - DNA, 670 bp, Homo sapiens
  misc_feature: GYAE6OF02HN6WN.23.26.C04.1.454.CMB.1.raw
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtacaggtggtccaggacacggcctgactcacgccccctcgatcgtccaaggacatcgaagacaacgacccgaccaacacctaccaccgtcgcaacgacgggaacgccaaactaattggttacggaccaaaccgtaaaggcgtacacgtcgttggttagcgagcacgcgacccgacggccccaccccgtccaaccgcctcctcgtaaccacaacggtaaacaacccgtaacccggcccgtacggtaacggactccgtacacgtaagtacttacgtttcgatcgtactacgtaacgtagaaacggaaccgactacgccctccgtacacttataccgacggacctccgacgtcgtacggacgaacggacgtcgtaacggtacttagttagttacgttagtaccgtaggtaccggtaaccgacctacgtacctccggttagcgtttacgttcgggtacggtacgtcggggtaaacggaccgtaacgcggtaccgtaccgtcgtacggctacggaccgagtcccgtcccg

SEQ ID NO: 257872 - DNA, 708 bp, Homo sapiens
  misc_feature: GYAE6OF02JZZ6H.23.26.C04.1.454.CMB.1.raw
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtgtccaggcaggcctgactcacgccccctgatcgtaccaaggacatgacgacacggaccgccacactccactcgacacgagggacctaccaactagttggtacggaccaaccgaaggagacgacgtcttagggttacgccgaagcgacgccgtaaccggaccggaccccgtacccaccccaaacgtcccttaccgtctaccgtaacgacggtaactacccgaaacccggttccacgtacgggtactcctacgaacggtagtacgtacttttaccgagtacccgttaactaccggtaagggttacccggaaaccgggtaaaccgtccgtaacccgtacccgttaccccggtactaaccgtttaccgtaacggttacgaacccgtccgtactacccggtagacggtaccggaggtccgtactagttacgttcgtagttacgcgtacggtacggactaacgtcgtctaacgtcgtacgtcgttacggcggttcggaacggttcgaactaccggtcgtacggaccggttcgtacggaccgccggtacctccggaccgtcccgg

SEQ ID NO: 257873 - DNA, 633 bp, Homo sapiens
  misc_feature: GYAE6OF02F2089.23.26.C04.1.454.CMB.1.raw
  modified_base (424)..(424): a, c, t, g, unknown or other
  misc_feature (424)..(424): n is a, c, g, or t
  modified_base (494)..(494): a, c, t, g, unknown or other
  misc_feature (494)..(494): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcaggcctgactcacgcccccctcgatgtaccaaggacatggagacagacccgccaccactccacctgcacgagggaccgaccaacaagtgttggaccaaccgaaggagcagtacttggttgacagacagcctaccgacgggccccaccccgtcccactacctcccgtcgtacctaacgaaggtaactaaacccgaaccccggtccctacgaaggactctacgaagagagttactttcagtcactcgtaacgtacgaacgggtaacncgacgtcctcctacgacctattaccgtcgtaccaccgtacgccgtagacggacgtagcgtagcttagttnttagttatcgagtcggacaccgtacgcctacgtactcggttcgttcggggtcgtacgggcgggtaaccgggaccgtacggtccgttccggtaaccgttcggttaccggcctaccggacccgttacggccgtcccccggg

SEQ ID NO: 257874 - DNA, 764 bp, Homo sapiens
  misc_feature: GYAE6OF02FL46U.23.26.C04.1.454.CMB.1.raw
  modified_base (257)..(257): a, c, t, g, unknown or other
  misc_feature (257)..(257): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtgtccaggcaggcctgactcacgcccccctcgagtgtccaaggacatcgagacagaccgccacactcactgcacaggacacaacatgtgcaacagagcagcttggtcncagcagcaccacggtcccacccgtccactactcctgtaccagacggaactaaccaacccggaccctaggacgggtctaccgtacgagaacgtagtactttcgtacgtactcgtaccaagggttacaaacgggtaacgacctaccgacccgttacccgtacgaacccttaacgttaccgtacggggttaccctacccgtaacggttccccgtaaggggaaccggttaccggaaccgggtccgtttaacccgggtaacctttaaagttttaccggtttaacggggttttaacgacggtaaaccgggttacgggtaaccccgttaacccgaaccggttacctttaacccgtacggttaccgggttaccgttttccggggtacgggttaccggggtaaccgggggtaacggaaccggtaaccgggtacccggttacgggtaacccccggttacggttaccggggtaacccgtaccggaaccccgggtttacggccccggtttaacccccgg

SEQ ID NO: 257875 - DNA, 710 bp, Homo sapiens
  misc_feature: GYAE6OF02J1WRX.23.26.C04.1.454.CMB.1.raw
  modified_base (167)..(167): a, c, t, g, unknown or other
  misc_feature (167)..(167): n is a, c, g, or t
  modified_base (617)..(617): a, c, t, g, unknown or other
  misc_feature (617)..(617): n is a, c, g, or t
  modified_base (672)..(672): a, c, t, g, unknown or other
  misc_feature (672)..(672): n is a, c, g, or t
tcagacgcgagtatcacgaccggtgctcgatttagtctagcgactttgggtttggggtccaaacgagagcttcagcaagcatagtgggaatctgcaccatgcccggggctctgctcctcctgaccctcctcactcacgtctgcagtgtcagtcgtccaggcagtccngactccacgcccccctagcttgtaccaaggacactgacaccaacgacccgtccaaccgactaccaccgtcgccaaacggacgtaaccgaccaagagttcgtacggaccaaaccgtagacgacgtagcgtttggacgagacgtacacgtaccgaccggaccgggaccccacccctccgaacctcccttaccgtacgtaccgtaagacgtaaacaaccgaacccggtccgtacggtacgtacttaccgaccgaaggtacaggtttacctttaccgtcgtaccgtacgtaaccggtcggtaaccggtaaagaccggctaacccggtccctacccgaacgtacctaactttacgtaccggtaccttcgaaccgtcgtacggaacgggaccgttaggtaccttagtacctttattattacggtaactcggtacgacggtaactccgaacgttccncgtaccgtgttccggtgtggtccggacggtcgaacacggtcccggtactaccggngttaacccggcgtaccggccgtacgggtaccctcccgg

SEQ ID NO: 257876 - DNA, 749 bp, Homo sapiens
  misc_feature: GYAE6OF02IL57G.23.26.C04.1.454.CMB.1.raw
  modified_base (243)..(243): a, c, t, g, unknown or other
  misc_feature (243)..(243): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtcggtccaggcacggcctgactcacgcccccctgatcgtaccgaaggtacagtgagacagaccgccacactcacctgcacgacgggacaccaanaacgtgtcggaccaaccgaaggcacgacgtcgttaggttcgcagacacgccaaccggacggaccccacccctcccgactaccttccgttacgtccttaacggaacggtaactaaacccgacccgaccgtacggaacggtcctaccgttacaaacggtacgtaacgtttacgtttcgacgtcctacgttacccggaggtaccggaaacgggtaaccgccgtaaccgtccccgttacccgtaccgtacccgtaacgtttacgaccgtacctaaccgacggtaccgtacgggaccgggtaacggacggtaccgtacgttaacttacggttttactttaaccggttacgtacgtacgggttaccggaccgtacgaccgttccaaccggtacgttccgtccgtttacggggtcggttaccgggacgggtaaccgggtaccgtaacggccgttaacgtcccgggttaacgtcggttaccggaaccggtacggtaccggacccgttaccccgg

SEQ ID NO: 257877 - DNA, 799 bp, Homo sapiens
  misc_feature: GYAE6OF02F5VSO.23.26.C04.1.454.CMB.1.raw
  modified_base (108)..(108): a, c, t, g, unknown or other
  misc_feature (108)..(108): n is a, c, g, or t
  modified_base (223)..(223): a, c, t, g, unknown or other
  misc_feature (223)..(223): n is a, c, g, or t
  modified_base (262)..(262): a, c, t, g, unknown or other
  misc_feature (262)..(262): n is a, c, g, or t
  modified_base (416)..(416): a, c, t, g, unknown or other
  misc_feature (416)..(416): n is a, c, g, or t
  modified_base (770)..(770): a, c, t, g, unknown or other
  misc_feature (770)..(770): n is a, c, g, or t
tcagacgcgagtatcacgaccggtgctcgatttagtctagcgactttgggtttggggtccaaacagagcttcagcaagcatagtgggaatctgcaccatgcccggggntctgctcctcctgaccctctcactccactcctgctagtctacagtcggccagtcacggcctgactcaccgccccctggctcgtacgagactagtgacgacactccgacacactcnctagacaggacgacctacaatagtgtacacgaagagacntacgtcgttacgtcacgacgacacggtccaacggcccgtaacccctccccgtaccaccttaccgttccggttaccgttaaccaacggtaaacgtaacccgtaacccggaccccgtacccggttaagggaaccttacgtacctaacgtaacgggngtttaaccgttctttacgggtaccacgtttaaccgtacggtaacggtaacccgtaaacgggaccttccggtaaccgttaccccgtaccgttaacgtacccgttaccgttaaccggtcccgtaaccgtaccggttaccggaccgttaaccgggaccggttaaaccgggtaccgttacggttaacgtttaacgtttaacgtttaccgtttacgggaccgttacggtaaccggtacccgggtacctaccgtaccgttacttaacccgagtttcgggtaccgggttggttaccggtacgggtaaccgggtaactaaaccgggttccgtaaccgtaccggtacgtacgacgtacccggnggttacccgtacggcccgttaaccccggg

SEQ ID NO: 257878 - DNA, 758 bp, Homo sapiens
  misc_feature: GYAE6OF02JZKJX.23.26.C04.1.454.CMB.1.raw
tcagacgcgagtatcacgaccggtgctcgatttagtctagcgactttgggtttggggtccaaacagagcttcagcaagcatagtgggaatctgcaccatgcccggggctctgctcctcctgaccctctcactcactctgcagtgtcagtggtccaggcaggcctgactcacgcccccctgatgtaccaaggacagtgagacagacccgccacactcaccgtgcacgaggaccgaccaacaatgtacggacaaccgaaggacgacaggtcgttacggttcgacgtagacgacgccgaccgaacgggcccctaacccgtacccacctaccgtcccgttacgtacctaaccgaggtaaacgtaacccgaacccggcctacgacggtactactacgacggtaacgtaagttacgttttctcggacctacttaccgggtaggtacgaaacgggtaaacgtccggaacctacccgtttcccgacgaaacccgtttagttaaccgtacccgggtactcccgaacgtcccggtaaggaccgggtaaccgtacggttaccgtacggttaaccgttaagttaccttttaagggtcgtagtaaccgggtaggtaaccccgacgttaccggaccctttacggtcggttacgttcgggttacgggtcggtttacggggaccgggtaaaccggtaccgttaacgacccgttaacggtcccgtttaacggtacccggtaacggaccgtaacccggtccgacccgttacccggg

SEQ ID NO: 257879 - DNA, 679 bp, Homo sapiens
  misc_feature: GYAE6OF02IPSOR.23.26.C04.1.454.CMB.1.raw
  modified_base (350)..(350): a, c, t, g, unknown or other
  misc_feature (350)..(350): n is a, c, g, or t
  modified_base (632)..(632): a, c, t, g, unknown or other
  misc_feature (632)..(632): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcaggtggtccaggcacggtcctcgactcaccgccccccttgatcgtaccaaggacagtcgagcgacgaccgccaccactccaactgccacggacggaaccgccaactaagtcgtacggaacaaccgtaaggacgacctaggtcgttaggtcgacacgcaggaccctaccggacggtaccccaacccccgttacaccgccttccncgttacccaacgtacggtaaaaccaaccggtacccgtaccctagggaacgggttctcccgtaagacggaacgttaaccggtttacgttcttacgaccgttacgtacgaacggtcgtaacgaacgccgtaaccgcccgtacgtacctaacgtactttacgacggcctacgcgtacgtcggaggtaccgcggtacgtagtacgttaatcgttacgttacgactggtaaccggccttacgcgttacgctgtacggtcgttacgggtcgagggtcgaagtaccggngtacgccgtaacgtcgtaccggcgtacgaccggtcgtcccgtcccgg

SEQ ID NO: 257880 - DNA, 927 bp, Homo sapiens
  misc_feature: GYAE6OF02JR9S3.23.26.C04.1.454.CMB.1.raw
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtctacgtggtccagggcacgggtcctcggaacctccgacggacccccccgttgaacgttccggtaccgaaagggacctacgttacggtaacggtaccgtaaccggtacccggacccaaaccctaccgttacccgaacccggttacggaccaaccgggttaacgggggaaccctaacccgtaaacggtaaacgttcgggttacgggaacccaaaccggaaccggttacgtaccgaacggttcgtttcgggttaccgactacgacggtaccgaccgaacggccgggacccctaaccctccgaacctccgtaccgttacggtccgtaaaccgtaacggaactaaacccggtaccccggtacccgttaacggtacggtaccgtacgttaccgaaggtccgtaagttaccgtttccgacgtaccgtgttaccggtacgtaaccgggaacggtaacccgtcggaacgttcccgtaaccgttcggtaaacccgttacgttaccggaccggttaaccacccggttacgaccggttacggacggttaccgggtaacgtacggttaaccgttaacggttccgtttaacgtggtttaaaccggacccggttaagtccggtaacccgaacggttaccgtcccttaacggttaaccggttcgttacgggtttaccgggttcggtaccggggttaaccggaaacggttccggtaacggttaaccggttcccttacgggttaccggttccggtaaccggtaccccggttacggtaaccggtcccggtttaccccggg

SEQ ID NO: 257881 - DNA, 759 bp, Homo sapiens
  misc_feature: GYAE6OF02GFC97.23.26.C04.1.454.CMB.1.raw
  modified_base (441)..(441): a, c, t, g, unknown or other
  misc_feature (441)..(441): n is a, c, g, or t
  modified_base (549)..(549): a, c, t, g, unknown or other
  misc_feature (549)..(549): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctctcactcactctgcagtgtcagtggtccaggcaggcctgactcagcccccctgatgtccaaggacatgagacacgaccgccacactcacctgaccacgagggaaccgaccaaacgtaatcggttaggaccgaaacccgaaaggacgcctaaggtccgtttacgggttagccgtacggacaacggccaaaccccgggtacggggaccccctaacccccgttcccccgaaccctacccgttccctaccggttaccccttaaaccggaacgggaaaaccttaaaccccgaacccgggtcccctaacgacggggttacnccttaccggaagtacgtacgttacgtttttcacggtccaagtcccgaacgggtacgaacgggtaaaccgccacgtcccgtcccagtaccctacgttactacggtaccnccgtacgtccgtaggacggaaccggtaggccttaacggtacttaagtttactttaggttaacgtcgtacgttacggaaccaccgtacgtcctaccgtatacggttcgttcgggttcggtcgggtaccgggacggtaccgtaacggtccgtaccggtacccgttacggtaccgggtaccgaaccggtacccggtacggcccgttaccccgg

SEQ ID NO: 257882 - DNA, 666 bp, Homo sapiens
  misc_feature: GYAE6OF02F7S25.23.26.C04.1.454.CMB.1.raw
  modified_base (203)..(203): a, c, t, g, unknown or other
  misc_feature (203)..(203): n is a, c, g, or t
  modified_base (258)..(258): a, c, t, g, unknown or other
  misc_feature (258)..(258): n is a, c, g, or t
  modified_base (575)..(575): a, c, t, g, unknown or other
  misc_feature (575)..(575): n is a, c, g, or t
tcagacgcgagtatcacgaccggtgctcgatttagtctagcgactttgggtttggggtccaaacagagcttcagcaagcatagtgggaatctgcaccatgcccggggctctgctcctcctgaccctcctcactcactctgcagtgtcagtggtccaggcgacggcctgactccacgcccccctgatcgtccgaaggacatganacagaccgcacactcacctgcacacgggacaccaacaatgtgaccaaccgaaggntcagtcgttggttgcaggcagccacgacggaccccacccgtcccacgaccttccgcttacccaacaacggaaccttaaacccgaacccggtccctacggaagggactacctacgaagaggtaacgtttactttcgagtacctacgttccgaacgggtaccgaaacgggtaaacctccgaaccgttcccgttacccggtacgtaacctacccgttttacgaaccgtaccctaccgtaccgtcgtaccgggacggacggtacgacgttagtaccgttaagtttctttagtagcgtagacggtacacgtcctactctagngtcgttcgggtacgttcgggacggtaacgtcggaacgtccggtaacgttccgaccggtttacgaccgaccggtccgacggtccctacccgg

SEQ ID NO: 257883 - DNA, 296 bp, Homo sapiens
  misc_feature: GYAE6OF01BQF8D.36.63.F08.1.454.CMB.1.raw
  modified_base (290)..(296): a, c, t, g, unknown or other
  misc_feature (290)..(296): n is a, c, g, or t
tcagtacgctgtctcacgaccggtgctcgatttagcgatcgtataagggggacggagtccctgatcgcttctcaggctccagctctgggcctgagcggtgcctcaccatctccagcctccagcccgaagatgaggctgactatttctgtcagacgtgggcactggcattcatgccgtgttcggcggaggaacccgattgaccgtcctaggtcagcccaaggctgccccctggtcactctcgttcccacctcctcagacagcgtactgagcgggctggcaaggcgcatagnnnnnnn

SEQ ID NO: 257884 - DNA, 294 bp, Homo sapiens
  misc_feature: GYAE6OF01EQ6M7.36.63.F08.1.454.CMB.1.raw
  modified_base (256)..(256): a, c, t, g, unknown or other
  misc_feature (256)..(256): n is a, c, g, or t
  modified_base (290)..(294): a, c, t, g, unknown or other
  misc_feature (290)..(294): n is a, c, g, or t
tcagtacgctgtctcacgaccggtgctcgatttagcgatcgtataagggggacggagtccctgatcgcttctcaggctccagctctgggcctgagcggtgcctcaccatctccagcctccagcccgaagatgaggctgactatttctgtcagacgtgggcactggcattcatgccgtgttcggcggaggaacccgattcgaccgtctaggtcagcccaaggctcgcccctcggtcactctcgtcccaccctctcanacagcgtactgagcgggctggcaaggcgcatagnnnnn

SEQ ID NO: 257885 - DNA, 294 bp, Homo sapiens
  misc_feature: GYAE6OF02ICZZ3.36.63.F08.1.454.CMB.1.raw
  modified_base (292)..(294): a, c, t, g, unknown or other
  misc_feature (292)..(294): n is a, c, g, or t
tcagtacgctgtctcacgaccggtgctcgatttagcgatcgtataaggggacggagtccctgatcgcttctcaggctccagctctgggcctgagcggtgcctcaccatctccagcctccagcccgaagatgaggctgactatttctgtcagacgtggggcactggcattcatgccgtgttcggcggaggaacccgattgaccgtcctaggtcagcccaaggctgccccctcggtcactctgttcccgccctcctcagaccagcgtactgagcgggctggcaaggcgcatagnnn

SEQ ID NO: 257886 - DNA, 511 bp, Homo sapiens
  misc_feature: GYAE6OF01A1G1B.34.23.C01.1.454.CMB.1.raw
  modified_base (327)..(327): a, c, t, g, unknown or other
  misc_feature (327)..(327): n is a, c, g, or t
  modified_base (424)..(424): a, c, t, g, unknown or other
  misc_feature (424)..(424): n is a, c, g, or t
  modified_base (506)..(507): a, c, t, g, unknown or other
  misc_feature (506)..(507): n is a, c, g, or t
  modified_base (509)..(511): a, c, t, g, unknown or other
  misc_feature (509)..(511): n is a, c, g, or t
tcagtacacgtgatcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcaacctgcctccgtctctgggtctcctggacagtcgatcaccatctcctgcactgtaaccggcagtgacgttgatgattataagtctgtctcctggtaccaacaacaccccggcaaaacgctacccaaactcactgatttatgatgtcaataatcggcctnaggtgttctcatcgcttctctgcctcatgtctggcaacacggcctccctgaccatctctggactccaggctgaggacgagggtcacgcccaaggccncgccccctcggtcacctctcgttcccgtccctcctcactcacgtcgtacctgacgcgggctggcgtaacgggcgcactagcnncnnn

SEQ ID NO: 257887 - DNA, 526 bp, Homo sapiens
  misc_feature: GYAE6OF01BI3KU.34.23.C01.1.454.CMB.1.raw
  modified_base (248)..(248): a, c, t, g, unknown or other
  misc_feature (248)..(248): n is a, c, g, or t
tcagtacacgtgatcacgaccggtgctcgatttagtacacgtgattagggattggggggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccagcagtgacgttggtcattangactatgtctcctggtaccaacattaccaggcaaagcccccaaactcattatttatgatgtcgctagtcggccctcagggtttctaatcacttctctggctccaagtctggcaacacggcctcctgaccatctcgtggctccaggctgaggacgaggctgattattatgcagctcacataacaaccattaacacttcgttggtttcggcggacggtacagttcgaccgtccgtacgtcgacgcccaaggctacgcccctcggcactctcgttaccccc

SEQ ID NO: 257888 - DNA, 599 bp, Homo sapiens
  misc_feature: GYAE6OF01DCXKV.34.23.C01.1.454.CMB.1.raw
  modified_base (199)..(199): a, c, t, g, unknown or other
  misc_feature (199)..(199): n is a, c, g, or t
tcagtacacgtgatcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcaacctgcctcgtctctgggtctcctggacngtcgatcacatctcctgcactggaaccagcactgacgttggtggttatggggtatgtctcctggtaccgacaatacacagacagacgcccccaattctttaattttgatgtcactaatccggccctcgtagggtttctcatccgtcttctctcggtctcaagtctggcagtcacggcctccctgacctatcctcgtcgggtcctccgaggtctggaggacgtaggtacttaagtttaccgtacgtcgtactcgtacctcgtattactacttatttcgaccctagtcgtcttggttcgtaggtttccgggacggtacgggtaacccgaagggtccgtaccgttcccgtacgcgttacaccggccgtaaacgcccgtaccgccccccgttggtcccttaccg

SEQ ID NO: 257889 - DNA, 664 bp, Homo sapiens
  misc_feature: GYAE6OF01BU60T.34.23.C01.1.454.CMB.1.raw
  modified_base (229)..(229): a, c, t, g, unknown or other
  misc_feature (229)..(229): n is a, c, g, or t
  modified_base (277)..(277): a, c, t, g, unknown or other
  misc_feature (277)..(277): n is a, c, g, or t
tcagtacacgtgatcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcaacctgcctccgtctctgggtcctcctggacagtcgatcaccatctcctgcactggaaccngacactgacgttggtggttatgggtatgtctcgtgtacgacaatacanagacacgacgcccccaattcgtttaattttgatgtacacttaacgtccggtcctacgtagggtttctctacttcgtcttcgtctcgctaccagtcgtgcagccgacgtccctcctcgacctacgttctccgtcggcctcgacggtcgtacgggagggtaaccggacggtactttaaccgttttacgtaaccgttcgggacttcggtccttactaacttaacgttacttagtttccgaccgtacggtcgtacgttcgtcggttacgtttcgggacggtaaccgggtacgtaacggtaccgtacccgttacccgtacgtacccggtacgtacccggaacccggtacggtccccggtacccgtcccccggttaccggtcccgttacccgg

SEQ ID NO: 257890 - DNA, 730 bp, Homo sapiens
  misc_feature: GYAE6OF01DGB7Q.34.23.C01.1.454.CMB.1.raw
  modified_base (222)..(222): a, c, t, g, unknown or other
  misc_feature (222)..(222): n is a, c, g, or t
  modified_base (235)..(235): a, c, t, g, unknown or other
  misc_feature (235)..(235): n is a, c, g, or t
tcagtacacgtgatcacgaccggtgctcgatttagtacacgtgattagggagttgggggggggtctcaggaggcagcgctctcgggacgtctccaccatggcctgggctctgctattcctcaccctcctcactcgagggcacgagggtcctgggcccagtctgccctgactcaacctgcctccgtctcgtcgggtcctcgtggacaggtcatcacatcctcngcactaggaaccngcacgtggtacgttggtggttagtggtactcgtccgtacgtacggtaaccaataactacaacgtacgaacacgacccgacccctaaatttactttaattttgattcacgtaactaccgtaccggtcctacgttaggttctgtactcgtcttacgtcgtacgtctaaccgtagtcgaggactacggccgtaacccgtccctaccgacgtacctacgttcgtccgggtaacggtcctacggaacgggtacggtagggtaacggtaacggttacgtacctttaaggttacctacgtacgttcgtacgttactaacgtaatacgttacgttacgttacggaccctacgggtcgtaccgtttacggttaccgttaacgggttacggggaaacccgggtacgggtaaacccggtaagtacccggtaaccgtcccggttaacgcgtacccgaacgtacccggtaacggccctacccggttcccctagggtcccttacccggg

SEQ ID NO: 257891 - DNA, 797 bp, Homo sapiens
  misc_feature: GYAE6OF01ADXHT.34.23.C01.1.454.CMB.1.raw
  modified_base (136)..(136): a, c, t, g, unknown or other
  misc_feature (136)..(136): n is a, c, g, or t
  modified_base (596)..(596): a, c, t, g, unknown or other
  misc_feature (596)..(596): n is a, c, g, or t
  modified_base (632)..(632): a, c, t, g, unknown or other
  misc_feature (632)..(632): n is a, c, g, or t
tcagtacacgtgatcacgaccggtgctcgatttagtacacgtgattagggattggggggggtctcaggaggcagcgctctcgggacgtctccaccatggcctgggctctgctattcctcaccctcctcactacggngcacggtcgtcggccgacgtctcgcctccgactacctaacctacgtccgtcccgttccgttcctcgggttcgttccctcggtacgacgtacggtactacacccaactcttccctcgtcacctacggaaccgaacgcgactacggtacggtttacgggtttgggttaggtttagggttaggttacgttccgttcccgttacgggttaccggaaacctaaactaactaccgaacgacgaacgaaccgccccccctaaaccttatttttaactttttagtcgtacttccgaaacctttaacggtcccgggtccccgttacgttaggggttttccgttcaacgttccgtccgtttccttcgtccgggtacctacctaacggttcgtccggacgacgtaccggtacccggtacccttccccctaggacctacctcgttccgtacggggtccaccgtcgggtacgngggtacgggaacggtacggtacctttatttaaccgntcgtacgtctcgtactatattactattcgacccgagtcgtcttcggtagggttaccgttaccgggacgggaccggtacgtacgggtccgtaaccggtccctagaacggtcccgaaccggacccgaccggttccgccccgaccccgtttacggtccactttccccg

SEQ ID NO: 257892 - DNA, 837 bp, Homo sapiens
  misc_feature: GYAE6OF01BYI3U.34.23.C01.1.454.CMB.1.raw
  modified_base (204)..(204): a, c, t, g, unknown or other
  misc_feature (204)..(204): n is a, c, g, or t
  modified_base (223)..(223): a, c, t, g, unknown or other
  misc_feature (223)..(223): n is a, c, g, or t
  modified_base (236)..(236): a, c, t, g, unknown or other
  misc_feature (236)..(236): n is a, c, g, or t
  modified_base (669)..(669): a, c, t, g, unknown or other
  misc_feature (669)..(669): n is a, c, g, or t
tcagtacacgtgatcacgaccggtgctcgatttagtacacgtgattagggagttggggggggtctcaggaggcagcgctctcgggacgtctccaccatggcctggctctgctattcctcaccctcctcactcagggcacagggtcctgggcccagtctcgccctgacctcaacctgcctccgtctcgtgggtcctccgtggacngtcgatccaccatcctccngcactaggaaccngccacgttggacggtttgggtaggtttagtggggttatcgttcctaccgttcggttaaccgaacaattaccaacgaagacgaacggtaaccgacccccccctaaatttccgttttaaagtttttacgagtttaccgttaacctaaccgttaaaccggttcccggtacccgtttacggttacgggggtttttacctccgttaacgtccggtttcctttaccgttacggtcggtcccttaacccgtaaacgggttccgtccggggtaacctaaccggtcccggtaaccccgggtaccccttaccccggttaccggtaaccccttaacgtcccgtttaccgggtaccggtcccgttaacccggaacggtcggtaacggtaacgggtaacggtacgggttactttaaccgtttaaccgttaaccgtcgtaccggttntaccttaacctagtaaccttaacgtacttccggtaccgtagttcccgtacgttacgtaccgggttacttcggggacggtaacggaccgtaacggtccgtacccgtcgacgtaccgtacgaccgtacccgtacggtcccttaccccggtcccgtcgggtctacccccgg

SEQ ID NO: 257893 - DNA, 803 bp, Homo sapiens
  misc_feature: GYAE6OF01AFXBX.34.23.C01.1.454.CMB.1.raw
  modified_base (136)..(136): a, c, t, g, unknown or other
  misc_feature (136)..(136): n is a, c, g, or t
  modified_base (159)..(159): a, c, t, g, unknown or other
  misc_feature (159)..(159): n is a, c, g, or t
  modified_base (257)..(257): a, c, t, g, unknown or other
  misc_feature (257)..(257): n is a, c, g, or t
  modified_base (323)..(323): a, c, t, g, unknown or other
  misc_feature (323)..(323): n is a, c, g, or t
  modified_base (442)..(442): a, c, t, g, unknown or other
  misc_feature (442)..(442): n is a, c, g, or t
tcagtacacgtgatcacgaccggtgctcgatttagtacacgtgattagggattgggggggggtcgtcgaggaggcagcgctctcgggacgtctccaccatggcctgggctctgctattcctcaccctcctcactcngggcacgacgggtcctgggcccngtctcgccctgactccaacctgccctccgtctcgttgggtcctccgtggacaggtcgactaccacctattcctccgtacgctacgttacgggaaccanactacgtacggtacggtttggttgggttattcgggggtattccgtcgttccgtagggtaacccaanaaacgttacaacgaacgtacgaacgccccgaaccccccttaactttcttttaaacgtttttggaacttacggtacctaactaaccgttcccggaccgttcggtacgggttttcaccgtntccgttctccggtcttcggaccttacgtagtcgtgctacgcgtaccgccctacagtccctacttccgtcggtacgttccgcgacggtcgtcgggaaacggtcggtaaccggttacttacgtttacctcgttcgaccgtagtaccttaattaccgtagtaaccgtttctcaccggttacgtccgttcgttcggtaccggtacgggtttaccgggaacgggtaccgggtaaaccggtaccggttaacccggttccggttccccgtaacgggttacccgtacccgggtaaaaccgggtccccggtaacccggtaccccggtccccgttaaacccccggggtttcccgtccggttttaacccccg

SEQ ID NO: 257894 - DNA, 679 bp, Homo sapiens
  misc_feature: GYAE6OF01AV641.34.23.C01.1.454.CMB.1.raw
  modified_base (211)..(211): a, c, t, g, unknown or other
  misc_feature (211)..(211): n is a, c, g, or t
  modified_base (224)..(224): a, c, t, g, unknown or other
  misc_feature (224)..(224): n is a, c, g, or t
  modified_base (358)..(358): a, c, t, g, unknown or other
  misc_feature (358)..(358): n is a, c, g, or t
  modified_base (429)..(429): a, c, t, g, unknown or other
  misc_feature (429)..(429): n is a, c, g, or t
  modified_base (448)..(448): a, c, t, g, unknown or other
  misc_feature (448)..(448): n is a, c, g, or t
  modified_base (631)..(631): a, c, t, g, unknown or other
  misc_feature (631)..(631): n is a, c, g, or t
  modified_base (669)..(669): a, c, t, g, unknown or other
  misc_feature (669)..(669): n is a, c, g, or t
  modified_base (673)..(674): a, c, t, g, unknown or other
  misc_feature (673)..(674): n is a, c, g, or t
  modified_base (676)..(678): a, c, t, g, unknown or other
  misc_feature (676)..(678): n is a, c, g, or t
tcagtacacgtgatcacgaccggtgctcgatttagtacacgtgattagggagttggggggggtctcaggaggcagcgctctcgggacgtcctccaccatcggcctgggctctgctattcctccaccctcctcactcgagggcacgtagggtccgtgggcccagtctcggccctgactcacctgccctccgtctcgtgggtcctcgtggacncggtcatccactntcctccgtgacacttacggaaccgtctaggtgtaccgttgtattaggaattttaacgtagtcttcgtccttcccgtacggtaacccaaaccaaacccgacccccgaacgaaaacctcccctaacccctaaaacnccgtaattagtaactttagacgtattacgtactaaagtaaacctccgggtacccttgtacgggttctttcnctacgtcctcttctcgtcnccctaactcggtctcgagacctcccggtactcccgaccctgacctcctcgtactcgccgtacgcggtcgtaggaacggtacggcgggtacgccggacccagccccgtcccgtcccctccgtccaccgtttccgtcccgtacccccctctcccggtactaacccgtcgtacggttccaccgggngcccggttcgggcaaacggtccggaaagtccgcggtancgtnncnnnc

SEQ ID NO: 257895 - DNA, 919 bp, Homo sapiens
  misc_feature: GYAE6OF01DCKT0.34.23.C01.1.454.CMB.1.raw
  modified_base (212)..(212): a, c, t, g, unknown or other
  misc_feature (212)..(212): n is a, c, g, or t
  modified_base (723)..(723): a, c, t, g, unknown or other
  misc_feature (723)..(723): n is a, c, g, or t
tcagtacacgtgatcacgaccggtgctcgatttagtacacgtgattagggagttgggggggggtctcaggaggcagcgctctcgggacgtcctccaccatcggccgtgggctctgcttacttcctcaccctctacactcgagggcacgacgggtcctgggcccagtctcgcctgacttcacctgcccttcgtctcgtggtcctcgtaggacnggtccaatccactacgttcctccgtgccgtacggtaggggacacgacgacctaccgaaacgtcgggtacggggacttaaggtttacgtagtagttaccggtaacgtaacggttacggtaacctaaggaccgtaacgttccggttaaaccggaaaaccggtaaccgaaaccccggttaacccccttaactaccgttactaccttaccgtagtaacctaaccgtaaacctaaccggtaccgtacccggaccggttacggtaccgggtacctaacggacgtttacttcggtacgtttcccggtacttaaccgggtacgtaacccggtcgtacctaacccggtctcccggtacccgttacccgttacgggacctaccgtaccggtaaccggttccgggtaccggttccggtacgggtacggtaacgggtacggtacgggttaaccgtcggttaacgtttaacgtttaacgtttaccggtttaccggttaccgtttaacggtttaccgggtttaanaaacccgggtcggtaacccgtacgggttaaccggttacgttaacgtttaccggtttacgttaacggttaccgggttaaccgtacgggtaaacccgggtcggttaaaccggtacccgtaacccggttacccggaaaccggtttccgtaacccggtaaccgtaacccgggtaacccctaaacccgacccgttaacccg

SEQ ID NO: 257896 - DNA, 752 bp, Homo sapiens
  misc_feature: GYAE6OF01ETWQU.34.23.C01.1.454.CMB.1.raw
  modified_base (115)..(115): a, c, t, g, unknown or other
  misc_feature (115)..(115): n is a, c, g, or t
  modified_base (123)..(123): a, c, t, g, unknown or other
  misc_feature (123)..(123): n is a, c, g, or t
  modified_base (224)..(224): a, c, t, g, unknown or other
  misc_feature (224)..(224): n is a, c, g, or t
  modified_base (231)..(231): a, c, t, g, unknown or other
  misc_feature (231)..(231): n is a, c, g, or t
  modified_base (299)..(299): a, c, t, g, unknown or other
  misc_feature (299)..(299): n is a, c, g, or t
  modified_base (435)..(435): a, c, t, g, unknown or other
  misc_feature (435)..(435): n is a, c, g, or t
tcagtacacgtgatcacgaccggtgctcgatttagtacacgtgattagggagttggggggggtctcagggaggcagcgctctcgggacgtctccaccatggcctgggctctgctnttcctccncccttcctcactcgagggcacgtaggggtcctcgggcccagttctcgcccgtgacttccaacctgcctcgtctcgtcggtctcgtgacagtcgatcaactntcctctncgtacgacgaaccagactacgtgtacgttgggtagtttaggtggtatcgtctccgtaggtaacctaanaacgtacaacgacgacgaaccgacccgtaccccctaagttttcgtttaaatttcgagttacgttacaccgtaacgtccgtccgttaggtacggtttctgtaactcgtcgttcgcgtcgtaacctcgtaacgtacgnggactacgggacctccggttacccgtcctaacaacctagttccggtacggtcggtccgtaagtccggtagaacgggttacgaacggggtaattaccttaacgttaccgttagtacggtcttaccactttaacaacggttactaatttccggtaacgtccgtaacgggtccttacggtacgttaccgggtacggttaggggaccggttaaaccggtaaccgggttacgaaccgggttaccctcgttaaccggacgtaacggttaacccgaccgtaaccggtcccggtaccccggttacccgttacgtcccgttacccg

SEQ ID NO: 257897 - DNA, 556 bp, Homo sapiens
  misc_feature: GYAE6OF02IG7IE.34.23.C01.1.454.CMB.1.raw
  modified_base (336)..(336): a, c, t, g, unknown or other
  misc_feature (336)..(336): n is a, c, g, or t
  modified_base (401)..(401): a, c, t, g, unknown or other
  misc_feature (401)..(401): n is a, c, g, or t
  modified_base (420)..(420): a, c, t, g, unknown or other
  misc_feature (420)..(420): n is a, c, g, or t
tcagtacacgtgatcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcaacctgcctccgtctctgggtctcctggacagtcgatcaccatctcctgcactggaaccagcactgacgttggtggttatgggtatgtctcctggtaccgacaatacacagacagacgcccccaattcttaattttgatgttacactaatcggcctcgtagggtttcnctactcgtcttctctgctcaagtctgcagcacgcctcctgaccatctctggctcagctgagacgngctattactatgactgctnatactactatttcgacctagccgtcgttgtacgtagtttcgggacgggtaggtaccgtaaggtcgaaaccgtcgttccgtacgtacgtaccgacggtacccctaaaggtccctaccggtcccccgtacggttaccc

SEQ ID NO: 257898 - DNA, 553 bp, Homo sapiens
  misc_feature: GYAE6OF02FGS6P.34.23.C01.1.454.CMB.1.raw
tcagtacacgtgatcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcaacctgcctccgtctctgggtctcctggacagtcgatcaccatctcctgcactggaaccagcactgacgttggtggttatgggtatgtctcctggtaccgaccatacacagacagacgccccccaactcttaatttttgatgtcactaatcggccctcgagggtttctcatcgcttctctggctccaagtctggcagcaccggcctccctgacccatctcgtcgggcctccgaggctggacggacgaggtcctaatttactactgctgctacatactactatttcgccagtcgtcttgtctagtttcggcgggtagggaccaaggtcgtaaccgtcctacgacgtccacgcccgaaggtccctaccgcccccgtcggtcctaccg

SEQ ID NO: 257899 - DNA, 674 bp, Homo sapiens
  misc_feature: GYAE6OF02IQA7P.34.23.C01.1.454.CMB.1.raw
  modified_base (270)..(270): a, c, t, g, unknown or other
  misc_feature (270)..(270): n is a, c, g, or t
tcagtacacgtgatcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcaacctgcctccgtctctgggtctcctggacagtcgatcaccatctcctgcatcggaaccagcactgacgttggtgttatgggtatcgtctcgtggtaccganaatacacagacacgacgacccccaattctttaagtttttgattcgtacaacttaactccggtcccttacgtagggttttcacgtacttcgtcttctcgtcggtcctaccgtaagttcttcggacacgaccgtaccggtccctcccgtacgacctatccgtcgtcgggcccttacgacggtctggaacggtacgacggtacttactttacgtactcgtctacgcttactaatacgttactacgtttcgacccgtagtccgtcgtcgttacgttacgtttaccgggggcgggtaacgggacccgttaagggttcccgtaacccggttccgttacgtaccgggtaccaccgggtaacccgacggtacccgtttacccggccccccggtttacggtacccttacccgg

SEQ ID NO: 257900 - DNA, 916 bp, Homo sapiens
  misc_feature: GYAE6OF02IPUVA.34.23.C01.1.454.CMB.1.raw
tcagtacacgtgatcacgaccggtgctcgatttagtacacgtgattagggattgggggggtctcaggaggcagcgctctcgggacgtctccaccatggcctgggctctgctatcctcacctctcaaccggttaccgtacgggtaccgtaccgtacgggtaccgttacgggtacccgtagtacgtacggtaccgtacggtacgtccgtaaccgtcgtaccgtaccgtacgtacgtacggtactaccgtacggtactacgtcgtacgtacgtaccgtacgtaccgtaccgtacgtaccgtacgtacggtaccgtacggtacgtacgtacggtaccggttacggtacggttacgtacggttacgtcggttaccttacggtacggtacccgtaacgtacgttaccccgtaggtacccgtaaacggtcccccgtaaagttccgtaacgtttaccggttacgtacgggtaaccttacggttacccggtaccgttacggttacccgggtaccctttacgggttaacggggttttaccctaacggttccggttaccgtttaccgtaccggttacggacccttacggtaaccggtttaccgtacgggtacctaaccggttcccgggtaccttacccggtaaggttacccgtaacggttccgttaccggtacgggtaccgttaccgtacggttaccgtacggtaacggtaccggtacggtccgttacggtaaccgttacggttacgtacggtacgtaccggttacgtaccgtacgtacgtaccgtacgttacgtactacgtcgtacggttacgacggttacgtaccgtacgtcgtaccgttacgtacggtccgtacggtaccgtacggtcctaccgtcccggtacgtacgtaccgttaccgttacggttacccgtacgttacccgg

SEQ ID NO: 257901 - DNA, 698 bp, Homo sapiens
  misc_feature: GYAE6OF02HQLU5.34.23.C01.1.454.CMB.1.raw
  modified_base (201)..(201): a, c, t, g, unknown or other
  misc_feature (201)..(201): n is a, c, g, or t
  modified_base (236)..(236): a, c, t, g, unknown or other
  misc_feature (236)..(236): n is a, c, g, or t
  modified_base (288)..(288): a, c, t, g, unknown or other
  misc_feature (288)..(288): n is a, c, g, or t
  modified_base (295)..(295): a, c, t, g, unknown or other
  misc_feature (295)..(295): n is a, c, g, or t
tcagtacacgtgatcacgaccggtgctcgatttagtacacgtgattagggattgggggggggtctcaggaggcagcgctctcgggacgtctccaccatggcctgggctctgctattcctcaccctcctcactcagggcacagggtcctgggcccagtctgccctgactcaacctgcctccgtctcgtgggtctcctggacngtcgatccaaccatcctcctgctacgtcggaaccngacacttcggaacgttggtaggttagtagggtatcgtctccgtggtaccganaatacanagacagaccgacccctaattctttaattttgattcgtacaacttacgtccgaccttacggttacgggtttcctacgtacgtccgtaccttcgttccgacggtccctaaccgtaagtccggtacgtcgacggtaccgtacccgggaccccttacccgggtacctaaccctgttaccgttccggccgggttaccctaccggacgttaccggtagggaaccggtaccgtacggttacctttaaagtttacgtacgtacgcttacggtcctactagttaactcttaacgtttcgaaccgcgtacggtcgttacttacgggttagtacggtacgggaccgggtacctaaggtccgaaccttccgtagactcggacgcgtacgacgttccccgaccggtgcttaacccg

SEQ ID NO: 257902 - DNA, 717 bp, Homo sapiens
  misc_feature: GYAE6OF02GKOMJ.34.23.C01.1.454.CMB.1.raw
  modified_base (234)..(234): a, c, t, g, unknown or other
  misc_feature (234)..(234): n is a, c, g, or t
tcagtacacgtgatcacgaccggtgctcgatttagtacacgtgattagggattggggggggtctcaggaggcagcgctctcgggacgtctccaccatggcctgggctctgctattcctcaccctctcactcagggcacagggtcctggcccagtctgccctgactcaacctgcctcgtctctggtctcctggcagtcatcacatctcctgcactggaccagcactgacgttggngttatgggtatgtctcgtcgtaccgacaatacactagacagaccgaccccctaattctttaattttgacgtacgtccaacttaagtccggtcccttacggtacggggtttactcgtacgttcgtctttctccgttcggtaccgtccgtaaggtccgtacggtactaccggtaccggtaccggtcccgttcccgtacgaccctacgttcccgttcggtcgggtacccttcccgggaacgtcgtacggaacgggtacgtaacggttacctttaacgtttaccgttaccggttacgtaccgtcgttacccttacgtaacgttaaccttaacgttaacgttccgaaccgtacggtacctggttaccgtcgttaacggttccgggacggacggtaccgtacgggtccgttaaccggtccttacgtaaccggtacgtaaccggtacccgtacggtccgttacccggccccgttacgtacccttacccgg

SEQ ID NO: 257903 - DNA, 126 bp, Homo sapiens
  misc_feature: GYAE6OF02GRLO7.3.60.F05.1.454.CMB.1.raw
  modified_base (124)..(126): a, c, t, g, unknown or other
  misc_feature (124)..(126): n is a, c, g, or t
tcagagacgcactccacgaccggtgctcgatttagtacgtcatcagggaagggctgggccctgacgtgtttctgttcccgccctcctcgagtgcgtctctgagcgggctggcaaggcgcatagnnn

SEQ ID NO: 257904 - DNA, 131 bp, Homo sapiens
  misc_feature: GYAE6OF02GRBZ1.3.60.F05.1.454.CMB.1.raw
  modified_base (126)..(131): a, c, t, g, unknown or other
  misc_feature (126)..(131): n is a, c, g, or t
tcagagacgcactccacgaccggtgctcgatttagtacgtcatcagggaaaggggctgggccctgacgtgtttctgttcccgccctcctcgagtgcgtctctgagcgggctggcaaggcgcatagnnnnnn

SEQ ID NO: 257905 - DNA, 173 bp, Homo sapiens
  misc_feature: GYAE6OF01D4IR9.47.86.H09.1.454.CMB.1.raw
  modified_base (173)..(173): a, c, t, g, unknown or other
  misc_feature (173)..(173): n is a, c, g, or t
tcagagctcacgtacacgaccggtgctcgatttagtgctatagacttgggtttgggggaagaggaagactgacggtcccccaggagttcaggtgctgggcacagcggccctgggctgcctggtcaaggactacttcctacgtgagctctgagcgggctggcaaggcgcatagn

SEQ ID NO: 257906 - DNA, 165 bp, Homo sapiens
  misc_feature: GYAE6OF02IEZ6Y.47.86.H09.1.454.CMB.1.raw
  modified_base (163)..(165): a, c, t, g, unknown or other
  misc_feature (163)..(165): n is a, c, g, or t
tcagagctcacgtacacgaccggtgctcgatttagtgctatagacttgggtttgggcggagggaccaaactgaccgtcctaggtcagcccaaggctgcccctcggtcactctgttcccaccctcctctacgtgagctctgagcgggctggcaaggcgcatagnnn

SEQ ID NO: 257907 - DNA, 761 bp, Homo sapiens
  misc_feature: GYAE6OF01BYT5B.29.21.B10.1.454.CMB.1.raw
tcagatagagtactcacgaccggtgctcgatttagtgtcgtcgcaaggaaggagaggggacctgatcaggtacttctcagttcagtacgttctcaccgatgaggcctccctcgctcagtcctccgtggggtcctgtctaatgctctggatacctggatccagtggagatattgagatggacccagactccacttcttctctgttaccgtcacccctggtacagaccggcctcccattccgtccgtagcctaaggtctagttcgagagccctcggtcgcgtactaggtgatcggaaacgacctatatggtacctggtaccgtgtccagtaacgttcgaggccagccctccacgtactcctagtagtttacgtgtaacggtttcccgaaagggtaccggtttacgtttttggggagttcggtaccctacggtaacgtaggtcctacggagggtcgggtacgtacggtaccgggttaccgaacgggggtacctaacggtacgtttaccgaaccgtacgttacgggtaaaaacggttccgaacggtaccccggggtacgggaacggtccgtacgggaagggtaacgttacgggttacggtaccgtaacgttttactttaacgtttcggtaccttacgttacggtaacgttaaaacgtttaaccgtaacggtaccgtttacggtttacgttaccggttttacgggacccggtaacggggtacccgtaacgttaccccggttaccggtaaccgttacgttaaacccg

SEQ ID NO: 257908 - DNA, 513 bp, Homo sapiens
  misc_feature: GYAE6OF01A21YC.29.21.B10.1.454.CMB.1.raw
  modified_base (416)..(416): a, c, t, g, unknown or other
  misc_feature (416)..(416): n is a, c, g, or t
tcagatagagtactcacgaccggtgctcgatttagtgtcgtcgcaagagaggagggggtgatcaggacttcctcagttcatcttctcaccatgaggctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttatgtaagtttccaagtcgtttatttggatgccagacaggctcgagtggcagcgggtcagggacagatttcacactagaaactcgaggccgggtggaggcgtgaggntgttggctatttattagttgacatgactaaagtttacagtcgttgttactacgttttcggaccgtagggacctactcgtaggactatacgtaaaccg

SEQ ID NO: 257909 - DNA, 503 bp, Homo sapiens
  misc_feature: GYAE6OF01ENG0C.29.21.B10.1.454.CMB.1.raw
  modified_base (471)..(471): a, c, t, g, unknown or other
  misc_feature (471)..(471): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagcctatatgtactggtacctgcagaagtcaggccagcctccacgactcctgatttatgaagtttccaagtcgttattttggagttgccagacaggctcagtggcaggcggtcgagggacagtnttcacactgaaaatcaggccgggtggaacggg

SEQ ID NO: 257910 - DNA, 682 bp, Homo sapiens
  misc_feature: GYAE6OF01C874T.29.21.B10.1.454.CMB.1.raw
  modified_base (319)..(319): a, c, t, g, unknown or other
  misc_feature (319)..(319): n is a, c, g, or t
  modified_base (366)..(366): a, c, t, g, unknown or other
  misc_feature (366)..(366): n is a, c, g, or t
tcagatagagtactcacgaccggtgctcgatttagtgtcgtcgcaagagaggagggggtgatcaggacttctcagttcatcttctcaccatgaggctccctgctcagctcctggggctgctaatgctctggatacctggatccagtggagatattgagatgacccagactccactctctctcgtccgtccacccctggacacgccggcctcatctcctgcaagtctagtcagacgcctcgtgcatagtgataggaaacgacctatatgtactggtacctgcagaagtcaggccacgccctcacgactcctagtacttanagtaacgttttccaaagttcgtttagtttggagtcgacctaaggacncggtacgttcgaggttcgggacgtaacgggtccggggtacgaacggggactaacggttatttaccaacgtaacgtaaggaaaacttccggaacgggtaccggggtaggacgggtcgtagggacgggtaggtttcggttacggtacgttaagttttaacgttagttcggtacctagttacgtaacgttaaaggtttaccgaggttaccgtttcggtttacccgttaacggttttccgggaaccccgggttaacggggtaacccttaccggttacccggttaagggtaaaccctaacgttaaacccggtaaaaccggg

SEQ ID NO: 257911 - DNA, 786 bp, Homo sapiens
  misc_feature: GYAE6OF01C9RXP.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctcgtgactaccgtgactccgaggtggagtattagttagagtatacgaccagacctcctactctctctcgtccgtcctacccgtacggaccacggcccgtcctacctactcctccgtcgactaacgttacgtacgtacgagaccgtccgttcggtcgacgtaagttaggtaggtaacgtaacgggtaaaacgtaaccttaagttacgtacggttacgttacggtaccgtagaacgtaaggtaacggtaccgacgggtacccgacgtccccgtaacccgaaccgttacccttaccgtttagttaacttttaacgaacggtttaaccgttttacccgtaaacggttttacggtttttaaggttttacgggacgttccggtaacccgtaagggaacccgtaggttaccctaggtaacgggttcgggaccggtacgggggtaccggggtaacgggtaaacggggtaaccttaaggtttaacccgtttaaccgaaaccgttaaacggttaaaacggtaaaaacgttcccgggaaaccggggggttcccggggggtaaggggtaaaccgggg

SEQ ID NO: 257912 - DNA, 808 bp, Homo sapiens
  misc_feature: GYAE6OF01CEZH7.29.21.B10.1.454.CMB.1.raw
  modified_base (165)..(165): a, c, t, g, unknown or other
  misc_feature (165)..(165): n is a, c, g, or t
  modified_base (167)..(167): a, c, t, g, unknown or other
  misc_feature (167)..(167): n is a, c, g, or t
  modified_base (172)..(172): a, c, t, g, unknown or other
  misc_feature (172)..(172): n is a, c, g, or t
  modified_base (178)..(178): a, c, t, g, unknown or other
  misc_feature (178)..(178): n is a, c, g, or t
  modified_base (185)..(185): a, c, t, g, unknown or other
  misc_feature (185)..(185): n is a, c, g, or t
  modified_base (191)..(191): a, c, t, g, unknown or other
  misc_feature (191)..(191): n is a, c, g, or t
  modified_base (194)..(194): a, c, t, g, unknown or other
  misc_feature (194)..(194): n is a, c, g, or t
  modified_base (203)..(203): a, c, t, g, unknown or other
  misc_feature (203)..(203): n is a, c, g, or t
  modified_base (206)..(206): a, c, t, g, unknown or other
  misc_feature (206)..(206): n is a, c, g, or t
  modified_base (219)..(219): a, c, t, g, unknown or other
  misc_feature (219)..(219): n is a, c, g, or t
  modified_base (226)..(226): a, c, t, g, unknown or other
  misc_feature (226)..(226): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcgngngtatnttgttnttctgtntcctcntcngctctcggnggntgactagcgctgngactcgngtcacgtaggtgatattagtagatagaccgaaccgacgtacctcctactctctcgtccgtcctacccaccggtacgacgccggcccgtcctactccgtcctcgacgaacgttacttcgtacgtacgacgtccgtccgtggctataacgttagagtacggtaaacggaaaccgttactattacggttacgttacgggttaccgttaccgtgaacggtaaggtaccgtacgggaccggtacgtacccgtacccgtaaccgtaaccgttcccgttcgttaaagttttaacttttacggtaaacgggttttaaccccttaacggtaaccggtttttacgttttttaacgggttacggggtaccgttacccggaaacgggtaacggttaaccgggtaccggttacctaacgggttaaggggtcccggtaaccgggtacggggggttccccgggtaaaacggggtaaccgggtaaagttaacggttttacctttaaacccccggaagtttaaaaccggtaaaaacggtttaaacccggttaccgggggtaaccccgggggggttcggggggtaaaaggggttcccggg

SEQ ID NO: 257913 - DNA, 511 bp, Homo sapiens
  misc_feature: GYAE6OF01EBSVN.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagactatatgtactggtacctgcagagtcaggccagcctccacgactcctgtatttatgtaagtttcaagtcgtttatttggagttgccagacaggctcgagtggcgaggcgggtcgagggacaggtctttacacactagaaactcgaggtccgggtggacggg

SEQ ID NO: 257914 - DNA, 577 bp, Homo sapiens
  misc_feature: GYAE6OF01AQZKR.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatcgacccagacctccactctctctcgtcccgtccacccctggacacgcccggccctccactcctcctgcaagtctagtcagacgcctcgtgctatagtgataggaaagactatatgtacgtcggtacctgacagaacgtcgacggccacgcctccgacgtacctcctgtactttatacgtaagtttccaagttcgtttagttttggagttcgaccgtaaggacgaggtacctacgacggtgaccgacggtcgggtacggagggtaccaggtacttacgaaccgtacgttaacgaaactccggaggtcccggggtgggaacggg

SEQ ID NO: 257915 - DNA, 581 bp, Homo sapiens
  misc_feature: GYAE6OF01A9HZJ.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctgggctgctaatgctctggatacctggatccagtggagatattgagatggacccagactccactctctctgtccgtcacccctggacacgccggcctccatctcctgcaagtctagtcagacgcctcgtgcatagtgataggaaagacctatatgtactggtacctgacagaagtcagccagcctaccacgactcctgtatttatagtaacgtttccaagtccgtttagtttggagttcgaccgtagacgaggtacccctagacggtggacgacggtaccggggtacgaacggggtaccgaggttaacttttaccgaacgtaaccgttaacggtaaaacgttaccgaacgggtcccgggggttagggtaacgggg

SEQ ID NO: 257916 - DNA, 681 bp, Homo sapiens
  misc_feature: GYAE6OF01EC7W0.29.21.B10.1.454.CMB.1.raw
  modified_base (402)..(402): a, c, t, g, unknown or other
  misc_feature (402)..(402): n is a, c, g, or t
tcagatagagtactcacgaccggtgctcgatttagtgtcgtcgcaagaggagagggggactgactcaggacttctcagttcatcttctcaccactgaggctccctgctcacgctccgtggggctagctaagtgcctcttggtataccgtggatccaggtcggagatattcgagatgacccagacctccactctctctcgtccgtccaccccgtggacaggcccggcctccactccgtcctgactaagtctagtcagcgcctcgtgcatagtgagtacggaaacgtccttatatcgttactggtacctgaccaggacgtccagggccaggccctacgacgtctccgtagtatttagacgtaacgtttaccaaaggtcgtttatttgggaactcgacgagacgnggctagagggtcgcgaggccgggtacgagggactagtacgtttacgacgtagtaacgaaacgtccgaacggtccggggtacgggacggtaccgtaggaacggtgtttacgggttacggtactttaagttttaacgtttagttcggtacgtaacgttaccggtaaccgtttaaacggttttaccgtagttccggttacggtttaccggttaccggttttacccgggacgggtacccggggtaccgtacgtacccgttagggaacctacggtaaacccggg

SEQ ID NO: 257917 - DNA, 581 bp, Homo sapiens
  misc_feature: GYAE6OF01AF1UW.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagactccacctctctctcgtcccgtccaccccgtggaccacgcccggcctccactcctcctgactaagtctagtcagacgtcctcgtgcatagtgagtaggaaacgtacctatagtacgttacgtcggttacctgacaagaacgtcgacggccacgccctaccgacgtacctcctagttatttacgtagtaacgtttaccgaagttccgttttagttttggacgtcgacctagacgaggtctacgaggtcggcgacggcgggtacgacgggtacaggtacttacactacgtaacgaaactcgacgggtccgggtgggacgg

SEQ ID NO: 257918 - DNA, 544 bp, Homo sapiens
  misc_feature: GYAE6OF01EATEB.29.21.B10.1.454.CMB.1.raw
  modified_base (256)..(256): a, c, t, g, unknown or other
  misc_feature (256)..(256): n is a, c, g, or t
tcagatagagtactcacgaccggtgctcgatttagtgtcgtcgcaagatagagggggactgatcaggacttctcagttcatcttctcaccatgatgctccctgctcagctcctggggctgctaatgctctggatacctggatccagtggagatattgagatgacccagactccactctctctgtccgtcacccctggacagccggcctccatctcctgcaagtctagtcagagcctcgtgcatagtgataggaaanacctatatgtactggtacctgcagagtcaggcagcctcacgactcctgatttatagtaagtttccaagtcgtttatttggagtgaccagacaggctacgaggtggcgacggcgggtacgagggacagtactttcaactactagaaactcgaggccgggtggacgtgaggagtgtggtagtattattattagtgtactagtacgtaaacgttaagttacgtcgttagttacgttacgtttacggtttcggacgggtaccggtactaccggttacgtcggtaactaaacg

SEQ ID NO: 257919 - DNA, 644 bp, Homo sapiens
  misc_feature: GYAE6OF01CB0PS.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagacctccactctctctcgtcccgtccaccccgtggaccacgcccggcctcccatcctcctgcctaagtcctagtcagacgcctcgtgctatagtagataggaaatacctatatgtactggtacctgacagaagtcgacggccacgtcccctaccgaccgtaccctcccgttagtaacttttagtacggttaaaccgttttcccgaaaggtttccggttttaagtttttcgggaggtttccgacccgtaaggtaccgtaagggtcccttacggaagggttcgggaaccgaggggtccggggtcggaacggggtaactaggttactttccgaaaccgtaacgttaacggaaaaacttcggaacggggtccggggtgggtaacggg

SEQ ID NO: 257920 - DNA, 527 bp, Homo sapiens
  misc_feature: GYAE6OF01A7JZ2.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagactccactctctctgtccgtccacccctggacacgccggcctccatcctcctgcaagtctagtcagacgcctcgtgcatagtgatggaaagacctatatgtactgtacctgcagaagtcaggccagcctccacgactcctagtatttatagtaacgtttccaagtcgtttagttttggacgttgaccagacaggtctcgagtggcagggcgggtacgagggacaggtcttcactacgtaagaaactcgacgggccgggtggacgg

SEQ ID NO: 257921 - DNA, 521 bp, Homo sapiens
  misc_feature: GYAE6OF01E0XBU.29.21.B10.1.454.CMB.1.raw
  modified_base (361)..(361): a, c, t, g, unknown or other
  misc_feature (361)..(361): n is a, c, g, or t
tcagatagagtactcacgaccggtgctcgatttagtgtcgtcgcaagaggagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatattgagatgaccagactccactctctctgtccgtcaccctggacagccgcctccatctctgcaagtctagtcagagcctgtgcatagngatggaaagcctatatgtactggtactgcagagtcaggccagcctccgacgcctccgtgtatttagtaggtaacgtttccgaagttccgttttagtttgggacgttcgaccgaggaccgaggcttcgtaggttcggacacgggtccgggtcgtaacgggg

SEQ ID NO: 257922 - DNA, 1056 bp, Homo sapiens
  misc_feature: GYAE6OF01BGAD2.29.21.B10.1.454.CMB.1.raw
tcagatagagtactcacgaccggtgctcgatttagtgtcgtcgcaaggagagaggggtcaggctggaactgaggagcaggtggggcacttctcctctaacactctccctgttgaagctctttgtgacgggcagctcgacggcctgatgggtgacttcgcaggcgtagactttgtgtttctcgtagtctcctgctcagtctcgtgggctgctaagtgctctggactaccgtggactccgaggtggacgtattacgttggaacgtacgttcgaacccgtagtaccttaccgtaccttcgttaccgttcgttcggttaccccgtaccgtaccccgtagggtacctaccggtcccggtaccttaccgtaacgttcccgttaccgtacggtaccgttaaacggttccgttaacggtacgtaacggtaaccgttcccgttaccggttagtaccgttaacggttacggtacggtaaacgttaacgggtaaacgttacccgttaaagtttaaccggttacggtttaaccgttacggggttaacccttagggtaacccgtaaagggttaaaccggttccgaaacgggtccccgtaaacggtccccgttaaccgtaacggttaccgttacccgttaaggttaacgtttacgtacggttaaccggtttaccgtaaggtttccgtttaaggttggaccccccgggggggtttttttaaaaacccggtaaccccgggttttaaaccggggtttaaccccgggtttaaacgggggttttaaacccccggtttaaacccgggggtttaaacccggggtttaacccgggggtttaaccccggtttaaaccccgggggttaaacccggggttttaaacccgggtaaacccgggggttttaaacccgggtttaaacccgggttttaaaccccgggtttaaaccccgggttaaaccccggggttttaaaacccggggtttaaaacccgggtttaaaccccggggttttaaacccggggtttaaaccccgggggttttaaccccggggtttaaaccgggggtttaaacccccgggg

SEQ ID NO: 257923 - DNA, 623 bp, Homo sapiens
  misc_feature: GYAE6OF01CNIXO.29.21.B10.1.454.CMB.1.raw
  modified_base (534)..(534): a, c, t, g, unknown or other
  misc_feature (534)..(534): n is a, c, g, or t
  modified_base (569)..(569): a, c, t, g, unknown or other
  misc_feature (569)..(569): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctccgtggggctgctaatgctctggactaccgtggactccgaggtggaagattagttgagtatcgacccagacctccactctctctcgtcctccacccgtggaccacggcccggccctaccacttcctccgtcgactaacgttcctagtcgaagaccgtccgttcgtcgactaagtagtacgaagtacggaaacgtactattagtacgtacgtacggtacctgacgaagaacgtcgacgccacgtccctaccacgtcctacgtagttactttaagtacgttaacgtttacaaggttcgttttagttttggacgtcgaccgtagacgcgtacngtacggtgacggacgggccgggtaggacgggtaanaggttacttacaacgtagtaaacgaaactcggaacgggtccggggaggtacggg

SEQ ID NO: 257924 - DNA, 684 bp, Homo sapiens
  misc_feature: GYAE6OF01E4XAO.29.21.B10.1.454.CMB.1.raw
tcagatagagtactcacgaccggtgctcgatttagtgtcgtcgcaaggagaggagggggactgatcaggacttctctagttcatcttctcaccatgaggcctccctgctcagctccgtggggctgctaatgctctggactacctggatccagtggagattattgagatcgacccagacctccactctctctcgtccgtccaccccgtggacacggcccggccctaccactcctcctgactaacgttctagtcaaggacgtccctcggtcgactaagtaggtagagttaagggaaaacgtaccttatagttacgttacgtcggttacctgaccgaaggtaacgtcgaacggtccacgtcccctacccgaacgtaccttccgtagtactttagtacggttaacgtttaccgaaaggttcgttttagtttggacgtcgaccgaagacgaggtctacgtaggtcggacgacgggtcgggtacgagggtacagttactttaccaactacgtaagtaaactcggacgggtccggggtagggacggtcggtagggtaggtagtttgggtcgtacttaagttttatttagtcgtagtagttagacttaaaacggttagacgttcttaggttacctttacggtttcggaccggtaacgggtacctacgttaccggtacgacgtagtaaacccg

SEQ ID NO: 257925 - DNA, 521 bp, Homo sapiens
  misc_feature: GYAE6OF01E5YXP.29.21.B10.1.454.CMB.1.raw
  modified_base (350)..(350): a, c, t, g, unknown or other
  misc_feature (350)..(350): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagactccactctctctgtccgtcacccctggacacgccggcctccatctcctgcaagtctagtcagagcctcgtgcatagtgatggaaanactatatgtactggtactgcagaagtcaggccagcctccacgactcctgtatttatgtaacgtttacaagtcgtttagttttggagtgccgtagacgaggctcgagtggcgaggcgggtacgagggacagtactttacactactagaaactcgaggtccggggtggtacgg

SEQ ID NO: 257926 - DNA, 534 bp, Homo sapiens
  misc_feature: GYAE6OF01EFXJ8.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagactccactctctctgtccgtccacccctggacacgcccggcctccatcctcctgcaagtctagtcagacgcctcgtgcatagtgataggaaacgactatatgtactggtacctgacagacgtcaggccacgcctccgacgacctcctgtatttatagtaagtttcaagtcgtttagtttggagttgcctagactaggtctacgagtacggcgacggcgggtcgagggaacagtacttacacgacttagaaactcgaggtccgggtgggacgg

SEQ ID NO: 257927 - DNA, 617 bp, Homo sapiens
  misc_feature: GYAE6OF01D05T6.29.21.B10.1.454.CMB.1.raw
  modified_base (525)..(525): a, c, t, g, unknown or other
  misc_feature (525)..(525): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgttgtttctcgtagtctccctgctcagctccgtggggctgctaatgctctggatacctggatccagtggagatattgagatcgacccagacctccactctctctcgtcccgtccaccccgtggaccgacggcccggccctccactcctcctcgactaagtctacgtacgagtacgtcctcggtcgacgtatacgtgaagtaaggaaacgtacttatattaggtacgtacggttaccctagacgaagaacgtcgacggccagtccctaccacgtaccttcgtagttacttagtacgtaacgtttccgaaagtttccgtttaagttttgggacgtacgacgtagtaaccgnggtctacgaggtcggcgtaggcggtaaggacgggtatacggtacttaccgaactaacgtacgaaaacgttcggacgggtccggggtggacgg

SEQ ID NO: 257928 - DNA, 822 bp, Homo sapiens
  misc_feature: GYAE6OF01B6MNA.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctccgtggggctgctaatgctctggatacctggatccagtggagatattgagatgacccagacctccactctctctcgtccgtccaccctggaccacggcccggcctccatcctcctcgactaagtctagtcagacgcctcgtgactagttagtagaagttacggaaaacgtacccgttataacgttaggttaaccgttacggggttaaccctggtaccgtaaagggtaaacggttaccgaaccgggtaccccgtaaccggtacccctttaaccccgaacccggttaaacccctttccccgtttagggttaaaccttttttaaacgtttaaccggttaaaccgggtttttaacccgtaaaacgggttttaccggttttttaaaggttttttacggggtaacggtttcgggtaaccccgttaaacgggtacccggtaaacggggtcccgttaccggtaacgggttaccggggtaaccgggtaccggggtacccggggttaccgggtaaaacgggggtaaccgtaaacgggttaacccgtttttaaccgaaaccgtaaaccgttaaacggtaaaaaacgttaccggtaaaccggggtaccggggtaacgggggtaaacgggg

SEQ ID NO: 257929 - DNA, 699 bp, Homo sapiens
  misc_feature: GYAE6OF01C8YJT.29.21.B10.1.454.CMB.1.raw
  modified_base (248)..(248): a, c, t, g, unknown or other
  misc_feature (248)..(248): n is a, c, g, or t
  modified_base (575)..(575): a, c, t, g, unknown or other
  misc_feature (575)..(575): n is a, c, g, or t
tcagatagagtactcacgaccggtgctcgatttagtgtcgtcgcaagagaggagggggtgatcaggacttctcagttcatcttctcaccatgaggctccctgctcagctccgtggggctgctaatgctctggatacctggactccaggtggagatattgagatcgacccagacctccactctctctcgtccgtccacccgtggacacggcccgcctccatcctctgacaagtctagcaggacgcctgngacagtagtgaagtaggaaaacgtccttaatacgtagtacgtcggtacctgacgaagacgtcgacggaccacgtccctaccgacgtaccttctagttactttagtacgtaacgtttcaaaggttctttagttcggagtacgaccgaagtacgacggtctaggaggtcgacggagggtaccggtaggaacggtactaacggttactttaccgaacgtaacgtaaaggtaaaccgtcgggaacgggtacccgggggtaagggtaaccgggtacgttaaggggaacggttaagttcgggttaggttaactttaagtttatttagtacgtntaagttacgtaaacttaacgttaacgtcggttccgtttaggtaccgttttaacggtttccgggaacccggttaaggggtacctaccggttacggtaacggtaacctaacgtaaacggtaaaccg

SEQ ID NO: 257930 - DNA, 552 bp, Homo sapiens
  misc_feature: GYAE6OF01DKQ3D.29.21.B10.1.454.CMB.1.raw
  modified_base (340)..(340): a, c, t, g, unknown or other
  misc_feature (340)..(340): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgaccagactcactctctctgtccgtcacccctggacagcccgcctccatctcctgcaagtctagtcagacgctcgtgctatagtnaagtggaaagacctatatgtactgtactgcagaagtcagccagccaccacgactcctgtatttagtagtaacgtttcaaggttcgtttaagtttaggtacgtcgacctagacgacgtactcgtaaggtggacgtagggacgggttcgaacggggtaacagttactttacgaccaacgtaagaaaacgtcgaacggtccggggtgggtaacgg

SEQ ID NO: 257931 - DNA, 582 bp, Homo sapiens
  misc_feature: GYAE6OF01BWQLO.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagactccactctctctgtccgtcacccctggacacgccggcctccatcctcctgcaagtctagtcagacgcctcgtgcatagtgataggaaagtacctatatgtactggtacctgacaagtaagtcacggccagccctcccacgtaccttccgtagtactttatagtaacgttttccaagttccgtttagttttggacgttcgcctaggactacggtctacgaggtcggcacgggtccgggtacgacgggggtactaaggttactttaccgaacttaacgtaacgaaaacgttccggacgggtccgggggtggtaaccgggg

SEQ ID NO: 257932 - DNA, 614 bp, Homo sapiens
  misc_feature: GYAE6OF01BHRHB.29.21.B10.1.454.CMB.1.raw
tcagatagagtactcacgaccggtgctcgatttagtgtcgtcgcaaggagagagggggtcaggctggaactgaggagcaggtgggggcacttctccctctaacactcctcccctgttgaagctctttgtgacgggcgagctcaggccctgatgggtgacttcgcaggcgtagtactttgtgtttctcgtagtctccctgctcagtctccgtggggctgctaatgctcgtggatacctggactccgaggtggagattatgagatacgaccagacctccactctctctcgtcctccaccctgacacgccgcctccactcctctgactagtctagtacagacgtcctcgtcgactagtaggtagaagtaacggaaacgtactagtagtacggttaacgtcgtaccgtgaacgtagaacgtaccgtacggacctacgtcccctacgtaacgtaccttctagttaattaacgttacgtaactttacgtaacgttgttttacgttggtacgtcgaccgtagtaccgagtccgtagacggtgacgagggtccggtacggtacggactaggttaactacgacgtaacgtacgaaagtcgtaacgggtcgggtagggtaacgg

SEQ ID NO: 257933 - DNA, 716 bp, Homo sapiens
  misc_feature: GYAE6OF01CR1CY.29.21.B10.1.454.CMB.1.raw
  modified_base (249)..(249): a, c, t, g, unknown or other
  misc_feature (249)..(249): n is a, c, g, or t
tcagatagagtactcacgaccggtgctcgatttagtgtcgtcgcaagagaggagggggtgatcaggacttctcagttcatcttctcaccatgaggctccctgctcagctccgtggggctgactaatgctctggataccgtggatccaggtggagatagttgagatcgacccagacctaccactctctctcgtccgtccacccgtggacacgcccgccttccattcctcctagactaacgttctacgganaggacgtcctcgtgactagtagtagtagtaaggaaaactcttaatagtacgttacgtcggtaacctggaacaaggtaacgtacaccggaccgactcccgtaccaacgtaccttcgtaagtactttagacgttaacgttactaaagttctttaggtttaggaagtcgacagtacgaggctacgaggtcgcggtacgggtcgggacgaacgggaacgtacttacttaaccgaacgtaacgtaagaaaacgttcggaacggggtccgggtaggacggtcgaggtaaggtgtttggttacgtaatttaagttttattagtagtaccgtaaggttacgtaaacgtttaaagttcgtaagggtccgttttcgttaaccggttttacgggtttaccgggaacccgggtaacggggttaaaccctcccggttaacgtaacgggtaaaccttaacgttaaaacccgggtaaaacgg

SEQ ID NO: 257934 - DNA, 626 bp, Homo sapiens
  misc_feature: GYAE6OF01A96J8.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctccgtggggctgctaatgctctggatacctggatccagtggagatattgagatgacccagacctccactctctctgtccgtccacccctggacacgcccggcctccatcctcctgacaagtctagtcagacgcctcgtgcatagtgagtaggaaacgacctatatgtactcggtacctgacgaagtagtcgacgccacgtccctaccgacgtaccttcctagtaacttttacgtagtaacgttttaccgaaggttccgttttaagttttgggagtcggacctaaggacgtacggtcttacgagggttcggaccgtagggtccggggtacgaacgggggtaactaacggttacctttaccgaaacgttaacgttaaacggtaaaactcccgggtaaggggtcccgggggtaaggggtaacgggg

SEQ ID NO: 257935 - DNA, 527 bp, Homo sapiens
  misc_feature: GYAE6OF01D9TC4.29.21.B10.1.454.CMB.1.raw
  modified_base (295)..(295): a, c, t, g, unknown or other
  misc_feature (295)..(295): n is a, c, g, or t
  modified_base (454)..(454): a, c, t, g, unknown or other
  misc_feature (454)..(454): n is a, c, g, or t
  modified_base (487)..(487): a, c, t, g, unknown or other
  misc_feature (487)..(487): n is a, c, g, or t
tcagatagagtactcacgaccggtgctcgatttagtgtcgtcgcaaggagagagggggtcaggctggaactgaggagcaggtgggggcacttctcccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagactccactctctctgtccgtcacccctggacngccggcctccatctcctgcaagtctagtcagagcctgtgcatagtgatggaaagacctatatgtactggtacctgcagtacgtcacggccacgcctaccacgacctcctagtactttatcgtaagtttccaagtcgtttacgtttggagtgccagacgnggactacgagtcggcgaggcggtacgacggganaggtatttccacactagaaaatcgacggcgggtggacggg

SEQ ID NO: 257936 - DNA, 613 bp, Homo sapiens
  misc_feature: GYAE6OF01CGU06.29.21.B10.1.454.CMB.1.raw
  modified_base (311)..(311): a, c, t, g, unknown or other
  misc_feature (311)..(311): n is a, c, g, or t
  modified_base (326)..(326): a, c, t, g, unknown or other
  misc_feature (326)..(326): n is a, c, g, or t
  modified_base (333)..(333): a, c, t, g, unknown or other
  misc_feature (333)..(333): n is a, c, g, or t
  modified_base (523)..(523): a, c, t, g, unknown or other
  misc_feature (523)..(523): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcgaggccctgatgggtgacttcgcaggcgtagtactttgtgtttctcgtagtcctccctgctcagtctccgtggggctgctaatgctcgtggataccgtggactccgagtggagtattagttgagatacggaccagacctcactctctctcgtccgtccacccgtggaccncgcccggtcctaccnctcctcncgactaacgtctacgtcgaacgcgtcctacgtgactagtaggtgaacgtaggaaactactaagtacgtagttacgtcggttacagacgaaggtactcgacgaccacgtccctacgacgtctcgtagttattacgtaagttaacttaccgtaagtttacggtttagtttacggagtcgtaccgaagtacgnggtctacgagtcggcgtaggccgggtacgagggaactagtaccttcgaaacgtacgtaacgtaaacgtcggacgggcggggtagtacggg

SEQ ID NO: 257937 - DNA, 835 bp, Homo sapiens
  misc_feature: GYAE6OF01CX2M6.29.21.B10.1.454.CMB.1.raw
  modified_base (210)..(210): a, c, t, g, unknown or other
  misc_feature (210)..(210): n is a, c, g, or t
tcagatagagtactcacgaccggtgctcgatttagtgtcgtcgcaagagaggagggggtgatcaggacttctcagttcatcttctcacatgaggctccctgctcagctccgtggggctgctaatgctcgtggataccgtggactccagtggagtatattgagatacgaccagacctccactctctctcgtcccgtccaccccgtggaacncgcccggtcctcctactcctcctgactaacgttctagtcgaggacgtcctcgtcgactagtagtagaagtaaggaaacgtactatagtacgtacgtcggtacctgacgaagacgtacgacggcctacgaccccgtacctaacgtcctccgttagttaactttaagttacggttaaacgtttacgtaagtttcgtttaaggtttacgggagtacgtaccgaacgggtacgacggtcctaggtaggtcgggaccggtaggggtaccgggtacgaacggggtaactacggttaaccgtttaccgaaacgttaaacgtaaaggtaaaaccggtccgggtaacgggggtcccggggtaaggaaggggttacgtacggggtaagggtaaggttttgggtaaccggtttaattttaagtttttaaggtacgttaacgggacttaaggttaaaccggttaacgtttaaaaagggttcccgttaaggttacccggtttttaacggtttaaccccggttttaaccgggggttttacccggggtaaacccccgggtaaacggggttaccccttttaacggtaccccgggtttaaagggaaaaacctttaccggtaaaacccgggttaaaaaccggg

SEQ ID NO: 257938 - DNA, 673 bp, Homo sapiens
  misc_feature: GYAE6OF01C9M8A.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctccctgttgaagctctttgtgacgggcgagctcaggccctgatgggtgacttcgcaggcgtagactttgtgtttctcgtagtctccctgctcagctcctggggctgctaatgctctggatacctggatccagtggagatatgagatgacccagacctccactctctctgtccgtccacccgtggaccaggcccggtcctccatcctctgactaagtctagtcagacgcctcgtgactagtacgtagaagtaggaaacgtacctattactacggttaacttcggtacctggactaagtaacgtacgaacggcctacgccctaccgaaccgtacccttccgtagttaacttttagtacggttaaacgttttacccgtaaaggttccgtttttaaggttttacgggacgttcgacccgtacggaacgtacggtccttacgagggttcgggcgtaacgggtccgggggtacgaacggggaacttaagggttaactttacccgaaacgttaaaccgttaaacggaaaaacgttccgggaacggggtcccgggggttaggggtaaaccgggg

SEQ ID NO: 257939 - DNA, 704 bp, Homo sapiens
  misc_feature: GYAE6OF01AYP1V.29.21.B10.1.454.CMB.1.raw
  modified_base (215)..(215): a, c, t, g, unknown or other
  misc_feature (215)..(215): n is a, c, g, or t
  modified_base (254)..(254): a, c, t, g, unknown or other
  misc_feature (254)..(254): n is a, c, g, or t
tcagatagagtactcacgaccggtgctcgatttagtgtcgtcgcaagagaggagggggtgatcaggacttctcagttcatcttctcaccatgagctccctgctcagctccgtggggctgctaatgctctggatacctggatccagtggagatattgagatcgacccagacctccactctctctcgtcccgtccaccctggacacgcccgcctccntcctcctgcacgtctagtcagactcctcgtgctagtagngagtaggaaactactatagtgtacgtacgtactgacaaggtacgtcgacggaccacgtccctaccgacgtaccttccgttagttaatttagtacgttaacgtttccgtaagtttacgttttagtttacgggagttacgaccgacgtacggacggtacctacggaggttcggacgtacgggtccggggtaacgtacgggaacctagttaccgttaaccaacgtacgtaaacgtaaacgtcggtaacgggcgggtaggacgggtcgtaggaggtacggttggttacggttacttaagttttagttattcgaacgttagtaacgttaacgttaaaactttacggaccgttttcgttacggtttcccggttaacggtttcgggacccggttaaacggggtaacccttcgggtttaaccccgaagttaaccgtaaccgttaaaccggtaaaccgg

SEQ ID NO: 257940 - DNA, 746 bp, Homo sapiens
  misc_feature: GYAE6OF01DE2VQ.29.21.B10.1.454.CMB.1.raw
  modified_base (222)..(222): a, c, t, g, unknown or other
  misc_feature (222)..(222): n is a, c, g, or t
tcagatagagtactcacgaccggtgctcgatttagtgtcgtcgcaagagaggagggggactgatcaggacttctcagttcatcttctcaccatgaggctccctgctcagctccgtggggctgctaatgctctggatacctggatccagtggagatatgagatcgaccagacctccactctctctgtcccgccacccgtggacacgccggcctccatcctccngacaagtcctagtcagcgcctgtcgactaagtagtgaagtaggaaaacgtaccttaatatacggttaccgttacgggtacctggacgaaggtaagtccgacggtccacgtcccctaccaaccgaccttccgtaagttactttaataggttaaacgttaccgtaaaggttcgttttaagttttgggacgtcgtacccgaggtaacgtacgggtacttacggacgggtcgggaccgtacgggaccgggggttacgaacggggaactaacggtttaacttaccgaaacctaacgttaaaggtaaaacgttccggaaccggggtaccgggggtaggaacgggtcgttagggacgggttagttggggtttaggtaactttaggttttaattaagttcggtacaaggttcgtaaaccgttaaaagttttcggaacgttccgtttaggtttaccgtttacgggtttacgggaacccggtaaccggggttaacctacggttacccggtaacggtactaaacgttaaacccgg

SEQ ID NO: 257941 - DNA, 584 bp, Homo sapiens
  misc_feature: GYAE6OF01EPKX9.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctccgtggggctgctaatgctctggatacctggactccagtggagatattgagatcgacccagacctccactctctctcgtccgtccacccctggaccacggcccggtccctccactccctcctgcctaagttctagtcagacgtcctcgtgactatagtgaagtacggaaatacctatatgtactcggtactgacaagactcgacgccacgccctaccaacgtccttcctagttattactagtaacgtttacaagttcgtttaacgtttggacgttcgactagacgtagctcgaggtcggacgtacgggcgggtacgaacggggtacaggtttacttaccaacgaacgttaaggaaatccggacgggtcggggtgggacgg

SEQ ID NO: 257942 - DNA, 550 bp, Homo sapiens
  misc_feature: GYAE6OF01CC0WZ.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagactccactctctctgtccgtcacccctggacacgccggcctccatcctcctgcaagtctagtcagacgcctcgtgcatagtgatggaaagacctatatgtactgtacctgcagaagtcgacggccagcctaccacgacctcctgtatttagtagtaacgtttccgaagttacgtttagttttggtagtacgtccagacgagtccgtacgtaggtcggcgacggtcgggtacgagggacaggtactttcgaactactacgaaaactcgaacgggccgggtggtaacggg

SEQ ID NO: 257943 - DNA, 582 bp, Homo sapiens
  misc_feature: GYAE6OF01BBWRJ.29.21.B10.1.454.CMB.1.raw
  modified_base (340)..(340): a, c, t, g, unknown or other
  misc_feature (340)..(340): n is a, c, g, or t
tcagatagagtactcacgaccggtgctcgatttagtgtcgtcgcaaggagagagggggtcaggctggaactgaggagcaggtgggggcacttctccctctaacactctcccctgttgaagcttctttgtgacgggcgagctcaggccctgatgggtgacttcgcaggcgtagactttgtgtttctcgtagtctccctgctcagctccgtggggctgctaatgctctggatacctggatccagtggagatattgagatggacccagacctccactctctctcgtccgtcacccctggaccagccggcctccatctcctgcagtctagtcagacgtcctcgngcagtagtgagtacggaaagacctatatgtactggtacctgacagtacgtcgacgcccagccctccacgtacctcctgtatttagtagtaacgtttaccaagttcgtttaacgttttgggacgttgaccgtagtaccgaggtctacgaggtcggacgagggaccgggttacgacggggtactaggtactttaccgaacgtaacgtacgaaaactcggaacggggtccggggtagggtacggg

SEQ ID NO: 257944 - DNA, 633 bp, Homo sapiens
  misc_feature: GYAE6OF01DFV9B.29.21.B10.1.454.CMB.1.raw
  modified_base (248)..(248): a, c, t, g, unknown or other
  misc_feature (248)..(248): n is a, c, g, or t
  modified_base (298)..(298): a, c, t, g, unknown or other
  misc_feature (298)..(298): n is a, c, g, or t
  modified_base (318)..(318): a, c, t, g, unknown or other
  misc_feature (318)..(318): n is a, c, g, or t
  modified_base (563)..(563): a, c, t, g, unknown or other
  misc_feature (563)..(563): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctccgtggggctgactaatgctctggatacctggatccgagtgganatattgagatgaccagactccactctctctcgtccgtcaccccgtggacncggccgcctccatcctcctnactaagtctagtcagacgcctcgtgactatagtagagtacggaaactactatagtagtacgtacggtacctagacgaagaacgtcgacggcctaacgcccgttaccgaaccgtacctaccgtagttaactttaaacgtagttaaccgtttaccaaaggtttccgttttaaggtttcggtaagttcgacctaagtaccgaggtcctacggaggtcggacgacgggtaccggtaggaaacggggtanaacggttactttacgaaacgtaacgtaaacgtaaaaacgtcggtaacggggccgggtaggggtaaccggg

SEQ ID NO: 257945 - DNA, 631 bp, Homo sapiens
  misc_feature: GYAE6OF01BVMCB.29.21.B10.1.454.CMB.1.raw
  modified_base (60)..(60): a, c, t, g, unknown or other
  misc_feature (60)..(60): n is a, c, g, or t
  modified_base (85)..(85): a, c, t, g, unknown or other
  misc_feature (85)..(85): n is a, c, g, or t
  modified_base (153)..(153): a, c, t, g, unknown or other
  misc_feature (153)..(153): n is a, c, g, or t
  modified_base (164)..(164): a, c, t, g, unknown or other
  misc_feature (164)..(164): n is a, c, g, or t
  modified_base (204)..(204): a, c, t, g, unknown or other
  misc_feature (204)..(204): n is a, c, g, or t
  modified_base (249)..(249): a, c, t, g, unknown or other
  misc_feature (249)..(249): n is a, c, g, or t
  modified_base (419)..(419): a, c, t, g, unknown or other
  misc_feature (419)..(419): n is a, c, g, or t
  modified_base (538)..(538): a, c, t, g, unknown or other
  misc_feature (538)..(538): n is a, c, g, or t
tcagatagagtactcacgaccggtgctcgatttagtgtcgtcgcaagagaggagggggtnatcaggacttctcagttcatcttcncaccatgagctccctgctcagctccgtgggctgactaatgctctggataccgtggactccgagtgganatattgagtancgaacccagacctccactctctcgtcgtcccgtcacccgnggaccacgcccgcctacactcctctagactaacgtctagcaagcnccgtgtcatagtaggtagaagtaacggaaactacctaagtagttacgtaacgttcggacctgaacgtaagtaacgcgacggaccacgccctacgaaccgtctacgtagtaattacgtagtaacttcgtaagttgtttacgtggacgttcgaccgagacgtacggtctagnggtacggcgagggacgtaggacgtacgattactacgaacaacgtaagaaacgtcggaaggtcgggtgaggtacgaggtagtaggttgtacggttactttaagtttatcgttacgagtanaacggttattaaagtctaacgtttcgtttcgtacgtttaggtcccggacggacgtaactacgtacccgaaggacctaaacgtaactaaacggg

SEQ ID NO: 257946 - DNA, 596 bp, Homo sapiens
  misc_feature: GYAE6OF01BQLFF.29.21.B10.1.454.CMB.1.raw
  modified_base (355)..(355): a, c, t, g, unknown or other
  misc_feature (355)..(355): n is a, c, g, or t
  modified_base (546)..(546): a, c, t, g, unknown or other
  misc_feature (546)..(546): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtcctccctgctcagctcgtggggctgctaatgctctggactaccgtggactccgagtggagtatattgagtatcgacccagacctcctactctctctcgtcccgtccacccgtggaccacggcccggtccctccatcctcctgactaagtctagtcagacgcctgngcagtagtgagtaggaaactactatatgtacgtggtacctgacgaagtacgtcgacggccacgccctaccgacgtcctcgttagtatttagtacgttaacgtttacgtaaggttcgttttagtttcgggagttcgaccgtagacgtacggtctacgtagggtcggacgtacgggccgggtagacgggtaanacgttacttaccgactaacgtagaaacgtcgacgggtccgggtaggacgg

SEQ ID NO: 257947 - DNA, 705 bp, Homo sapiens
  misc_feature: GYAE6OF01CFAJA.29.21.B10.1.454.CMB.1.raw
  modified_base (154)..(154): a, c, t, g, unknown or other
  misc_feature (154)..(154): n is a, c, g, or t
  modified_base (269)..(269): a, c, t, g, unknown or other
  misc_feature (269)..(269): n is a, c, g, or t
  modified_base (360)..(360): a, c, t, g, unknown or other
  misc_feature (360)..(360): n is a, c, g, or t
tcagatagagtactcacgaccggtgctcgatttagtgtcgtcgcaagagaggagggggactgatcaggacttctcagttcatcttctcaccatgaggctccctgctcagctccgtggggctgctaatgctctggactacctggatccagtgganatatgagagtcgacccagacctccactctctctcgtccgtccacccgtggaccacggtcccggccctacctactcctcccgtgaccgtaagtcttagcaggtacgtcctcggtancaagtaggtgaacgtaggaaactaaccttatagtacgtacgtacggtacctggacaagtaacgcgacggccacgccctaccactacctctntactttaagagtaacgttacaagttcgtttagtttggacgtcgtacgagacgtacgctagcgggtgacgcgggtacgggacgacgggtaatcgttacgttaacaacgtaacgtaacggtaaactcgggtaaacgggcggggtagggacggtacgagggtacggtaaggttcggtagttacgttattttaaagtgttagtacgtaacgttacgtaaacgtttaacgttaagtccggtttaaccgtttgggttaaaccttttacgggtttacccggggacggttaaaaccgggtacccggttaaccgtttacgggaaccgtaaacccgttacggtaaaaaccccggg

SEQ ID NO: 257948 - DNA, 652 bp, Homo sapiens
  misc_feature: GYAE6OF01BKCBN.29.21.B10.1.454.CMB.1.raw
  modified_base (210)..(210): a, c, t, g, unknown or other
  misc_feature (210)..(210): n is a, c, g, or t
  modified_base (262)..(262): a, c, t, g, unknown or other
  misc_feature (262)..(262): n is a, c, g, or t
tcagatagagtactcacgaccggtgctcgatttagtgtcgtcgcaagagaggagggggtgatcaggacttctcagttcatcttctcaccatgaggctccctgctcagctccgtggggctgctaatgctctggatacctggatccaggtggagatattgagatgacccagacctccactctctctcgtccgtcaccctggacacgccgccncatctcctgcagtctagtcagacgtcctcgtgacatagtgagtacgggaaanacctatatgtactggtacctgacagacgtcgaggcccacggccctaccaacgtaccttccgttaggtaacttttagtagtaaacgttttccgaaaggttcgttttaagtttgggacgttcgaccaaggtacgaggtactcgaggtcggacgacgggtcgggtacgaaggggtactaggtactttacgaactaacgtaacgtaaactcgaacgggtaccggggtagggacggtcgttagggaagggtagttggttacgggtacttaagttttagtttagttcgtactaagttagaacgttaaaggtttaccgaggttacgttgttaccttacggtttcgggaccggtacggggtaccctacgttccgtaggaactacgtaacgtaaaccgg

SEQ ID NO: 257949 - DNA, 688 bp, Homo sapiens
  misc_feature: GYAE6OF01C3E8I.29.21.B10.1.454.CMB.1.raw
  modified_base (210)..(210): a, c, t, g, unknown or other
  misc_feature (210)..(210): n is a, c, g, or t
  modified_base (259)..(259): a, c, t, g, unknown or other
  misc_feature (259)..(259): n is a, c, g, or t
  modified_base (582)..(582): a, c, t, g, unknown or other
  misc_feature (582)..(582): n is a, c, g, or t
tcagatagagtactcacgaccggtgctcgatttagtgtcgtcgcaagagaggagggggtgatcaggacttctcagttcatcttctcaccatgaggctccctgctcagctccgtggggctgctaatgctctggataccgtggatccgagtggatatattgagatcgacccagacctcccactctcctcgtcgtcccgtccacccgtggacncgccggcctcatctcctgactaagtctagcagcgcctgtgactagtagngaagtaaggaaactactaattgtgttacgtacggtacctgacaagtacgtcgacggccaacgtccctaccacggtacctcgtagttatttaagtacggtaactttaccgaagtttcgtttaagttcgggatcgaccaaggacgacgggtcctaggaggtacgggcgtaagggtccggggtacgaacgggtacgtaacgttaacgtttaaccgaaccgtaacggtaaagtaaaaccggtcggtaacggggaccgggggttagggaagggtcgggtaggaagggttacggttaggttaggttactttaagttttacttaagttanactaggtacgttaaagttaacgttacgtacgttacgtttcgttagtttaccggttcgggacccgtaacgggactacgtacgtagaaccctaaagtaaccgaaacgg

SEQ ID NO: 257950 - DNA, 704 bp, Homo sapiens
  misc_feature: GYAE6OF01DTAVZ.29.21.B10.1.454.CMB.1.raw
  modified_base (205)..(205): a, c, t, g, unknown or other
  misc_feature (205)..(205): n is a, c, g, or t
tcagatagagtactcacgaccggtgctcgatttagtgtcgtcgcaagaggagagggggactgatcaggacttctcagttcatcttctcaccatgaggctccctgctcagctccgtgggctgctaatgctctggatacctggatccagtggagatattgagatgacccagactccactctctctcgtcccgtccaccccgtggacncgcccggcctccatcctcctgcaagtctagtcaggacgtcctcgtgctagtacgtgaataggaaacgacctatatcgttactcggtacctgacagaacgtcgacggccacggtcccctaccaacgtaccttccgtagtatttacgtaggtaacgtttccgtaaagttccgtttagttttacgggacgttcgaccctaggtaccgtaggtcctacgtaggtcgggacgaacgggtccggggtacgtaacggggtaactaggttactttaccgaaacgttaccgttaaggtaaaacgttccggaacgggtcccggggtaagggtacggtacggtaggtaagggtacgtttgggttacggtacgtttaagttttacgttacgttaggtacgtaagttacggtaacttaaaggtttacgacggttcgtttaggtttaccttacggttttaccggacgttaacgggtaccgttaacctacgttaccgtacggtaacctaaacgg

SEQ ID NO: 257951 - DNA, 651 bp, Homo sapiens
  misc_feature: GYAE6OF01B3AYR.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggactccagtggagatattgagatcgaccagactccactctctctcgtccgtccaccccgtggaccacggcccggcctccactcctcctcgacaagtctagtcaggacgtcctcgtcgctatacggtgaagtaggaaacgtaccttaatagtcgtaacgtcggtacctgactaaggaacgtcgaacggccagtcccctacaccgtacctccgttagtaactttacgtacgtaacgttttccaaggtttccgttttaagtttcgggagttcgacccgtaggtaaccgagggtcctacgagggttccgggacgtacggggtaccggggttagaaccgggggtataacggttactttacccgaaactaaccggttaaagaaaaccgttccgggaacggggttcccggggtaggggtaacggg

SEQ ID NO: 257952 - DNA, 709 bp, Homo sapiens
  misc_feature: GYAE6OF01ENZI7.29.21.B10.1.454.CMB.1.raw
  modified_base (202)..(202): a, c, t, g, unknown or other
  misc_feature (202)..(202): n is a, c, g, or t
  modified_base (210)..(210): a, c, t, g, unknown or other
  misc_feature (210)..(210): n is a, c, g, or t
  modified_base (223)..(223): a, c, t, g, unknown or other
  misc_feature (223)..(223): n is a, c, g, or t
  modified_base (239)..(239): a, c, t, g, unknown or other
  misc_feature (239)..(239): n is a, c, g, or t
  modified_base (315)..(315): a, c, t, g, unknown or other
  misc_feature (315)..(315): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctcttgtgacgggcagctcacggccctgatgggtgacttcgcaggcgtagtactttgtgtttctcgtagtcctccctgctcngtctccgngggctgactaatncgtctaggactaccgnggactccgagtgagattagttgagatcgacccagtacctcctactcgtctctcgtacccgcctacccctggaaccncggcccggccctctacgtcctcgtcgaccgtagttacgtagtacgacgtaccgtccgtagtcgactagtacggtagaagtaacggtaaactaccttaagtacttacggttaacgtacggtacccgtgtaacgtaagtacgttacgaaccggtccgaccgtacccgtaccggacctacccgttcctagtttaacgttacgtaacgttaccgtttaacggtacgttacgttttacgggttacgagttcccgaccgtaacggtaacgcgtaccgttaggaccggtacgggtacgtccggggtaacgtaacggggtaccgtaagtactttaaacgtaccgtaaacggttaaacgtaactaaacgggtcggaacggggtacccgggtggtaaaccgggg

SEQ ID NO: 257953 - DNA, 773 bp, Homo sapiens
  misc_feature: GYAE6OF01DA66U.29.21.B10.1.454.CMB.1.raw
tcagatagagtactcacgaccggtgctcgatttagtgtcgtcgcaaggagagagggggtcaggctggaactgaggagcaggtggggcacttctccctctaacactctcccctgttgaagctctttgtgacgggcgagctcaggccctgatgggtgacttcgcaggcgtagtactttgtgtttctcgtagtctccctgctcagctccgtggggctgctaatgctcgtgactccgtggactccgtagtggagtattagttgagagtacgaaccgacgtacctcctactctctctcgtcccgtacctacccgtaggaccgacgcccggtcctccgtactccgtcctcgactaaggttactacgtacgtacgaccgtccgttcgtcgtactaagttaggtagtaaacgtaacgggtaaactaaccttagttacgttacggttacgtttaccggtaaccgttggaacgtaacggtaacggtaccgtacggaccctaccggtccctaccgtaacccgtaccttaccgttagtttaactttacgtaacggtttaaccgttttaacccgtaaaggtttacggttttttaacggtttacgggtacgttaccggtaccgtaacggacgtacggtacccgtacggtacgggtcggttacgggaccgggtaccgggtaacgggaaaccgggttaacgtaacggtttaacctttaacccgaaacgttaaaccggtaaaggaaaaccgttccggggtaacggggtacggggtacggggtaaccgggg

SEQ ID NO: 257954 - DNA, 701 bp, Homo sapiens
  misc_feature: GYAE6OF01B0SYG.29.21.B10.1.454.CMB.1.raw
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (458)..(458): a, c, t, g, unknown or other
  misc_feature (458)..(458): n is a, c, g, or t
tcagatagagtactcacgaccggtgctcgatttagtgtcgtcgcaagagaggagggggactgatcaggtacttctcagttcatcttctcaccagtgaggcctccctgctcagtctccgtgggctgctaatgtctcgtaggactaccgtaggactcgagtaggagtatagtacgagatcgaccagtacctcctactcctctcgtcgtccgtaccacccgacggacacggcccgacctctactccgtccgtagtacgtaacgttagtacggactaaggccgtccgttagagacgtaataggtaacgtagtaaacggaactacgttatagtcggttactacggtaccaggaaccaaggtaacgctacggccctacggaccctaccgtactacgtacgtattactaagtacggttaactacgtagtctttagtggactcgacagtcacgntacgnggtacgngtcggacggagagtagtaatacgaacgtaacgaataacgaagtacgggacgggtacggtagaacggtcgtaaggacgttagtacgggttagttacgttaagttaagtacgtaacgtacgtaaacgttaggtaaaccgttaaagtttacgacggtttactaaccggtttacgtacgggtttaccggaacccggttaaacgggtacttaccgggtacgtaaacggtaactaaacggttaaacccg

SEQ ID NO: 257955 - DNA, 654 bp, Homo sapiens
  misc_feature: GYAE6OF01A0K15.29.21.B10.1.454.CMB.1.raw
  modified_base (306)..(306): a, c, t, g, unknown or other
  misc_feature (306)..(306): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtcctccctgctcagctccgtggggctgctaatgctctggatacctggatccaggtggagtattattgagatcgacccagacctccactctctctcgtccctccaccccgtggaaccncgcccggcctccactcctcctgactaagtctagtcagacgtccgtcgtgctagtacggtagagtaaggaaacgtaccttaattattacgtacgtacgtacctgacgaagtaacgtccgacggccacgccctaccgacgtacctccttagtactttagtacgttaacgtttaccgaagtttcgttttaaggtttggtacgtaccggccgtaaggaccgtagggttcctacggtaggtacgggtaccgacgggtaccggggtacggaaacggggtaacgtaaggttacctttaaccgacgttaaacgttaacgaaacgttaccggacggggtaccgggggtcggaacggg

SEQ ID NO: 257956 - DNA, 776 bp, Homo sapiens
  misc_feature: GYAE6OF01EO72I.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagcttctttgtgacgggcgagctcaggccctgatgggtgacttcgcaggcgtagtacttttgtgtttctcgtagtcctccctgctcagctccgtggggctgctaatgctcgtgactaccgtggactccaggtggagtattagttgagatcggacccagacctccactctctctcgtccctccaccccgtggacacggcccggccctccactcctccgtcgactaagtctacgtcacgaccgtcctcggtcgactaagttaggtagtaagtaacggtaaacgtaaccttaagtagttacggttacgtacggttacccgtagaaccgtaacggtaaacgttcggaaccggaccctaaccggtcccgtaacccgtaccgttaacccttcccgttaagtttaaccgttttacgtttacggttaaacgttttacccgtaacggttttacggtttttaacgttttagggtacgggttaaccgtacccgtaacggtaacgtaccggtaccgtttacgggtaacggtcgggtaaccggttaccggggtaccggggttaaccggtaacggggtacgtaaacgggttacctttaaccgtaaacccgtaaacggtaaaccgttaaaaaccggtccggaacgggggttccggggtaagggttaaccgggg

SEQ ID NO: 257957 - DNA, 803 bp, Homo sapiens
  misc_feature: GYAE6OF01CDF9N.29.21.B10.1.454.CMB.1.raw
  modified_base (129)..(129): a, c, t, g, unknown or other
  misc_feature (129)..(129): n is a, c, g, or t
tcagatagagtactcacgaccggtgctcgatttagtgtcgtcgcaaggagagagggggtcaggctggaactgaggagcaggtgggggcacttctccctctaacactctccctgttagaagcttctttgnggacgggcgagctcgacggcctgagtgggtcgacttcgcgaggcgtagtactttgtcgtttctcgtacgtcctccgtgtctcgacgtcctccggtgggctgactatcgctagtacgactacgaggtactcgaggtagagtattagtagagtacaccgaaccgacgtacctacctaccttccttccgtccgttccggtaccccgtacccctaccccgggtacggaaccgtacccgggtccccgtacccttacccgtaccgttcccttaccgtacggtaacctaacggttaccgttacggaaccgaccgacggttcccgttaggtacgaacgttaaggtacgggtaacggtaaaggtaaacggtaaaccttacttaagttacggttacggttaacgtccggtaacgtacgaggttaaacggacgtaaccgacccgccgtaacccgtaccctaccggtaaaccttccgttacgtttaagttacgtttaacggtactttaaccggtttacgtaaggttttacgtttagttacgggaccttacggaccgttaaggaccgtcggttactacgggtacgggtacggtacggacgggtaaccgacgggtaaacgtagtacttaacggttacaaacggtaactaacgggaaacggttgggaacgggttcggggacgtaacggg

SEQ ID NO: 257958 - DNA, 623 bp, Homo sapiens
  misc_feature: GYAE6OF01AOQHS.29.21.B10.1.454.CMB.1.raw
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
  modified_base (535)..(535): a, c, t, g, unknown or other
  misc_feature (535)..(535): n is a, c, g, or t
  modified_base (603)..(603): a, c, t, g, unknown or other
  misc_feature (603)..(603): n is a, c, g, or t
tcagatagagtactcacgaccggtgctcgatttagtgtcgtcgcaagagaggagggggtgatcaggacttctcagttcatcttctcaccatgaggcctccctgctcagcctccgtggggctgactaatgctctggactacctggactccaggtggagtatagttgagtatcgacccagacctccacttctcgtctcgtcccgtccacccgtggacacggcccggcctcctatcctcctgactacgtctagtacagcgtcctcgtgactagttagagagtaaggaacgtactatagtcgtacgtacggtacgtgacgaaggactcgacgccacgtccctaccgacctacttctagttatttagacgttaacttaccgtagtttacgttaggtttagacgtcgacgtacgacgacgtctaggnggtcggngtacgggtcggagaggtctagttacttaaccgataagtaaagaaccgtcggacgggcggtaggacgtcggtaggacggttgttaggtagtatttagttaagttcganacgttagtacgtaattaacgttgtacgttcgtttcgtaacggtttcgtcggaccgtcgtaactccgtntaacgacttcgaaacgtacg

SEQ ID NO: 257959 - DNA, 922 bp, Homo sapiens
  misc_feature: GYAE6OF01DFJ89.29.21.B10.1.454.CMB.1.raw
tcagatagagtactcacgaccggtgctcgatttagtgtcgtcgcaagaggagagggggtgatcaggacttctcagttcatcttctcgccatcgaggctccctgctcagctccgtgggctgctaagtgctcgtgactaccgtggactccgagtggagatagtgagtatcgacccaggtacctccactctctcgtcgtccgtccacccgtggacacggcccggtacctacctattccgtccgtacgaccgtaaagttccgtagtaccgaaggtccgtccgttacggtacggtaccttaaggttacgggtaacggtaaggtaaacggggtaaaacctaacccgtttaagtttacgttacggtttaacggtaccgggttaacccgttaggaaccggtaaacggtaaaccgtccggaaccgggtaacccgaacggtaccccttaccgtaaaccggtaacgttcccttaaggttaacttttaagtaccggtttaaacgttaccgtaaacgggtttcgttttaagggttacgggaaccgttccggaaccgtaaggtaccccggttaacgggttcgtaaccggtaggggtacccggaacgggtaccgggggttaccgggtaacggtaacgggggtacccttaaagggtttaaccctttaaccggaacgttaacgtaaaaccggtaaacggccggtaacgggggtacccggggtagtaccgggtacggtaaggtcgggttaacggtttcgtaaccgggttatttacggttttaaagtcggttaacgaccgttagtaaccggttaaacgtttaaccggttcgtaaacggtttcgtttaccggttaccggtttaacgggttcccggaacccgggtaaggtaacccggttacggtaacccgttaacggtcttaaaccggtaaacggtaaccggg

SEQ ID NO: 257960 - DNA, 757 bp, Homo sapiens
  misc_feature: GYAE6OF01EKZ72.29.21.B10.1.454.CMB.1.raw
tcagatagagtactcacgaccggtgctcgatttagtgtcgtcgcaagagaggagggggtgatcaggacttctcagttcatcttctcaccatgaggctccctgctcagctccgtgggctgctaatgctctggattaccgtggactccgaggtggagtattattgagtatcgacccagtacctcctactctctcgtcgtcccgtccacccgtgacacggcccgtcctcctagtcctctgactaagtctagcagctccgtagtgatagtgagagtaaggaactactatagtcgtacgttcggtactgacgtaaggtacgtccgacggaccacgtaccctaccgtaacgtccttcgtaaggtttaatttacgtaacggtttaacgttaccgttaaggttcgttttaggttacggacgttaccggtaccgaagtaccggtacggtcgtacgggtaggtcgggacggccggggttacggaacgggtaaggtacgttaacgtttaccttaaccgaaacgtttaaccggaaaggttaaaccgtccgggggtaaccggggtaccggggtacgtaaccgggtaggttaagggtacggtaccgttttagggtacggtttaacttttagtttaccgtaggtcgtaacgtaacgtttacgaaaacgtttacggttcgactttcggttttaaccggttaccgttacggttccggggaaccgggttataccccgttcgtaacggtaatacccggtaacgtaaacggtaaccg

SEQ ID NO: 257961 - DNA, 681 bp, Homo sapiens
  misc_feature: GYAE6OF01CM7MZ.29.21.B10.1.454.CMB.1.raw
  modified_base (132)..(132): a, c, t, g, unknown or other
  misc_feature (132)..(132): n is a, c, g, or t
  modified_base (216)..(216): a, c, t, g, unknown or other
  misc_feature (216)..(216): n is a, c, g, or t
  modified_base (224)..(224): a, c, t, g, unknown or other
  misc_feature (224)..(224): n is a, c, g, or t
  modified_base (240)..(240): a, c, t, g, unknown or other
  misc_feature (240)..(240): n is a, c, g, or t
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
  modified_base (615)..(615): a, c, t, g, unknown or other
  misc_feature (615)..(615): n is a, c, g, or t
tcagatagagtactcacgaccggtgctcgatttagtgtcgtcgcaagagaggagggggactgatcaggacttctcagttcatcttcgtcaccatgaggctccctgctcagctccgtgggctgctaatcgctntggactacctggactccaggtggagtattattagaagtactcgaaccagtactccactcctctctcgtccgtccacccgtgacngccgctcntctctgactagtcatnagacnctcgngactagtgagaagtacggaaatactagttactcgtaactcggtaacctgacgaaggaacgtcgacggcctaccgtacctacgaaccgttcctacgttataacgtttagaacgttaaacgtttaccaaagggtttcgttttaaggttttcgggacttaccggaccgtaaacgcgaacggtcgttaagacggttgggacgtacggggtacgggtaccggtaagggtaactacggttaactttaaccgaaacgtaacgtaacgtaaaacgttcgaacggggtccgggttaggggaccggttgaaggtacggtaagtggttgtaacggttatttacgttagttccgtatacgtagtaacgttaacgttntacggtagttcgttacgttcgttacggaccggtacggtactacgtaccgaggtacacgtaaaccgg

SEQ ID NO: 257962 - DNA, 827 bp, Homo sapiens
  misc_feature: GYAE6OF01B1CTZ.29.21.B10.1.454.CMB.1.raw
tcagatagagtactcacgaccggtgctcgatttagtgtcgtcgcaaggagagagggggtcaggctggaactgaggagcagggtgggggcacttctccctctaacactctcccctgttgaagcttctttgtgacgggcagctcacggccctgagtgggtcacttcgcaggcgtagtactttgtgtttctcgttagtcctcccgtgctcacgtcctccggtgggctgtactatcggtctacgtggtacttaccgtggtactaccgagtggatattagtaggatacgtaccgaaccacgtacctccactttcctaccttcgtccgttacccgacccctacccggacgtaccgccggtccccgtcctcccgtaactccctcgtacgacttacgtaccgtagtacgtacgaccttcgtcgtagacgttaagtaaggtacgtaacggtaaaggtaaaaacctgtttaaacgtacgtttacggttaacgttacccggtaatacggtaactaaggttaaacgttccgacccggtaacacccgttacccgtaccgtaccgttaacccttgtttaagtttaaaccgtttaggtttaaacccggtttaaaccgtttaacccgttaagggttttacccgtttttaaggttaccgggttaacgggtacccgtaacccgtaaagggttaaccggtacggttacccggttacgggaaggggtttcccggaaacgggtaccgggtaacgggtacgggttaaacgacgtttaaacgtacgtttaacccgaacgtaaggttaaaccgacggtaggggttacccggaagggggtcgtaaaccgggg

SEQ ID NO: 257963 - DNA, 663 bp, Homo sapiens
  misc_feature: GYAE6OF01C8KAT.29.21.B10.1.454.CMB.1.raw
  modified_base (151)..(151): a, c, t, g, unknown or other
  misc_feature (151)..(151): n is a, c, g, or t
  modified_base (268)..(268): a, c, t, g, unknown or other
  misc_feature (268)..(268): n is a, c, g, or t
  modified_base (367)..(367): a, c, t, g, unknown or other
  misc_feature (367)..(367): n is a, c, g, or t
  modified_base (470)..(470): a, c, t, g, unknown or other
  misc_feature (470)..(470): n is a, c, g, or t
tcagatagagtactcacgaccggtgctcgatttagtgtcgtcgcaagagaggagggggtgatcaggacttctcagttcatcttctcaccatgaggctccctgctcagctccgtggggctgctaatgctctggatacctggatccagtgganatattgagatgacccagacctccatctctctcgtccgtccaccccgtggacacggcccgtccctccattcctcctgactaagtctagcagacgcctcgtgcagtagtgataggaaanacctatatgtactggtacctgacgagaagtcgacggccacgcctaccacgtaccttcagtatttagagtagttaccaagttcgtttagtttggagttcnccgtaagcgtacggctagagggtcggacgacgggtcgggtacgaagggtacaagttactttaccaaacgtaacgtaagaaacgttacggacgggtaccggggngtacgggtacgtagggacgggttagtttacgggttagggtactttaaagtttttacttacggttgtaaccgttagttacgggtaaactttaaaacggtttccgaagttccgtttacgttaccgtttaacggttttccgggaacccgtacgggtaacctacgtaccgtaggtaaacctagtaaccgtaaaacgg

SEQ ID NO: 257964 - DNA, 729 bp, Homo sapiens
  misc_feature: GYAE6OF01EVLXO.29.21.B10.1.454.CMB.1.raw
  modified_base (445)..(445): a, c, t, g, unknown or other
  misc_feature (445)..(445): n is a, c, g, or t
tcagatagagtactcacgaccggtgctcgatttagtgtcgtcgcaaggagaggagggggtcaggctggaactgaggagcaggtgggggcacttctccctctaacactctcccctgttgaagctctttgtgacgggcgagctcacggccctgagtgggtgacttcgcgaggcgtagtactttgttgtttactcggtagtcctccctgctcagtccttccggtggggtctgtcttaagtcgtcttcgtagtacttaccgtaggtactccgaggtgaagtatagttgaatacgtaccgaacctacgacctacctaccttcgttcctccgttccgttccccgtacccgtacccggtacggaaccgtcccggtcccggtacccttccctaccgttcccgttccgtacgtaaccgtaacggttactaacgtacacgtaccgtccgtcgtanaacgtagtacgtagtaagtaaacggtaactacgtaaacttcgttacgtaccggttacgttacgtacgaaccgtaaggtaccgacgtaccgaccgtaccgtccctaaccggacttacccttcgttaagtttaacgttagttaacgtacctttaagttacgtttacgttagttcgtacgaccgacgtacgtacgttgaacctaggtcgtcggacgtacgggtaccgtagaacggtatacggtaccctaagtaaacgacgtaagacggcggtacgggcgggtagtcg

SEQ ID NO: 257965 - DNA, 683 bp, Homo sapiens
  misc_feature: GYAE6OF01EIYOM.29.21.B10.1.454.CMB.1.raw
  modified_base (401)..(401): a, c, t, g, unknown or other
  misc_feature (401)..(401): n is a, c, g, or t
  modified_base (609)..(609): a, c, t, g, unknown or other
  misc_feature (609)..(609): n is a, c, g, or t
  modified_base (675)..(675): a, c, t, g, unknown or other
  misc_feature (675)..(675): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcgaggccctgatgggtgacttcgcgaggcgtagtactttgtgtttctcgtagtcctccctgctcagctccgtggggctgactatgctcgtggattaccgtggactcgaggtggaagtattattggatagtacgacccacgacctccacttcctcttccgttcgttccccgtacccgtaccccgtacggaccgtccggtcccgtccctaccgtacctccgttacctacgactaacgtcgtacgtacgaacgcgtccgtacgngtactagtagtagaagtaacgaaacgtaactagtagtacgttacgttaccgtacgttacgacgtaagtacgtacgaccgacctaccgtaccgtaacccgtaactaccgttaccgtagtttaactttacgtaacgttaaccgtttacgtaacggtttccgttttaaggttcggtaacgccgtaacgacgtacgactcgtagcgtacggngtacggtcggacgacgtgtaacgttctaaccgagtaacgtaaacggtacgacgggtcggtacgggngggtaacg

SEQ ID NO: 257966 - DNA, 612 bp, Homo sapiens
  misc_feature: GYAE6OF01B5IL3.29.21.B10.1.454.CMB.1.raw
  modified_base (296)..(296): a, c, t, g, unknown or other
  misc_feature (296)..(296): n is a, c, g, or t
  modified_base (304)..(304): a, c, t, g, unknown or other
  misc_feature (304)..(304): n is a, c, g, or t
  modified_base (605)..(605): a, c, t, g, unknown or other
  misc_feature (605)..(605): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagtactttgtgtttctcgtagtctccctgctcagctccgtggggctgctaatgtctctggtataccgtggactccgaggtggagtattattgagatcgaccagacctccactctctctcgtcctccncccgtgcncgccgcctcatcctctgacacgtctagtcagtactccgtcgtgactagtagtgtaagtacggaaacgtacctatatacgttacgtacggtacctcgacgaagtaacgtcgacggacctacgcctaccgacgtacctcgtattactttacgtacgttaacgtttccgtaaggttacgttttagtttcgggacgttccgacgtagtacgacgtctaggtcggtgacggacgggtacgggtacgaacgggtatacggttacttaccgaacgttaacgtaacgaaacgtaccggcgggtcggggnggtacgg

SEQ ID NO: 257967 - DNA, 744 bp, Homo sapiens
  misc_feature: GYAE6OF01CWN3X.29.21.B10.1.454.CMB.1.raw
  modified_base (132)..(132): a, c, t, g, unknown or other
  misc_feature (132)..(132): n is a, c, g, or t
  modified_base (224)..(224): a, c, t, g, unknown or other
  misc_feature (224)..(224): n is a, c, g, or t
  modified_base (635)..(635): a, c, t, g, unknown or other
  misc_feature (635)..(635): n is a, c, g, or t
tcagatagagtactcacgaccggtgctcgatttagtgtcgtcgcaaggagagagggggtcaggctggaactgaggagcagggtggggcacttctccctctaacactcctcccctgttgaagtcttcgtttgnggacgggcgagctcgacggtcccctgagtgggtcgtacttcggcgaggcgtagtacgttttgtcgtttctcgtacgtccctcccgtgcctcncgtccgtccggtgggtctgactaagtcgcttgtacggtactccgtggtactaccggaggtaggatagttagttagaacgtacgtaccggaacccacgtaacctcctccttccttcgtcgtcccgtccccgtaccaccccggtaggaccaccggtccccgtaccctcctacgttccgtaccgtacgaccgtaacgttcgtacgtacgacggtcgtccgtcgacataagtagtaggtaaagaaacggtaacctataattacggtacgtacgtacgtaccgtagacgtaacggtaacgccgcgtaccgtaccgtccctaccgaccgtctaccgtagtttaacgtatacgttacgtacgtagttaccgtttagttggaacgtcgtaaccgtaggacgtacgtacgtacggtacgnggaccgggttcggaacgggtaacggtagaacccgtaagtttaccgtaacccggaactaaaccggtaaggttaaccgaccgggttaccggggtaaggggtagtaccgggg

SEQ ID NO: 257968 - DNA, 837 bp, Homo sapiens
  misc_feature: GYAE6OF01DKWXY.29.21.B10.1.454.CMB.1.raw
tcagatagagtactcacgaccggtgctcgatttagtgtcgtcgcaagaggagaggggaccttgattcgaggacttcgttcagttcatcttctcaccgagtgaggcctcctgctcgagctccgtgggtctgtcgtaatgcctcgtggactaccgtggactccgaggtcggagatattggagtagtcgaccagaccttccgtacttcgtctcttcgttccgtccgacccgtggacgtacgcccggtctccgatcgtccgtgactaaggtcgtacgcacggacgccgtcgtggcctagtaggtagtaacgtacgggtaaaactccgtaagttacgtacggttaccgttacggttaaccgttcgaccggtaaacggtaaacgtccggaaccgggtacccaaccggtcccctaccgtaacggtacccttccggttagttaacgtttaaccgacggtttaaaccgtttacccgtaaggttaccggtttttaggtttacgggacggttacgaacggtaacgtacgggtaacgtccgttaaggtaacggttcgggtaaccggtacgggtacgggttaacccgggtaaaggttaaccgttaaaaggtttactttaaccggtaacgtaaacggtttaaacgtaaacggtacgggtacccgggtacgggttacgggtaacggtcgtaacgggtaaggttcgttacgggtaccgttaacgtttaaccttttaaagtacgtttacgacgttaacggtacgtaaccgttaaaagttacgaacgtttcgtaacgttacgttcggttaacgaccggtaacggtacctaacggtcgtaacgtacgtagtaaacg

SEQ ID NO: 257969 - DNA, 643 bp, Homo sapiens
  misc_feature: GYAE6OF01CIE2C.29.21.B10.1.454.CMB.1.raw
  modified_base (318)..(318): a, c, t, g, unknown or other
  misc_feature (318)..(318): n is a, c, g, or t
tcagatagagtactcacgaccggtgctcgatttagtgtcgtcgcaagagaggagggggactgatcaggacttctcagttcatcttctcaccatgaggctccctgctcagctcctggggctgctaatgctctggatacctggatccagtggagatattgagatcgacccagactccactctctctgtccgtcacccctggacacgccggcctccatctcctgacaagtctagtcagacgcctcgtgcatagtgatggaaacgtactatatgtactgggtacctgcaggaagtcaggccagcctccacgctctgatttangtaagtttccaagtcgtttagttttggagtcgaccagacgaggtcctcgtaggtcgggactagggccgggtacgaacgggtactacggttatttaccgaacttaacgtaaggaaaacttccgaacgggtcccgggggtaggtaacgggtcgtaagggaggtaacgttgggtttaacgggacttaaggtttttaattaacgttcgtacgttaacgttaggtaaccgttaaaaggtttccaagggtttccttagggtttaccctttacgggttttcggacccgggtaaggggtacccctaggtaccctggaacctacgttaaacccg

SEQ ID NO: 257970 - DNA, 775 bp, Homo sapiens
  misc_feature: GYAE6OF01DSIAW.29.21.B10.1.454.CMB.1.raw
tcagatagagtactcacgaccggtgctcgatttagtgtcgtcgcaaggagagagggggtcaggctggaactgaggagcaggtgggggcacttctcctctaacactctcccctgttgaagctctttgtgacgggcagctcgacggccctgatgggtgacttcgcaggcgtagtactttgttgtttctcgtagttcctccctgctcagtcctccgtgggctgctaatgctcgtggactaccgtggactccgaaggtcggagtaattagtacgaagtacttacggaaccccaagtaacctcccgtaaccttcctccttcttacggtccccgtacccctaccccggtaggaccctacggtaccccggtccctcccgtacttcccgttcccgtagtaaccgtaaaacgttcgtacgtacaagtaccgtccgttcgtcgacctaagtaaggtacgtaagtaaacgggaaacctaaccgttaagttacgttacggttaacgttcggttaacctggtaccgtaagtaacgttaccgaacggacccgtaaccggtccctaacccgtaaaccgtaccccttaccgttagtttaaacgtttatacggttaaccgtttacgtaacgttacggttttagtttacggtacggtaacgtccgtaacggacgtacgtccgtagtacgtcggtacgtaccgggtacgggaccggtacgggtagtaacgttaagttacctaaacgtaaccgtaagtaaaacgtccgtaacggggtccggggtgggtaaccggg

SEQ ID NO: 257971 - DNA, 923 bp, Homo sapiens
  misc_feature: GYAE6OF01ALKN9.29.21.B10.1.454.CMB.1.raw
tcagatagagtactcacgaccggtgctcgatttagtgtcgtcgcaaggagaggagggggtcaggctggaactgaggagcaggtggggcacttctccctctaacactctccctgttgaagcttctttgtgacgggcgagctcaggccctgatgggtgacttcgcaggcgtagactttgtgtttctcgtatctcctgctcagtcctcgtgggctgactatcgctcgtggactaccgtggactccgaggtggagtatagttgagtatacgaacccacgtaacctcctacttcctccttactccggttacccgtcccaacccccgttagggaccgaccgtcccgggtacccttcctaactcctaccgtcgaaccgtaaagtttcgtaaccgtacgaaacggtaccgtcccgtcggttacgaccgtaaagttaacggtaggtaaacggttaacgggaaaaaccgttaacccgtttaaagttaaagttttaccggttaaaccggttaccgggttttaaccgtacgggaaacgtaaacgggtaaacggttaccggaaaccgggtaaccccgaaccgtaacccccgttaaccccgtaaaaccggttacccctttacccgttaaaggtttaaaccgttttaaacgtaaccgggtttttaaaacccggttttaacccgtaaacggttttaaccggttttttaaacgggttttaacgggaaccggtttaccgaaaccccggttaaaggttaaaccccgggtaacgggttaacctaacccggggtagggttacgggaaacccggtacggggtaaccgggggtaaaccggtaacggggtaaaccttacggttaaacctttaacccgtaaacgaaaccgtttaaaaggaaaacccgttagggaacggggttaccccgggggttaaggaacccggggg

SEQ ID NO: 257972 - DNA, 777 bp, Homo sapiens
  misc_feature: GYAE6OF01C02QB.29.21.B10.1.454.CMB.1.raw
  modified_base (128)..(128): a, c, t, g, unknown or other
  misc_feature (128)..(128): n is a, c, g, or t
  modified_base (158)..(158): a, c, t, g, unknown or other
  misc_feature (158)..(158): n is a, c, g, or t
  modified_base (389)..(389): a, c, t, g, unknown or other
  misc_feature (389)..(389): n is a, c, g, or t
  modified_base (510)..(510): a, c, t, g, unknown or other
  misc_feature (510)..(510): n is a, c, g, or t
  modified_base (763)..(763): a, c, t, g, unknown or other
  misc_feature (763)..(763): n is a, c, g, or t
tcagatagagtactcacgaccggtgctcgatttagtgtcgtcgcaaggagagagggggtcaggctggaactgaggagcaggtggggcacttctccctctaacactcctccctgttgaagcttctttgngacgggcgagctcacggccctgagtgggtnacttcgcaggcgtagtacttttgtgttctcgtagtcctccctgctcacgtcctccggtggggcctagaccttaagtcgtccttacgtacggtaacgtaccgtcggattaccagggtggaagtattaagtgaagtacgtacgaccaacgtacctacctacctccttcgtctccggtccctaccgtacccgtaggaccgaccggccccgtccttaccaccgttccctccgtanacgtaaacggttctaggtaacgacgtccgtaccgttgtaccgagtaaggtagtcggtaaagtaacgggtaaacttaaacccgttagttaaccgtacggttaccgttaacgtacccggtaanaaccggtaacgtaacggtcgaaccgtcccggaacttaccccgtaccgaaccttaccgtacgtttaagttaacgtttacggttaacgtttaacggttaaccttaagggttttaccgttttaaggttttcggaccgtttacggaccgtaacggtacctaacgggtgttaccggagggtaccgtacggtaccgggtacgggacgaacggtaacgtgttaaccgttcaaactaacgtagtaaacgtcgggtaacggngggtacgggtaagg

SEQ ID NO: 257973 - DNA, 839 bp, Homo sapiens
  misc_feature: GYAE6OF01EGR54.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctccctgttgaagcttctttgtgacgggcgagctcgacggccctagagttgggtgacttcgcgaggcgtagtacttttgttcgtttctcgttacgtcctcctgctcacgtccgtccggtggggctgtactaagtcgtctcgtgtactaccgtaggactcgaggtggagtattagttagagtactaccgaacccacgtaccctacctacttcctaccttccgttccggttcccctaccccgtaccccggtacggaccgtaccggtccccgtaccctacctaccgttccctcccgtacgtaacgtaacgttccgtacgttaccgacgtaccgtccgtcgtacgtaacgtaagttacggtagtaaagtaaacgggtaaacgtactttaacgttaacgttacggttaaccgttacgggtaccttaggaaccttaaacggttaccggaccggtacgacccgtacccgtaccccgtaaccggtaacttcccgttacctttaaggtttaaactttacggttaaccgtttaaaccgtttaccgtttaacggtttttacggtttaagtttacgggacgttcccggaaccgtaacgggttactaccgggtcttaaccgggaggttaccgggaccggttcccgggggtacggtaaacgggtacggtaattaaccggtttaactaccggtaaacgtaaacgttaaacggtaacggttaccggggacgggtcggggtggtaacggg

SEQ ID NO: 257974 - DNA, 701 bp, Homo sapiens
  misc_feature: GYAE6OF01C1SIH.29.21.B10.1.454.CMB.1.raw
  modified_base (167)..(167): a, c, t, g, unknown or other
  misc_feature (167)..(167): n is a, c, g, or t
  modified_base (176)..(176): a, c, t, g, unknown or other
  misc_feature (176)..(176): n is a, c, g, or t
tcagatagagtactcacgaccggtgctcgatttagtgtcgtcgcaagagaggaggggggactgatcaggacttctcagttcatcttctcaccatgaggcctccctgctcagcctccgtggggctgctaatgctcgtggactacctggactcgaggtggagatatganatcgaccanacctcctactctctctcgtccgtaccacccgtgacacggcccggcctacctactcctcctacgacgaagttctaacgtacacggacgtccgtcgtacgacgtaagtacggtagtaagtaaacggaaacgtaacctaagtatacggttacgtacggtacgtagacgaagaagtacgacggacacgacctaccgacgtactacgtattagttaagtagttaacgttactaaggttacgtttagtttaggacgtacgacgagtacgacggtactacggtagggtacggtacgggaacggcggggtaacggaggtaactaattacgttaaccaaacgtacgaaagtaaacggtccggacggggtacggggtaggacgtacggtaagggaaggttgttacggttacggtttaacttttagtttacgtttaagtacgattacggtaaagtaaacgttaaagttcgagttacgttagtttacgtttacggtacgggacgacggtacctacgtacgtagaactacgtaaacgg

SEQ ID NO: 257975 - DNA, 634 bp, Homo sapiens
  misc_feature: GYAE6OF01DTPG3.29.21.B10.1.454.CMB.1.raw
  modified_base (196)..(196): a, c, t, g, unknown or other
  misc_feature (196)..(196): n is a, c, g, or t
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (228)..(228): a, c, t, g, unknown or other
  misc_feature (228)..(228): n is a, c, g, or t
  modified_base (241)..(241): a, c, t, g, unknown or other
  misc_feature (241)..(241): n is a, c, g, or t
  modified_base (245)..(245): a, c, t, g, unknown or other
  misc_feature (245)..(245): n is a, c, g, or t
  modified_base (252)..(252): a, c, t, g, unknown or other
  misc_feature (252)..(252): n is a, c, g, or t
  modified_base (281)..(281): a, c, t, g, unknown or other
  misc_feature (281)..(281): n is a, c, g, or t
  modified_base (463)..(463): a, c, t, g, unknown or other
  misc_feature (463)..(463): n is a, c, g, or t
tcagatagagtactcacgaccggtgctcgatttagtgtcgtcgcaagagaggagggggtgatcaggacttctcagttcatcttctcaccatgaggctccctgctcagctccgtggggctgactaatgctcgtggactacctggactccgaggtggagtattattgagatcgaccagactccactctctctcgtccnccacccgnggacncgcccgcctccnctcctcngacagtcgtagcngacnccgtgtncagtagtagagtaaggaactactatcttntacgtcgtctacgagaagtacgcgacgccacgtccctaccaacgccttactagtaacttagtacgtacgtttacgtaagtttcgtttaggttcgagtcgacctagacgtacggtctacggtcggcggacggacgggttacggacggtaacgtacggtacgttactaacgaactacggtaaanaacggttcgggtacgggccggggtaggaggtaacgtggtaaggttgttggttacggttacttaagttttacgttgttacgagtacgtcgaaacgtttagtactgttaacgttcgttacgttggttaccggaccggtaggtacctcgtacgaacgtactaatccggtaaacg

SEQ ID NO: 257976 - DNA, 692 bp, Homo sapiens
  misc_feature: GYAE6OF01C8JZT.29.21.B10.1.454.CMB.1.raw
  modified_base (549)..(549): a, c, t, g, unknown or other
  misc_feature (549)..(549): n is a, c, g, or t
  modified_base (588)..(588): a, c, t, g, unknown or other
  misc_feature (588)..(588): n is a, c, g, or t
  modified_base (593)..(593): a, c, t, g, unknown or other
  misc_feature (593)..(593): n is a, c, g, or t
  modified_base (618)..(618): a, c, t, g, unknown or other
  misc_feature (618)..(618): n is a, c, g, or t
tcagatagagtactcacgaccggtgctcgatttagtgtcgtcgcaagagaggagggggtgatcaggacttctcagttcatcttctcaccatgagctccctgctcagcctccgtgggctgactaatgctcgtggacttaccgtggactccgaggtaggagtattagttgagtatacgacccgagtacctcctacttcctccttctccgtccgtacccaccccgtggaccgacggcccggtccctccacttcctccgtacgactaacgtcgtacgtcgaacgtccgtccgtcggtgaacgtagtaaggtagtaagtaaggaaacgtacttaatagtacgtacgtcgtactgacacgaacgtcgacgccacgtcccaccacgtactcgtaagttattagtagttactttacgtaagtttcgtttagttacggtacgtcgaacgaggacgtacggtctaggtaggccggtaggccgggtacgggtaaggaacgggtactacggttaattaccgaagtaacgtaaaggtaaccgcgggacgggggtacgtaggnggtacggaggtacggtgttggttacgtattttaagtttntacgngtaatgtaacgtaaacgtttacgtntacgttccggtttaccttaggttacggttccggaacggttacgcttcggttacagttacccaaggtaacgtacg

SEQ ID NO: 257977 - DNA, 888 bp, Homo sapiens
  misc_feature: GYAE6OF01CPKAZ.29.21.B10.1.454.CMB.1.raw
  modified_base (129)..(129): a, c, t, g, unknown or other
  misc_feature (129)..(129): n is a, c, g, or t
  modified_base (137)..(137): a, c, t, g, unknown or other
  misc_feature (137)..(137): n is a, c, g, or t
  modified_base (159)..(159): a, c, t, g, unknown or other
  misc_feature (159)..(159): n is a, c, g, or t
tcagatagagtactcacgaccggtgctcgatttagtgtcgtcgcaaggagagagggggtcaggctggaactgaggagcaggtggggcacttctccctctaacactcctcccgtgttgaagcttctttgnggacgggngagctcgacggcctgatgggtnacttcgcgaggcgtagtacgttttgttcgtttctcggtacgttcctcccgtgccttcgacgtccgttcccggtggggtacctggtaacttaagtcgcgttcggtaggtaacgtaccgtacgggtactaccggtaaggttgggaattagtttaacgttaggaagtaacgtaacccggaaccgtaacgtaccttaacccctacctttccttccgtttaccgttccccgggttaccccgtacccccgacccccgggttaaggaaccccgtaaccgggttcccccgtccttaacctacctcccgtttaccgacggtaacttaacgtccgttactaccggaacgtcggtccctggtacgaacgttagtaacgtaggtaacgtaacgaaacgtacgttaagtaacgttacgttacggtaacgtaccgtaaggaacgtaaacgggtaacgtaccggaaccgacccgtaaccgtacccgtaacccgttaaaccgtacccgtttaacgtaacgttttaacgttaacggttaaccgtttaacgtttaaacccggttagtttaaccggttttaaggttacggtaaccgtccggtaacgtaacgttaacggaccgtacgttacggacggtaccgggtacgtacggggtaacgtaccgggaaaggtaaccgtaagttaaccgtaccgtaaagtaaaccgttaacggaaacggccgggtaaaccgggtgggtaacggtacggg

SEQ ID NO: 257978 - DNA, 781 bp, Homo sapiens
  misc_feature: GYAE6OF01ERGI9.29.21.B10.1.454.CMB.1.raw
  modified_base (114)..(114): a, c, t, g, unknown or other
  misc_feature (114)..(114): n is a, c, g, or t
  modified_base (248)..(248): a, c, t, g, unknown or other
  misc_feature (248)..(248): n is a, c, g, or t
  modified_base (496)..(496): a, c, t, g, unknown or other
  misc_feature (496)..(496): n is a, c, g, or t
  modified_base (518)..(518): a, c, t, g, unknown or other
  misc_feature (518)..(518): n is a, c, g, or t
tcagatagagtactcacgaccggtgctcgattttagtgtcgtcgcaagagaggaggggggtgatcaggacttctcagttcatcttctcacatgaggctccctgctcagctccgnggggctgactaatgctcgtggataccgtggactcctaggtggaagtattagttaggagtatacgaaccccgaagtaccttacccgtacttccttcttccgttcggttccccgtaccctaccccggtgggaaccnccggcccggtccctcctacgttcccttccgtcgaactacgttactaggtacgaacggccgtccgttcgtgacctaaggtaggtaggaagttaaggaaacgtaacttattagttacggttacgttcggtacctggacgaagacggtcgacggacctacgccctaaccgacttcctacttagtttactttaagacgtttaaacgttaccgtaagtacgttttaggttggacgttcaaccggaaggtacgnggttacacgtagggcgtaacgngggccgggtaacggacggtacgtacgttacgttacgaacgtagtaaacggaacgtaccgggacggggtacgggacgggtaaccgggtgtaacgggtaggttacggtttgggttacgtacgttttaagtttacttaggttacggataacggttactaacgggttaagtttaccgacgggtttcttttacggttaccggttttaacggtcgggtaccggttaccggaccttggtaccgtaaggtaactacgtaaaccgtaaacgg

SEQ ID NO: 257979 - DNA, 722 bp, Homo sapiens
  misc_feature: GYAE6OF01CA8DO.29.21.B10.1.454.CMB.1.raw
  modified_base (203)..(203): a, c, t, g, unknown or other
  misc_feature (203)..(203): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgagtgggtgacttcgcaggcgtagactttggtgtttctcgtagtctccctgctcngctccgtggggctgactatgctcgtggatcccgtggactccgaggtggagtatagttggagtatcgaacccgagaccctcctacctccttctcctcggtaccccgtcccctacccccgtagggaccgaccggccccgggtccctaccgactccttccgtcggactaaccgttcgtacgtacgacggacgcccgttcggtcgtaccgtaagtacgttacggtaaggtaaacggggaaactacccgttaaagtttaagttaccgttaacggttaccgggtacctaggaccgtaaggtaaacggtccgtacgggaccctcgacccttaccgacgttaccctcgtagttaatttacgacgttaacgtttaccgaacgtttgggtttactttacgggctaccgacggtaacggtacgtaacgggtcgtacggtacggcggtacggtaccgggtgggtaaccggtagggaccgtaaggtacttaaccacgtaacgaaagtacgcgggacgggcggggtgtacggg

SEQ ID NO: 257980 - DNA, 708 bp, Homo sapiens
  misc_feature: GYAE6OF01CODT0.29.21.B10.1.454.CMB.1.raw
  modified_base (216)..(216): a, c, t, g, unknown or other
  misc_feature (216)..(216): n is a, c, g, or t
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (687)..(687): a, c, t, g, unknown or other
  misc_feature (687)..(687): n is a, c, g, or t
tcagatagagtactcacgaccggtgctcgatttagtgtcgtcgcaagagaggagggggtgatcaggacttctcagttcatcttctcaccatgaggctccctgctcagcctccgtggggctgctaatgctcgtggattacctggactccaggtggagtattagttggagtatcgaacccagacctccacttctctctcgtccgtaccacccgtgacncgcccgcctcntcctcngactatctagcaggtctcgtcgtgactagtaggacgtaaggtaacggaaaacgtcctaattacgttcgttacggtacgttaccgcgacgtaagacggtcggaccggccacgccctaccgacgtaccttcgtagttaatttaacgtacgttaaccgtttaacgtaaggtttcggttttagtttaggtacgtcgaaccgacgtacggtacggtccgtcgtaggtcggtacgggtacgggtccgggtaacggaacgggtacgtaaagtttccttaaccgaactaaacggtaacgtaaacgtaccggtacggggtaccgggtaaggtccggtagacgggtagttacggttcggttacggtatttaagttttattagtgttaactagtacgtaaacgtttaagtcgtacgttcgttttagtaccgtttggttccgacgggtacgtccttaacgcgttanaacgttaccgtaagtaaccgg

SEQ ID NO: 257981 - DNA, 755 bp, Homo sapiens
  misc_feature: GYAE6OF01E2D01.29.21.B10.1.454.CMB.1.raw
tcagatagagtactcacgaccggtgctcgatttagtgtcgtcgcaaaggagagagggggtcaggctggaactgaggagcaggtgggggcacttctccctctaacactctcccctgttgaagctctttgtgacgggcgagctcaggccctgatgggtgacttcgcaggcgtagtactttgtgtttctcgtagtcctccctgctcagcctccgtggggctgactaatgtctcgtggactaccgtggtactccgaggtggatattagttagagataccgaccagacctccactcctctctcggtccctacccacccgtggaccgaccggcccggtccctacctacgttccctccgtacggtactaacggttctaacgtacgaacgtcgtccgttcggacgtactaagttaggtaggtaaagtaaccgggtaaaactaccttaaagtagtttacggtaacggttacgttaaccgtacgtaactaaaggttaaccgtccggacgccctaacggtaccccacgtaccggtaccttaccggttattaactttacgtacgttaaccgttaccgaaggttttcggttttaagtcgggtaacgtacccggaacgtacggtaaacggtccgttaccggtaggacgggttacggaccggtacggggtacgggtaaccggaaggggtaacccttaggtttacctaaccgaaacgtttaaacggaaacggttaaaccacgggggtaccgggttcgggggaagtaccggg

SEQ ID NO: 257982 - DNA, 672 bp, Homo sapiens
  misc_feature: GYAE6OF01CFZDO.29.21.B10.1.454.CMB.1.raw
  modified_base (269)..(269): a, c, t, g, unknown or other
  misc_feature (269)..(269): n is a, c, g, or t
tcagatagagtactcacgaccggtgctcgatttagtgtcgtcgcaagaggaggagggggtgatcaggacttctcagttcatcttctcaccatgagctccctgctcagctccgtggggctgctaatgctcgtaggactaccgtgggactccgaaggtggaagtaatagttgaagagtcgaacccagacctccactctctcgtcgtccgtccacccgtgaccacggcccgcctacacgtcctctgactaagtctagtcgagacgtcctgtnactagtaggtagtagtaaggaaactcttaagtacgttacggtaacgtcggtaacctgacgaagtaacgtccgacggacctacgccctaccgacgtacttctagttattacgtacgttaacgttacgaagtttcgtttagttcggagtccgacaaggactcgctacggtaggcggacggtacggcgggtaagaacgggactaattagtaccaagaacgttaaagaacgtcggaaggggccgggtaggacggtcgtaggaacggttgttcgggtagtaactttagttttaacttgtagtaactagtaaacgtaacgttaacgttacgacgtttcttacggttaccgttaggttaccgacggtaacggtaccttacggtacgtaagacaaacgtacgtaaaaccgg

SEQ ID NO: 257983 - DNA, 716 bp, Homo sapiens
  misc_feature: GYAE6OF01AZSOU.29.21.B10.1.454.CMB.1.raw
  modified_base (161)..(161): a, c, t, g, unknown or other
  misc_feature (161)..(161): n is a, c, g, or t
  modified_base (277)..(277): a, c, t, g, unknown or other
  misc_feature (277)..(277): n is a, c, g, or t
tcagatagagtactcacgaccggtgctcgatttagtgtcgtcgcaagagaggagggggactgatcaggacttctcagttcatcttctcaccatgaggctccctgctcagctcctggggctgctaatgctcgtggatactggatccagtggagatattgagntgacccagacctccgactctctctgtccgtcacccctggacacgccggcctccgatcctcctgacaagtctagtccagtacgcctgtgctatagtgaataggaaaacgacctaatntagtacgtggtacctggcaagagtcaggccagccctacgacgacctcctgtaatttagagtaacgtttcgaaggtcgtttaagtttgggatcgtacccgaagaccgtaaggtcctaacgtacgggtcgggacgaacggtccggggttacggaacggggtaccgtaaagggtaacttttaccgaaaccgttaacgttaaacgtaaaacgttaccggtaaccgggtaccgggggtaacgggaacgggttacggtacgggtaacgggttaagtttacggggtttacggtaacgtttaacgtttttaagtttacggttacggtaccgtaacgttacggtaaacgttaaaacggtttacgtaaacggttaccgttacggtttaccgttcggttttacggaccggtaacggggtacctacgttaccgtacgacgtaacgtaaccg

SEQ ID NO: 257984 - DNA, 613 bp, Homo sapiens
  misc_feature: GYAE6OF01BX8K7.29.21.B10.1.454.CMB.1.raw
tcagatagagtactcacgaccggtgctcgatttagtgtcgtcgcaaggagagaggggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctccgtgggctgctaatgctctggataccgtggatccagtggagattattgagatgacccagacctccactctctctcgtcctccacccctgacacgccggcctcatctctcgcaagtctagtcgagacgcctcgtgcatagtagacgtaggaaacgaccttatacgttagtacgtggtaccctgcgtaagaacgtcgacggtcccacgccctaccgaccgacctccgtgttaactttagtacgttaacgttttccgaagtttccgtttttagttttacgggacgttcggtacccgtaaggaccgtacgggtccttacgacggtcggacgaccgggtacggggtacggacgggaactacggtctttaacgactaactaaggaaaacgtcgacggtcggggagggtacggg

SEQ ID NO: 257985 - DNA, 791 bp, Homo sapiens
  misc_feature: GYAE6OF01DFH2B.29.21.B10.1.454.CMB.1.raw
  modified_base (217)..(217): a, c, t, g, unknown or other
  misc_feature (217)..(217): n is a, c, g, or t
tcagatagagtactcacgaccggtgctcgatttagtgtcgtcgcaaggagagagggggtcaggctggaactgaggagcgaggtgggggcacttcctccctctaacactcctccctgttgagtcttctttggtggacgggcgagctcgacggccctgagtgggtgtacttcgcgaggtcgtagtacttttgttgtttctcgtagtcctcccgtgctcncgtcgtccggtggggctgtactaagtcgtctcgtaggtactaccgtaggactcgtaaggtaggatagttgtagaagtacgtaaccgaacccgaacgtaccctaccctaccttccttccgtccttaccgtccccgtacccgtaccccgtcggaaccgccggcccgtaccctcccgtacctccgtccgtacgtaaccgtacgttacgtacgtaaccgacgtccgtaccgttggtaactagtaacgtaggtaagtaacggtaaacggtaacttaaacttagttaacgttacggtaccggttacgtacgtacgtaacgtaacggtaccgtaaccggaccggaacccgtaccctcccgtaaccgtaacccgttccgttaccgtttaagtttaacgtttaaccgtacgtttaaccgttacgttaagtttacgttttaggtacggttacgacgtaccgtaagtaccggtacgtacgtcggtggtacggacgggtacgggtaccgggtagtaaccggtacgttactaaacgttacaaacgtaacggtaagtaaaccggtcgggaacgggtcgggtaggacgg

SEQ ID NO: 257986 - DNA, 783 bp, Homo sapiens
  misc_feature: GYAE6OF01CBYXY.29.21.B10.1.454.CMB.1.raw
  modified_base (127)..(127): a, c, t, g, unknown or other
  misc_feature (127)..(127): n is a, c, g, or t
tcagatagagtactcacgaccggtgctcgatttagtgtcgtcgcaaggagagagggggtcaggctggaactgaggagcaggtggggcacttctccctctaacactctccctgttgaagcttctttgngacggcgagctcgaggccctgagtgggtcgtacttcgcgaggtcgtagttacgtttgtcgtttctcgttagtccttccgtgtcctacgacgtccgtcggtgggctagtactagtcgtcttcgtacggacttaccggtagactccggtaaggtaggaagtattaggtagtacgtacgtaccggaaccgtacgtaccctacccgttaccttccgttccgttccgttacccggttacccccgtaccccgtacccggtacggaccgtcccggtcccgtaccctacctaccgttcccgtacgtacgtaacgttaacggttcgtacgtacgaccgtccgtaccggttcggacgtaacgtagttaggtaacgtaacgtaacgtaaacgttaacttagtacgttacgtaaccggtcgtacgtacgacgtaagtaccgacgtacgacctaccgtacctacgtaccgttacgtacgttacgttacgttacgttacgtacgtttacgttaggttttacgttaggttacgtacgtacgtacgtacgtacgtacgttacgtacggtcggtacggacggtcgggtaaccggtacgtacggtaacttacgttacgtaacgtaaacgtaacggtaacgtaacggtaccgggtaacggtcgggtagggtaccg

SEQ ID NO: 257987 - DNA, 680 bp, Homo sapiens
  misc_feature: GYAE6OF01CIWUR.29.21.B10.1.454.CMB.1.raw
  modified_base (206)..(206): a, c, t, g, unknown or other
  misc_feature (206)..(206): n is a, c, g, or t
  modified_base (426)..(426): a, c, t, g, unknown or other
  misc_feature (426)..(426): n is a, c, g, or t
  modified_base (566)..(566): a, c, t, g, unknown or other
  misc_feature (566)..(566): n is a, c, g, or t
tcagatagagtactcacgaccggtgctcgatttagtgtcgtcgcaagagaggagggggtgatcaggacttctcagttcatcttctcaccatgaggctccctgctcagctccgtgggctgctaatgctctggataccgtgatcagtgagatatgagtatcgacccagacctccactcgtctctcgtcccgtaccacccgtggaaccnccggcccgcccttacacgtcctacgtgactacgtcagtcgagtacgccttacggtgctaagtgaagacgtaaggaaactactatagtacgtacgtacggtcgtagactaagtacgtcgacgccgacgccctacacgtacctacgttagtatttacgacgtttaacgttacgtacgtttaggtttagttaggaagccgtaacagggactacggcttaaggnggttacggacggcgggttaacgggagaaacgggttcaaggttaacttaccgaaactaacggtaacgaaacgttcgggaaacggggtccggtaggaacgttgaagggtcggtagttaccgttagacgtttaaagtttgtancggtaatacgtataaccgtttaagtccgtaagttcggtaactttacggttacggtaccggggaacgtaaccggaacttcggggtaacaggtaacaaaccgtaacggttaaacgg

SEQ ID NO: 257988 - DNA, 831 bp, Homo sapiens
  misc_feature: GYAE6OF01DA22J.29.21.B10.1.454.CMB.1.raw
  modified_base (257)..(257): a, c, t, g, unknown or other
  misc_feature (257)..(257): n is a, c, g, or t
  modified_base (267)..(267): a, c, t, g, unknown or other
  misc_feature (267)..(267): n is a, c, g, or t
tcagatagagtactcacgaccggtgctcgatttagtgtcgtcgcaagagaggaggggggtgatcaggcttctcagttcatcttctcaccatgaggctccctgctcagctccgtggggctgctaatgctctggactaccgtggactccgaggtagggaatatagttgaagtatacgacccagacctccacttctctcgtcgtccgtccacccgtggacacgccgcctcactctcctgactagtctagcagacgctcgnactagtacgngaagtaggaaactactattagttacgtacgttcggtaccgtgaacgaacgtaacgtccgaacggccctaacggtcccctaccgaaacgtccttaccgtaagttattttaaacgtggtttaaaccgtttaccgtaaagggtttacgtttttaaggttttacgggaacgtacggaacccgttaacggacgtacggggttacctacggaaggggtacggtaccgggtaacggggtccgggttaaccgggaacggggtaaccgttaaaggttaacccttttaacccgaaaccggtaaagtttaaaacggaaaacggtcccgggtaacggggtacccgggggttaggaacggttcgtaaggggtaacggttcggtttagggttacgtaacttttaagttttttaacggtagttccgtaactaacgggttacgttaaaacgtttaacggtttaccgaggttttacgtttaccggtttacccggtttaaacggtttcccggggaaacgttacccggggaaaccttacggtttaaccggaacgttaaacaacgttaaaacccggtaaacggg

SEQ ID NO: 257989 - DNA, 646 bp, Homo sapiens
  misc_feature: GYAE6OF01BTJIW.29.21.B10.1.454.CMB.1.raw
  modified_base (321)..(321): a, c, t, g, unknown or other
  misc_feature (321)..(321): n is a, c, g, or t
  modified_base (330)..(330): a, c, t, g, unknown or other
  misc_feature (330)..(330): n is a, c, g, or t
  modified_base (336)..(336): a, c, t, g, unknown or other
  misc_feature (336)..(336): n is a, c, g, or t
tcagatagagtactcacgaccggtgctcgatttagtgtcgtcgcaaggagagagggggtcaggctggaactgaggagcaggtgggggcacttctccctctaacactctccctgttgaagctctttgtgacgggcgagctcaggccctgatgggtgacttcgcaggcgtagtactttgtgtttctcgtagtctcctgctcagctcgtgggctgctaatgctcgtggtataccgtggtactccgaggtggagtatattgagatcgaccagactcctactctctctcgtcctccaccctggacgcgcccgcctcactcctcgtnactaacgtntacgtnacgtccgtcctcgtcgactagtaggtacgaagtaacggaaacctacttagttaacgttacgtaccgttacggtaccgtacggaacgtaacggtaacgtccgaaccggtacccgtacgtcccctaaccgtacgtaacccctttcgtttaagttacttttaacgtacgttaaccgtttaccgtaagtttccgttttaaggttcggaacgtcgaccgtaggacgtacgtcgtactcgggtagcggtacggtacgggcggaacggtactaggttacctacgatacgtaacgaacgtcggccgggagggtggacg

SEQ ID NO: 257990 - DNA, 635 bp, Homo sapiens
  misc_feature: GYAE6OF01A7FOP.29.21.B10.1.454.CMB.1.raw
  modified_base (160)..(160): a, c, t, g, unknown or other
  misc_feature (160)..(160): n is a, c, g, or t
  modified_base (170)..(170): a, c, t, g, unknown or other
  misc_feature (170)..(170): n is a, c, g, or t
  modified_base (247)..(247): a, c, t, g, unknown or other
  misc_feature (247)..(247): n is a, c, g, or t
  modified_base (420)..(420): a, c, t, g, unknown or other
  misc_feature (420)..(420): n is a, c, g, or t
  modified_base (428)..(428): a, c, t, g, unknown or other
  misc_feature (428)..(428): n is a, c, g, or t
tcagatagagtactcacgaccggtgctcgatttagtgtcgtcgcaagagaggagggggtgatcaggacttctcagttcatcttctcaccatgaggctccctgctcagcctccgtggggctgactaatgctctggatacctggatccagtggagatatganatcgacccanactccactctcgtctcgtccgtccacccgtgacacggccgcctcactcctccagactaagtctagtacgagcgtccngtgactagtacgtagaagtagggaaactacctaatagttacgacgtacgtaacgtcgacgtaagaagtcgacggacctacgacctaccgacgtacctcgtacgttattacgtacgttaacgttacgtaagtcgtttagttaggagtacgacagtaacggtacgctagtaacgnggtaccgnggcggtagacggatagtactacataacgtaagaactcgacgggtacggtagaggtcgtaggaagtacgtaggttacgtagttactttaagtattacgactagtactaacgtaaacgttcgtagttacgtcgttacccggttaaggtttcccggaacggacggttacccgtaaagtccgtaaacggtaactaacggttaacgaaacgg

SEQ ID NO: 257991 - DNA, 944 bp, Homo sapiens
  misc_feature: GYAE6OF01EA1O6.29.21.B10.1.454.CMB.1.raw
  modified_base (212)..(212): a, c, t, g, unknown or other
  misc_feature (212)..(212): n is a, c, g, or t
  modified_base (222)..(222): a, c, t, g, unknown or other
  misc_feature (222)..(222): n is a, c, g, or t
tcagatagagtactcacgaccggtgctcgatttagtgtcgtcgcaagagaggaggggggtgatcaggacttctcagttcatcttctcaccatgaggctccctgctcagctccgtggggctgctaatgctctaggataccgtggactccagtggatattagttgagatcgaccagacctccacttctctctcgtcccgtccacccgtaggacncgcccgtccncactctctgactaagtctagcagtcgtccttgacgactagtaggtagtaagtaggaaaacgtacttaagttcgtacggttaacgtttcggtaactcgacgtaaacggtacgacgccggaccgtaccctaccctacccgaccgttacctacgtttacgttaaattttacggaaaggttttaacccctttaaagggtaccgttttaaggtttttttacgggttaacgtacggttacccgaacggtaaccgtaaaccggtacggttaccgttaacgggtacgggtacggaaccgggttacggggggtacggtaaccgggggaacgttaaccgggtaactttttacccggtaaaccgtaacccttacgggttaaaaaaccgtaaccggtaaccggggtacgggggttaaccggggtagggggttacccggtaagggttaaccggggtaaaggggtttaccggttttaggggtttaacccgttaacggtttttttaaagtttttaacgttaaccgggtttaaacgtaacccgtttaaagggttaaaccggttaaaccggtttttaaaaccgtttacgggtaacctttaccgggttttttacggtaaacccggttttttacgggggttaccccggaaacgggggtttaaccccgttaacccggttaacccgggttaccggttaaaacccgtaacggtttaaaccgttaaacccggggttaaaaccggg

SEQ ID NO: 257992 - DNA, 866 bp, Homo sapiens
  misc_feature: GYAE6OF01DDH6G.29.21.B10.1.454.CMB.1.raw
  modified_base (246)..(246): a, c, t, g, unknown or other
  misc_feature (246)..(246): n is a, c, g, or t
tcagatagagtactcacgaccggtgctcgatttagtgtcgtcgcaaggagagagggggtcaggctggaactgaggagcaggtgggggcacttctccctctaacactctcccctgttgaagcttctttgtgacgggcgagctcacggccctgagtgggtgacttcgcgaggcgtagtactttggttgttctcgtagtcctaccctgctcagcctcgtgggactgactaatgctcgtaggactaccgnggactccgtaggtaggaacgtatagttagacgtacgtaccgaacccgtacgtaccctacctaccttccttaccgttaccgttccggtaccccgtaccccgtaacccggtacggaaccgtacccggtaccccgtacccttaccgtaccgttccgttaccgtacgtaaaccggttaaacgttaccgttaacggtaccgtacggtaccgtaccttacggtagtaacgtaacgtaaggtaacggtaaacggtaaacggtaaacgtaacgttaacgttacgtaacggttaccgtaccggtaacgtacggtaacgtaaacggtaacggtaaccggaaccgtaccccgaacccggttaacccgtaacccggtaaacccgttaccgttaacgtttaagtttaacgttaaacgtttacggtttaaaccgtttaacggtttaacggtttaacggttttacggttaacggtacggtaccggaacggtacggtaacgtacggttacgtacgggtacggtaccggtacggtaccgggtacgggtaacggtaacgggtacgtaacgttaaccgtaacctaacggtaaacgttaacggtaaacggaccgggtaacgggacgggtacgggtaacgg

SEQ ID NO: 257993 - DNA, 756 bp, Homo sapiens
  misc_feature: GYAE6OF01ARUVH.29.21.B10.1.454.CMB.1.raw
  modified_base (215)..(215): a, c, t, g, unknown or other
  misc_feature (215)..(215): n is a, c, g, or t
  modified_base (661)..(661): a, c, t, g, unknown or other
  misc_feature (661)..(661): n is a, c, g, or t
  modified_base (741)..(741): a, c, t, g, unknown or other
  misc_feature (741)..(741): n is a, c, g, or t
tcagatagagtactcacgaccggtgctcgatttagtgtcgtcgcaaggagagagggggtcaggctggaactgaggagcaggtgggggcacttctccctctaacactctccctgttgaagcttctttgtgacgggcgagctcgacggccctgagtgggtgtaccttcgcgacggcgtagtacgttttgttgtttcgtcgtacgtcctcctgtctcncgtctcgtgggctagctaatcgtctcgtgtactaccgtggtactcgtaggtaggagtagttacgttagagtacgtaccgtaccgtacgacctcctaccgttcctccgttccgttccgtaccccgtacccgtacccgtacggaccgaccgtcccgtccctacctcctccgtccgtacgtaccgtaacgttctacgtacgacgccgtccgtcgtcacgtagtagtacgtaacggtaacgtaactaacttagttacgtacgttaccgtacgtacgacgacgtaacggtacggtaccgaccgtacccgtacccgtacccgtaccgtaacgttacccgttagttaacgtttaacggtttaaacgttacgtttaaaccgttacggtttaacggttttacggtttaggttacggtaccgttacgaccgtacgtaccggttcgacggttaccgnggtacgcgggtacggtaccgggtaacgacggttaacgtacgttaactaacgtaacggtaagtaaacggacggtaacgggnggtcgggtaggtacg

SEQ ID NO: 257994 - DNA, 797 bp, Homo sapiens
  misc_feature: GYAE6OF01COM1Z.29.21.B10.1.454.CMB.1.raw
  modified_base (128)..(128): a, c, t, g, unknown or other
  misc_feature (128)..(128): n is a, c, g, or t
  modified_base (158)..(158): a, c, t, g, unknown or other
  misc_feature (158)..(158): n is a, c, g, or t
tcagatagagtactcacgaccggtgctcgatttagtgtcgtcgcaaggaggagagggggtcaggctggaactgaggagcaggtagggggcacttctccctctaacactctcccctgttgagctcttgngacgggcagctcgacggccctgagtgggtnacttcgcgaggcgtagtacgtttgtgtttctcgtagtcctccctgcctcagtcctcgtggggctgactaagtcgcctcgtaggactaccgtggactccgtaggttcggaagtatagtgaagtagtcggaacccagtaccctaccgtactcctcgtactcggtccgtccacccgtggacctacggcccggccctccgtatcccgtccgtacgtaacctaacgttacctacggtacgacggtacggcccttcggactactagtaacgtagtagtaacgggtaaacgttacctattaacgtacgttaccgttcgtaacctcgtaacgtaaggtaccgtcgtaacggacccgtaccgtcccgttaaccaaccggttacccgtaccgttaagttaacgttttactaaccgggttaacgttttaacccgtaacggtttacgggttttagttttccgggaacgtacggtaaacccggtacggttaccggtacgttaccgttacggtaagggtaccgggtacgtacgggggtaccggaacgggtacggttaccggtaacggtttaaaccgttaaccctacccggtaacgttaaacgggtaaaacccgttcccggaaccgggggtccggggtacgggttaaacccggg

SEQ ID NO: 257995 - DNA, 812 bp, Homo sapiens
  misc_feature: GYAE6OF01EKVFW.29.21.B10.1.454.CMB.1.raw
  modified_base (105)..(105): a, c, t, g, unknown or other
  misc_feature (105)..(105): n is a, c, g, or t
  modified_base (130)..(130): a, c, t, g, unknown or other
  misc_feature (130)..(130): n is a, c, g, or t
  modified_base (383)..(383): a, c, t, g, unknown or other
  misc_feature (383)..(383): n is a, c, g, or t
  modified_base (401)..(401): a, c, t, g, unknown or other
  misc_feature (401)..(401): n is a, c, g, or t
  modified_base (451)..(451): a, c, t, g, unknown or other
  misc_feature (451)..(451): n is a, c, g, or t
tcagatagagtactcacgaccggtgctcgatttagtgtcgtcgcaaggagagagggggtcaggctggaactgaggagcagggtgggggcacttctccctctaacnctctcccctgttgaagcttctttgnggacgggcgagcctacacggccctagagtgggtcgacttcgcgagggtcgtagtactttggttgtttctcgtagtccttccctgctcgtacgcgtccgtggggtctcaacttaatcggtcttaccgtaggaacctttacccgtaggtaccttaccgtagggtagggaagttaattaagttagtaacggaagtaccgaacccgtactacctaccctacgttccttctccgttaccgtcccgtacccctacccgngaccgaccggcccgtccncccgtatcctccgtagaccgtaagtctacgtcgagaccgtccgtacgtanacgtacgtagtaagacgttaaacgaaacgtaccttaagtcgtacggttaactcgggtaacgtacgtaagaacgtaaaccgtacgtaccggaccgtaccgtcccgtaacccgtacgtacccgtttaaccgtagttttaaacgttaacgtttacccgggttaaaacgtttttacccgttaaacggttttaggttttaacgtaacgggtttaacggacctaaacgggaacctaacggtacgtaacgtcggaaggccggtaaccgtaagggggttaccggtaacgggtaacggaacttaggttaaacctacggaactaaacggttaaacgaaacgtaggtacggggtaacgggtagggtaacggg

SEQ ID NO: 257996 - DNA, 729 bp, Homo sapiens
  misc_feature: GYAE6OF01B4BX7.29.21.B10.1.454.CMB.1.raw
tcagatagagtactcacgaccggtgctcgatttagtgtcgtcgcaagagaggagggggactgatcaggacttctcagttcatcttctcaccatgaggcctccctgcctcagctccgtggggctgctaatgctcgtggataccgtggactccgaggtggagtatattgagatcgacccagacctccactctctctcgtcccgtccaccccgtggaccacggcccgtcctacctacttcctccgtgtaccgtaacgttcgtacgtcgaaggtcgcccttggtacgactaagttaggtagtaacggtaaggaaacgtaccttaagtacgttacggtaacgttccggtaccgtgtaacgtaacggtaacgtccggaaccggtacccaccgtccctaccgtacggtaaccttcgttaagttaacgtttacgtacgtttaaaccgtttactaaacgggttcgttttaagtttcggaagtcgaccgtaagtaccgtggttacctaggacgtacggagtaccgggtcggtacggaacggtaattacgttacctgaaacgtacgtaagtaacgtcgggtacggtgggtagcggtcgttaaggcggttaagttcggttaacgtattttagttacgttagttcggacttaaggtcgtaaacttagttacgcgtttgttaccgtaacggtttcggaccggtacgaacgtccttacggaccgtagaaccttaagtaacccgg

SEQ ID NO: 257997 - DNA, 664 bp, Homo sapiens
  misc_feature: GYAE6OF01DOPRG.29.21.B10.1.454.CMB.1.raw
  modified_base (223)..(223): a, c, t, g, unknown or other
  misc_feature (223)..(223): n is a, c, g, or t
  modified_base (555)..(555): a, c, t, g, unknown or other
  misc_feature (555)..(555): n is a, c, g, or t
  modified_base (566)..(566): a, c, t, g, unknown or other
  misc_feature (566)..(566): n is a, c, g, or t
tcagatagagtactcacgaccggtgctcgatttagtgtcgtcgcaagagaggagggggtgatcaggacttctcagttcatcttctcaccatgaggctccctgctcagcctccgtggggctgctatgctcgtggactaccgtggactccgaggtaggagtattagttgagatccgacccacgacctccacttctccgtcttcgtcccgtcccacccgtggaccncggccccgtcctacctctcctccgagactagtctagcgagtccgtctcgtagactagtgtagaagtaaggaaactactagttagttcgtacggtacggtacctgaagacgtacgccgacggcccacggtccctaccgaccgtactcgtaagttactttagacgtttaaccgttacgtagtttcggtttagttcggacggtccaacgacggtacgtcggtcgtcggtaggtcggacgggcggtaccgggaagggacgtataccgttactaacgaacgtaactaagaaccggtgggaccgggtgggacgtggtcgaggtcgtgtttgtacgttnttagttttacnggtactgtacgttacgtaaacttagtccgttagtcgttttacgttacccggttaggtacccgcggtacgaccctttgcgaataccctagtaacgtacg

SEQ ID NO: 257998 - DNA, 767 bp, Homo sapiens
  misc_feature: GYAE6OF01EOJA7.29.21.B10.1.454.CMB.1.raw
  modified_base (685)..(685): a, c, t, g, unknown or other
  misc_feature (685)..(685): n is a, c, g, or t
  modified_base (760)..(760): a, c, t, g, unknown or other
  misc_feature (760)..(760): n is a, c, g, or t
tcagatagagtactcacgaccggtgctcgatttagtgtcgtcgcaaggagaggagggggtcaggctggaactgaggagcaggtggggcacttctccctctaacactctccctgttgaacgctctttgtcgacgggcgagctcacggcctgagtgggtgtacttcgcgaggtcgtacgtactttgttcgtttctcgttagtccttccgtgccgtcgacgtccgtccggtacggggtctcgactaagttcgctcgtggtactaccgtaggtactccggaggtgagtagttagttaggacgtactaccgaccgtagaacctcctaacttccgttaccttccgttccgtaccccgtaccctacccggtagggaaccgtccgcccggtaccttaccgacttccgttaccgtacgtaacgtacgttcttacgaccgtacgtacgtccttacggacgtagtaagttaggtacgtaacgggtaaacggtaaaccgttaacttagttacgttcggtaaccgttacggaactcggtaactaacggtaccgtacggaaccgtcccgtaacccgtcccttaaccggtactaccgtttacgttacgtttagtttaacggtacgtttaaaccgttcgtaaaggttttcggttttaagttcggacgttacgaaccgtacggtacgtcgtccgtaaccggngggtcgtacgggaccggtccgggtaacgaggtaactacgttactacaacgtacgtaagaacgtcgacgggttggngtaacgg

SEQ ID NO: 257999 - DNA, 870 bp, Homo sapiens
  misc_feature: GYAE6OF01D7K36.29.21.B10.1.454.CMB.1.raw
  modified_base (213)..(213): a, c, t, g, unknown or other
  misc_feature (213)..(213): n is a, c, g, or t
  modified_base (272)..(272): a, c, t, g, unknown or other
  misc_feature (272)..(272): n is a, c, g, or t
tcagatagagtactcacgaccggtgctcgatttagtgtcgtcgcaagagaggagggggtgatcaggacttctcagttcatcttctcaccatgagctccctgctcagctccgtggggctgctaatgctctggactacctggactccgaggtggagtattagttgagtatcgaacccagacctcctacttctcttctcgtcctccaccctggacncgccgtcctctactcctcctgacgtaactctagtcgaagcgtcctgtgactagtagganaagtaaggaaactaacttattattacgttacggttacgtactcgacgtaacggtacgtacggaccgcctaccgtaccctaccacgtaccttcgttaagtttacgtttagttaacggtttaacgttaacgttaggtttacggtttttagttacggtacggtaaccgtaacggtaaggaccgtacggttacgtacggtacgggtaccgggacgggtaacggggtaccgggtaccggggaaaggtaccggttaacgtttaacccgttaaccgaaacgtttaaaacgggtaaaaccgtaaacgggttccggggtaaaccgggggtccggggggttaacggaaccgggtttacgggtaagggtaacgggtttaggtttacccggttttaaggttaaccgtttttaaagtttttaagttaccgtttacggttaacgtttaacgggttaaccggttaaaaacgtttacggttacgtttaaccgggtttacggttttccgttttaccgggtttaaaccggggtttcccgggggaaaaccggtttaccgggttaaccgttacccgggtacggtaagtaacccgtttaaacgaaacccggttaacggg

SEQ ID NO: 258000 - DNA, 717 bp, Homo sapiens
  misc_feature: GYAE6OF01CH726.29.21.B10.1.454.CMB.1.raw
  modified_base (610)..(610): a, c, t, g, unknown or other
  misc_feature (610)..(610): n is a, c, g, or t
tcagatagagtactcacgaccggtgctcgatttagtgtcgtcgcaaggagagagggggtcaggctggaactgaggagcaggtgggggcacttctccctactaacactctcccctgttgaagctctttgtgacgggcgagctcaggccctgagtgggtgacttcgcgaggcgtagtactttgtgtttctcgtagtcctccctgctcagtctcgtgggctgactaatgctgtggtactaccgtggacttccgtaggtaggacgtagttagttagaacgtagtccgaacccgacgtaccttccctaacttccttcttccgttccgttaccccgtccgtaccccgtcggaccgaccggcccggtcctacctacgttcctacgtcgaacgtaacgtcgtacgtacgaacgtcggtcctcgtacgtactagttagtacgtaacgtaacggtaaactaaccgttaattacgttaacgttaccgttacggtaacttaggaccgtaaggtaacgttccgaacggtacctaccccggtccctaacccgacgttaaccttccgtatttaaaccgtttagacgttaacccgtttacaggtttcgttttaagtggacgttacnccgtagtaacgcgttaccgacgacggttacgcggtccggtaggtacgaacggtattagtaccgttaacgaataaccggtataaacgcggtacggtcggaggtaccgg

SEQ ID NO: 258001 - DNA, 715 bp, Homo sapiens
  misc_feature: GYAE6OF01C0FXN.29.21.B10.1.454.CMB.1.raw
  modified_base (104)..(104): a, c, t, g, unknown or other
  misc_feature (104)..(104): n is a, c, g, or t
  modified_base (227)..(227): a, c, t, g, unknown or other
  misc_feature (227)..(227): n is a, c, g, or t
  modified_base (435)..(435): a, c, t, g, unknown or other
  misc_feature (435)..(435): n is a, c, g, or t
  modified_base (496)..(496): a, c, t, g, unknown or other
  misc_feature (496)..(496): n is a, c, g, or t
tcagatagagtactcacgaccggtgctcgatttagtgtcgtcgcaagagaggagggggtcaggctggaactgaggagcgaggtggggcacttctccctctaacnctcctccctgttgaagtcttctttgtgacgggcgagtctcgaggccctggagtgggtgtacttcgcgaggcgtagtcttttgttcgtttctcgtagtcgtgtctttgctcgagcgtgagggtncgtgcgtggacggtgtagtggtgtacgttcgttccttggactaagtcgacttcgtagtacgttaccgtaggactcgtaggtaggatagttagtagaagactaccgaaccagtaccctacctactcttcgtcttacgtcccgtacccacccgtaggaccacgccgtccactactcgtctacactaacgttcgacgacacggccttccgnggtacacgtagtacgtaaggagtaacggaaactacgttagacgttagtacgtacgttaccngtaacgaagtacgacgaaccggcctaaccgaccgttaaccaaccggttccctaaacgttagttaaccgtttaacgtttacggtaaacccgtttacgtaaaacggtttgttaacgggttaccggtacgttaacccggagaaacccgggtaggttacccgtaacccgttaacggtaccggggtcggaaacccggttcggaaccccgggggttaagaaacgg

SEQ ID NO: 258002 - DNA, 508 bp, Homo sapiens
  misc_feature: GYAE6OF02IT0Q7.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctcacgactcctgatttatgaagtttccaagtcgtttatttggagttcgaccagacaggctcaagtgcagcgggtcagggacagtatttcacactagaaactcgacggtccgggtaggacgg

SEQ ID NO: 258003 - DNA, 517 bp, Homo sapiens
  misc_feature: GYAE6OF02GOST4.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagactccactctctctgtccgtcacccctggacagccggcctccatctcctgcaagtctagtcagagcctcgtgcatagtgataggaaagacctatatgtactggtactgcagagtcaggccagcctaccgacgactcctgtatttatagtaagtttccaagtcgtttagtttggagtcgccagacgagctacgagtggcaggcgggtacaggggacaggtatttacacgtactagaaatcgaggccgggtggacgg

SEQ ID NO: 258004 - DNA, 506 bp, Homo sapiens
  misc_feature: GYAE6OF02GJGPN.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttatgaagtttccaagtcgtttattttggagtgccagacaggctcagtggcaggcgggtcgagggacagatttcacactagaaaatcgaggccgggtggacggg

SEQ ID NO: 258005 - DNA, 502 bp, Homo sapiens
  misc_feature: GYAE6OF02GXKWA.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagagtcaggccagcctccacgactcctgtatttatgaagtttccaagtcgttatttggagtgccagacaggctcagtgcagcgggtcagggacaggatttcacactaggaaatcgaggtccgggtggacgg

SEQ ID NO: 258006 - DNA, 532 bp, Homo sapiens
  misc_feature: GYAE6OF02HPCXD.29.21.B10.1.454.CMB.1.raw
  modified_base (410)..(410): a, c, t, g, unknown or other
  misc_feature (410)..(410): n is a, c, g, or t
  modified_base (454)..(454): a, c, t, g, unknown or other
  misc_feature (454)..(454): n is a, c, g, or t
tcagatagagtactcacgaccggtgctcgatttagtgtcgtcgcaaggagagaggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagactccactctctctgtccgtcacccctggacagccggcctccatcctcctgcaagtctagtcagacgcctcgtgcatagtgaatggaaaacgcctaatatgtactggtacctgcaagaatcagccagcctccacgactcctgtatttangtaagtttccaagtcgtttatttggacgttgccagacagtcctnagtgcaggtcgggtcgaagggaccaggtactttacaactaccgtagaaaattccggaaggtcccgggtaggtaacggg

SEQ ID NO: 258007 - DNA, 550 bp, Homo sapiens
  misc_feature: GYAE6OF02HUWDI.29.21.B10.1.454.CMB.1.raw
  modified_base (420)..(420): a, c, t, g, unknown or other
  misc_feature (420)..(420): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctgtagtctccctgctcagctccgtggggctgctaatgctctggatacctggatccagtggagatattgagatgacccagactccactctctctcgtcccgtccacccctggacacggcccggcctccatcctcctgcaagtctagtcagacgcctcgtgacatagtgataggaaatacctatatagtacttggtacctgacagaagtcgaggccagccctcacgactctatatttangtaacgtttcaagtcgtttagtttggagtgccagacgagctacgaggtcgcgaggtccgggtgaacggggaactagtaactttaccgaactacgttaaggaaacttcggacgggtccggggtagaacggg

SEQ ID NO: 258008 - DNA, 889 bp, Homo sapiens
  misc_feature: GYAE6OF02HNMUO.29.21.B10.1.454.CMB.1.raw
tcagatagagtactcacgaccggtgctcgatttagtgtcgtcgcaaaggaaggagaggggtgatcgaggacctttctcccgagttccaagtcctttcctctaccgatgaggctcccctgtctcacgctccgtgggggcctgcctaaatggcttcggtggatacctggagtccttagtggtagatatttgagtatcgacccagctccgactcgtcctcgtgtaccgtccacccgggtcgtacgtacgccggccctccgggactcgtaccgtcgtccaacgttcgtagtcaggacgtccttcggtgtccaagtttaggtaggacttacgggtaaacgtcccttaagttaacgttgggttacccgttcgggttaaccccgtggtacccgaagggggtaaacgggtcctaaggggaccccgtaggggtcccctaccccgaacggacccttacccgtacggtaactttttaaacggaacgggttaaaccgttttacccgaaaaagggttaccgtttttttaaagtttttacgggggaacgtttcccggtaccccgtaagggttaaaccggaacgggggtacccttacgttaacgggtaccggtacgtacgggtacccggggttacgaaacgggggtaacctaaaggttacgttttaaccgaaaccgttacgttaacggtaaaaacgtttccgaacgggtaccccggggtagggtacggtcggtacgggtaacgggttacgttgggttaccggacgtaacgttttaaggttacgttacgtcgttaagttacgtaacttaagtttccgtaacgttcgttaaggttccttaacggttttacggacccgtaacgggttacctaacgtttccgttacggaactacggtaccgtaaacgg

SEQ ID NO: 258009 - DNA, 592 bp, Homo sapiens
  misc_feature: GYAE6OF02GKNUQ.29.21.B10.1.454.CMB.1.raw
  modified_base (353)..(353): a, c, t, g, unknown or other
  misc_feature (353)..(353): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagacctccactctctctgtccgtcacccctggacacgccgcctccatcctcctgcaagtctagtcagacgcctcgtgcatagtgataggaaanacctatatgtactggtacctgcagagtcaggccagcctaccacgtacctccgtagtactttagtacgtaacgtttaccaaggttccgttttaagttttgggagttcgacccaaggtaccgagggtccttacggtaaggtcggaccgtagggtccggggtacgaacggggtaacctagggtaactttacgaacgtaacgtacggtaaaacgttccgaacgggtccggggtaggtaacggg

SEQ ID NO: 258010 - DNA, 534 bp, Homo sapiens
  misc_feature: GYAE6OF02G0XCH.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagactccactctctctgtccgtcacccctggacacgccggcctccactcctcctgcaagtctagtcagacgcctcgtgcatagtgagtaggaaagacctatatgtactcggtactgcagagtcgaggccagcctccacgacctcctgtatttatgtaagtttccaagtccgtttagttttggagttcgacctaagacaggtcctagaggtggcaggtccgggtacgagggactagtacttacactacgtagaaactcgaggtccgggtagacgg

SEQ ID NO: 258011 - DNA, 541 bp, Homo sapiens
  misc_feature: GYAE6OF02JA9H3.29.21.B10.1.454.CMB.1.raw
  modified_base (351)..(351): a, c, t, g, unknown or other
  misc_feature (351)..(351): n is a, c, g, or t
  modified_base (406)..(406): a, c, t, g, unknown or other
  misc_feature (406)..(406): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagactccactctctctcgtccgtcacccctggacagccggcctccatctcctgcaagtctagtcagacgcctcgtgcatgtgataggaaanactatatgtactggtacctgcagaagtcgaggccagcctaccgacgacctccgtntatttatcgtaatttccaagttcgtttagttttggagtcgaccagtacgaggtctcgaggttcgagcggtcgggtacgagggactaggtaactttcaacgtacgtaagaaactcggaacgggtccgggtggacgg

SEQ ID NO: 258012 - DNA, 635 bp, Homo sapiens
  misc_feature: GYAE6OF02FTKSS.29.21.B10.1.454.CMB.1.raw
  modified_base (351)..(351): a, c, t, g, unknown or other
  misc_feature (351)..(351): n is a, c, g, or t
  modified_base (371)..(371): a, c, t, g, unknown or other
  misc_feature (371)..(371): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagactccactctctctgtccgtcacccctggacagcccggcctccatctcctgcaagtctagtcagacgcctcgtgcatgtgataggaaanacctatatgtactggtaccngcagaagtcagccagccctacccacgacctcccgtagtaattttactagtaacgttttaccgaaggttccggttttaagtttttacgggtaagtttcggacccgtaaggtaccgtaagggtcttaccggtaagggttcgggaccgtacgggaccgggggttaccgaagggggtaaccctaagggttaacctttttaccgaaccgttaacggttaacggtaaaaacgttaccggtaacgggtacccgggggttagggaaccgggg

SEQ ID NO: 258013 - DNA, 517 bp, Homo sapiens
  misc_feature: GYAE6OF02IQCAB.29.21.B10.1.454.CMB.1.raw
  modified_base (408)..(408): a, c, t, g, unknown or other
  misc_feature (408)..(408): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgacctcctgtatttangtaagtttccaagtcgtttatttgggagttcgccagacaggtctcagtgcagcgggtcgaagggacaggtactttcgactactagaaactcgaaggtcgggtaggacgg

SEQ ID NO: 258014 - DNA, 599 bp, Homo sapiens
  misc_feature: GYAE6OF02GGV4Z.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagactccactctctctgtcccgtcacccctggacacgccggcctccatcctcctgcaagtctagtcagacgcctcgtgcatagtgataggaaacgcctaatatgtactggtacctgcaagaagtcgaggccagccctaccacgtacctcctagtaactttagtagtaacgtttaccgaagttcgtttaagttttcgggagttcgaccgtagaccgtagggtcctagagttcgggacgtagggtccggggttacgaaggggtaacctaaggttaaccttttaacgaaccgttaacgtaacggtaaaaccgtccggacgggtaccggggtaggtaacgggg

SEQ ID NO: 258015 - DNA, 574 bp, Homo sapiens
  misc_feature: GYAE6OF02JCW38.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagactccactctctctcgtccgtccacccctggaccacgcccggccctccatcctcctgcaagtctagtcagacgcctcgtgcatagtgataggaaagtacctatatgtacgttggtacctgacagaacgtcacggccacgccctaccaccgacctcctagtaactttagtagttaacgtttccaagtcgtttatttgggagtcgccgaagacgtacgactcgaaggtgacgagggccggtacggaacgggactaagtactttacgaacgttacgtaacggtaaatccggaacgggtaccggggtaggtacggg

SEQ ID NO: 258016 - DNA, 609 bp, Homo sapiens
  misc_feature: GYAE6OF02HYDCB.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagactccactctctctcgtccgtaccacccctggaccacgcccggcctccactcctcctgcaagtctagtcagacgccttcgtgcatagtgaataggaaacactatatcgtactgtactgacagaacgtcgacggccagtccctaccacgtacctcctagtaattttatacggttaacgtttaccgaagttccgttttaagtttgggaagttccgacctaaggaacgtaggtcctacgaggtcggtaccgtagggccggggttaaggaacggggtactaaggttactttaaccgaacttacgtaacggtaaaaccgttccgggaaccgggtccggggtagggtaacggg

SEQ ID NO: 258017 - DNA, 540 bp, Homo sapiens
  misc_feature: GYAE6OF02IYB2V.29.21.B10.1.454.CMB.1.raw
  modified_base (353)..(353): a, c, t, g, unknown or other
  misc_feature (353)..(353): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagactccactctctctgtccgtcaccctggacacgccggcctccatcctcctgccaagtctagtcagacgcctcgtgcatagtgataggaaanacctatatgtactggtacctgacagaacgtcaggccacgcctaccacgacctcctagtactttatgtaacgtttccaagtcgtttagtttggagtgaccagacaggctacgagtgcgagcgggtcgaagggactaaggtactttacaacgtacgtaggaaaacgtcgaacggtccgggtaggacggg

SEQ ID NO: 258018 - DNA, 618 bp, Homo sapiens
  misc_feature: GYAE6OF02GV44H.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctccgtggggctgctaatgctctggatacctggatccagtggagatattgagatgacccagactccactctctctgtccgtcaccctggacacgccggcctccatcctcctgcaagtcctacgtcagacgtcctcgtgcagtagtagtagtaggaaacgtacctatagtcgtaacgtcggtacctagctaagttaacgtacgacggcccacgtccctaccaaccggtaccctcccgttagtaacttttacgtagttaaacgtttaccgaaggtttcgttttaagttttgggaacgttcgaacccgtagaccgtacggtccacgtaggtcggcgacgggtccggggtacgaacggggacaagttacttcgaaccgtattaacggaaactaccggacgggtaccgggtagggtaacgg

SEQ ID NO: 258019 - DNA, 699 bp, Homo sapiens
  misc_feature: GYAE6OF02HN7S4.29.21.B10.1.454.CMB.1.raw
tcagatagagtactcacgaccggtgctcgatttagtgtcgtcgcaaggagagagggggtcaggctggaactgaggagcaggtgggggcacttctccctctaacactcctcccctgttgaagctctttgtgacgggcgagctcaggccctgagtgggtgacttcgcaggcgtagtactttgtgtttctcgtagtctccctgctcagctccgtgggctgctaatgctcgtggactaccgtggactccgaggtggagtatagttgagatacgaacccagacctccactctctctcgtcctcctaccccgtggaccacggcccggccctccactcctcctcgactaacgtctagtcgaaggacgtcctacgtgactagtagtagaacgtaggaaaacgtacctaataacgttacgttacgtacgggtacccttaggactaaaggtaacgtccgaacggcccacgtccctacccgtaaccgtccttacgtaggttaaacttttagtacgttaaacgtttaccgaaaggtttaccgtttttaagtttagggacgttaccgacgtaaggtacgacggtaccgtagaacgggttacgacgacgggtaccggggtacggaaacgggtaacctaggtttaacctttacccgaaacgtaacggttaaagaaaaccggttcccggaacggggtcccgggttaagggacggg

SEQ ID NO: 258020 - DNA, 690 bp, Homo sapiens
  misc_feature: GYAE6OF02G4MXQ.29.21.B10.1.454.CMB.1.raw
  modified_base (325)..(325): a, c, t, g, unknown or other
  misc_feature (325)..(325): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagacttttgtgtttctcgtagtctccctgctcagctccgtggggctgctaatgctctggatacctggatccagtggagatattgagatcgacccagacctccactctctctcgtcccgtccacccgtggaccacggccccggcctccactcctccncgacaacgtctacgtcgaacgtcgcctcgtcgactaagtggtagtaacgtaagggaaaactaccttaagtaagttacggttaccgttacgggttaacctcggaacgaaggtaacggtaccgacgggtaccctacgtccctaccgaaccgtaccttccgtagttaactttacgtacgttaaccgtttacgtaacggtttacggtttttagtttacgggtaacggtcgtaccgtaaaggtaccgtaggtcccttacggtaacggtcgggacgtacgggtccgggtacggtaacgggtaactacggttacgtttaccgaacgtacgttaacggaaaacttcgggaacgggtccggggtaggtaacggg

SEQ ID NO: 258021 - DNA, 581 bp, Homo sapiens
  misc_feature: GYAE6OF02HTKQG.29.21.B10.1.454.CMB.1.raw
  modified_base (434)..(434): a, c, t, g, unknown or other
  misc_feature (434)..(434): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagactccactctctctcgtccgtccacccctgacacgccggcctccatcctcctgcaacgtctagtcagacgcctcgtgcatagtgataggaaaacgacctaatatcgtactcggtaaccttgacaaggaaagtcgaaggcccagccctaccacgacttcctagtaattttagngtaaactttccgaagtccgttttaagttttcgggagttcgacctacggaacgagcctagaagttcggactagggccgggttacgaacgggtacaagtactttaccaactacgtaagaaaagtccgaacggtaccggggtggtaacgg

SEQ ID NO: 258022 - DNA, 525 bp, Homo sapiens
  misc_feature: GYAE6OF02H2Q0G.29.21.B10.1.454.CMB.1.raw
  modified_base (352)..(352): a, c, t, g, unknown or other
  misc_feature (352)..(352): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagactccactctctctgtccgtcacccctggacagccggcctccatctcctgcaagtctagtcagagccttcgtgcagtagtgataggaaancctatatgtactggtacctgcagaagtcaggccagcctccacgactctgtatttatgtaagtttccaagtcgtttagtttaggagtcgaccagacgacggtctcgagtggacaggcgggtacgagggtacagtatttccgaatacgtaagaaatccgaggtccgggtggacgg

SEQ ID NO: 258023 - DNA, 686 bp, Homo sapiens
  misc_feature: GYAE6OF02IJ0IB.29.21.B10.1.454.CMB.1.raw
  modified_base (477)..(477): a, c, t, g, unknown or other
  misc_feature (477)..(477): n is a, c, g, or t
tcagatagagtactcacgaccggtgctcgatttagtgtcgtcgcaaggagagaggggtcaggctggaactgaggagcaggtgggggcacttctccctctaaacactctcccctgttgaagctactttgtgacgggcgagctcaggccctgatgggtgacttcgcaggcgtagactttgtgtttctcgtagtctcctgctcagctcctggggctgctaatgctcgtaggtactaccgtggactccgtaggtgggatagttacttggagtagttacgaacccgagtacctcctaccttccttccttcgttccgttcccctacccctacccggtacgaccgtacccggtcccgtcccctaccgttaccttccctccgtccgtaaccgttacgttccgttacggaccgtaagtccgtacgtcgtacgtatagtcgtagtaaggtaacgtaactacgtaatcgttacgtacgtaccgtcganacgtaagtcgacgacgacgacgccacgacctctacgtagttacttagaacgtttaccgtacgtacgtttagtttaacgtggtaacggccgaacgtacgtaacgtcgtcgtacggtaggtcgacggtacgggtacgacgggaacgtacgtaagttcccttaacgaacgtacgtaaagtacccgtacggtacgggtcccgggaagtccggg

SEQ ID NO: 258024 - DNA, 628 bp, Homo sapiens
  misc_feature: GYAE6OF02HZS71.29.21.B10.1.454.CMB.1.raw
  modified_base (573)..(573): a, c, t, g, unknown or other
  misc_feature (573)..(573): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctccgtggggctgctaatgctctggataccgtggactccgagtggagattagttgagatcgacccagacctccactctctctcgtccgtccacccgtggaccacggcccgtcctccactcctccgtcgactaacgttctagtacagaccgtcctcggtgcaagtagtagtaagtacggaaaactaccttaattacgtagttacgtcggttacctgacgaaggtacgtcgaacggccacggtcccaccgaccgtccttcgtagttacttttacgtagttaacgtttaccgaagttcgttttagtttcggagtcgaccgtaagaccgtaggtctacgaaggttggaccgagggtccgggtaaggacgggaacngttaacttaccgaacgtacgtaaggaaacctcggagggtaccgggtagtaacggg

SEQ ID NO: 258025 - DNA, 631 bp, Homo sapiens
  misc_feature: GYAE6OF02GL15I.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggactacctggactccaggtggagatattgagatcgaccagactccactctctctcgtccgtccaccctggacacggcccgccctccactcctcctcgctaagtctagtcagacgtcctcgtgctatagtagataggaaactactaatagtagtacgtacggtacctgacgaaggtaactcggaacggcccacgtccctaccgaaccgtacccttacgtaggttaattttacgtaacgtttaaccgtttaccgtaaaggttttaccggttttagttttcggggaacgttcgaacccgaagtacgtacggtctacggtaggtgggaccgtagggccgggtacggaaggggtacctaaggtcttaccgaattaacgtaagtaaactcgggacggtccggggtggaacgg

SEQ ID NO: 258026 - DNA, 506 bp, Homo sapiens
  misc_feature: GYAE6OF02FIG28.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagactccactctctctgtccgtcacccctggacagccggcctccatctcctgcaagtctagtcagagcctcgtgcatagtgataggaaagacctatatgtactgtacctgcagaagtcagccagcctccacgactcctgtatttatgtaagtttcaagtcgttattttggagttgccagacagtctcgagtggcaggcgggtcgagggacagtatttcacactagaaatcgaggccgggtggacgg

SEQ ID NO: 258027 - DNA, 590 bp, Homo sapiens
  misc_feature: GYAE6OF02IC99Z.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctccgtggggctgctaatgctctggataccgtggactccaggtggagtatattgagatcgaccccagacctccactctctctcgtccgtccaccctggaccacgcccggccctccactcctccgtcgactaagttctacgtcagacgcctacgtgcaagtagtacgagtaggaaacgtacctatagttgtacgtcggtacctgacaagtaacgtcgaacggccacgccctaccgaaccgaccttcctagttatttacgtagttaacgttactaaggttcgttttagtttggtagtcgacgagacgtacgctgagtgcgtaggccggtacgagggtacagtactttaccaacgtagtaacgaaacgtcggacgggtccgggtaggacgg

SEQ ID NO: 258028 - DNA, 707 bp, Homo sapiens
  misc_feature: GYAE6OF02HFF8C.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtcctccctgctcagctccgtggggctgctaatgctctggataccgtggactccaggtggagtattagttggaagatcgaacccagacctccactctctctcgtcccgtcaccccgtggaccacgcccggcctccactcctcctcgactaacgtcctaggtacagtaccgtcctcggtcgactagtaaggtgaacgtacggaaacgtaccgttatacgttacgtaccgttacgggtacctgaactaggtaacgtccgaacggtccacggtccctaccgacgtaccttacgtagttactttagtaccggttaacgtttacccaaggtttccggttttaacgtttcgggacgttaccgaccgtaaggtaccgtacgtccgtaacggtacggttaccggtaccgtacggggtaccgggttacgggtaacggggtacctaacggttaaccgtttacccgaacgttaaccggttaacgtaaaaccggttccgggtaacgggtaccccggggttaagggtaccgg

SEQ ID NO: 258029 - DNA, 660 bp, Homo sapiens
  misc_feature: GYAE6OF02JY9IA.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctccgtggggctgctaatgctctggataccgtggactccgaggtggagtatagttgagatacgacccagacctccactctctctcgtcccgtccacccgtggaccacggcccggtcctccactcctcctcgacctaacgttctacgtacgagacgtccgtcgtgactagtagtacgtaagtacggaaatacctaatacgttacgttacgtacgggttaacctcggacgtaacgtaacgtacgacggtaccacgtccctaaccaccgtaccttccgtagtacttttaagtagttaacctttacgtaagtttcgtttaagtttagggacgttcgaaccgtaggtaaccgagggtacctacggaaggtcggaccggtaggtccgggtacgaacgggtactacggtaacttaccgaacgtaacgtaaggtaaaccgtcggaacgggtccgggtaaggtacgg

SEQ ID NO: 258030 - DNA, 737 bp, Homo sapiens
  misc_feature: GYAE6OF02IRI34.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagactccactctctctgtccgcaccctggacacgccgcctccatcctcctgaccaacgtctagtcacgacgtcctcgtcgacaagttacgtagaagtacgggaaaacgtaacccttattaacgttcgttaaccgtcgggttaccctcggaccgtaaggaaacgttaccgacgggtaccccaacggtccccgttacccgaaccgtaacctcccgttaggttaactttttagtacggttaaacgttttacccaaaggtttccggtttttaacgtttttaggggtacgtttaccggtacccgtaacggtaaccgtaacggggttccttaaccggtagggttacggggacccgtagggggtacccggggttaacggtacggggggtaactaacggggttaaccttttacccggaaaccgttaaccgttaaggaaaaacccgtttcggtaaccgggtaccccggggggttagggtaaccggg

SEQ ID NO: 258031 - DNA, 565 bp, Homo sapiens
  misc_feature: GYAE6OF02IQYZU.29.21.B10.1.454.CMB.1.raw
tcagatagagtactcacgaccggtgctcgatttagtgtcgtcgcaagagaggagggggtgatcaggacttctcagttcatcttctcaccatgaggctccctgctcagctcctggggctgctaatgctctggatacctggatccagtggagatattgagatgacccagactccactctctctgtccgtccacccctggacacgccggcctccatctcctgcaagtctagtcagacgcctcgtgcatagtgatggaaagacctatatgtactggtacctgcagaagtcaggccagcctccacgactcctgtatttatgtaagtttccaagtcgtttattttggagtcgccaagacaggctcgaggtcggcaggcgggtacgagggacagtatttcacactagtaaaatcgacggccgggtagggagggcgtaggagagttggttggtctaagttttattagttgtactagtagtacgtaaagtttacgagtcgttgttacgttacgttttcggaccggtaacggggtacctacggttccgtacgggtaactacgtaactaaaaccgg

SEQ ID NO: 258032 - DNA, 539 bp, Homo sapiens
  misc_feature: GYAE6OF02IFT1C.29.21.B10.1.454.CMB.1.raw
  modified_base (413)..(413): a, c, t, g, unknown or other
  misc_feature (413)..(413): n is a, c, g, or t
tcagatagagtactcacgaccggtgctcgatttagtgtcgtcgcaaggagagagggggtcaggctggaactgaggagcaggtggggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtgagatatgagatgacccagacctccactctctctgtccgtcaccctggacacgccggcctccatctcctgacaagtctagtcagacgcctcgtgcatacgtgatggaaatacctatatgtactgggtacctgacagaagtcaggccagcctaccacgtactctgtatttanacgtaattaccaagtacgtttagtttggagtgacgagacacggtctcgagtcggcacggcgggtacgacgggtacaagtactttaccaactacgtagtaaactcgaacggtaccgggtggtaacgg

SEQ ID NO: 258033 - DNA, 691 bp, Homo sapiens
  misc_feature: GYAE6OF02G1GX9.29.21.B10.1.454.CMB.1.raw
tcagatagagtactcacgaccggtgctcgatttagtgtcgtcgcaaggagagagggggtcgaggctggaactgaggagcaggtgggggcgacgttctccctctaacactctcccctgttgaagctctttgtgacgggcgaggctcaggccctgatgggtgacttcgcaggcgtagactttgtgtttctcgtagtctcctgctcagctccgtggggctgcgtactgctcgtgactaccgtggtactccgaggtgggaggtattagttggagagtacgacccaacggtactccaaccttcctcctccttcgtcccgtccgtaacccccgtggaccgtacggccccggccctacccactcctccgtcgacctaacgttcctagtacgacgacgtccgtacgtgctatacgtagagacggaaatacctatatagtacgtagtacctgacgagacgtacggacgaccgacgtcccgaaccgtaaccgtaccgtaccgttacgtaattttacgttaacgttaaggtttacccgtaaaggtacccgtttttaagttttcgggtaacggttacgtaccgtaacgtaaccggacggtacgtacggtacggtcggtacggcggtacgggtacggaacgggaacgtgtaacggttccaacgtaacgtagtaaacgtcgtaacggggtccgggttaaggcggg

SEQ ID NO: 258034 - DNA, 598 bp, Homo sapiens
  misc_feature: GYAE6OF02HSLGX.29.21.B10.1.454.CMB.1.raw
  modified_base (292)..(292): a, c, t, g, unknown or other
  misc_feature (292)..(292): n is a, c, g, or t
  modified_base (299)..(299): a, c, t, g, unknown or other
  misc_feature (299)..(299): n is a, c, g, or t
  modified_base (352)..(352): a, c, t, g, unknown or other
  misc_feature (352)..(352): n is a, c, g, or t
  modified_base (406)..(406): a, c, t, g, unknown or other
  misc_feature (406)..(406): n is a, c, g, or t
  modified_base (449)..(449): a, c, t, g, unknown or other
  misc_feature (449)..(449): n is a, c, g, or t
  modified_base (532)..(532): a, c, t, g, unknown or other
  misc_feature (532)..(532): n is a, c, g, or t
tcagatagagtactcacgaccggtgctcgatttagtgtcgtcgcaaggagagagggggtcgaggctggaactgaggagcaggtgggggcacttctccctctaacactcctccctgttgaagctcttgtgacgggcgagctcaggccctgagtgggtgacttcgcaggcgtagtactttgtgtttctcgtagtctcctgctcagctccgtggggctgactaatgctcgtggataccgtggtaatccaggtggagtatagttgagatgacccagacctccactctctctgtccnccacccnggacaggtcccgactcccatcctccgtgacctaaggtctacgtcaagcgtccncgtgacattagtgactaggaaaactacttaactatcgtactacggtaccttganacgtagtacgacgcagccaccacgaccgtcctagaacttttanagtaacgtttacgagtccgtttaagtttcgggtaagttccgcaagacgtacggtctcgtaagtcggacgagggccggtacggnggaacgacgtaagtttaccaacgtaccgttaaggaaaactacccgggtaaggacgggtggtaacgg

SEQ ID NO: 258035 - DNA, 593 bp, Homo sapiens
  misc_feature: GYAE6OF02GPFTV.29.21.B10.1.454.CMB.1.raw
  modified_base (338)..(338): a, c, t, g, unknown or other
  misc_feature (338)..(338): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctgggctgctaatgctctggatacctggatccagtggagatattgagatcgaccagactccactctctctgtcccgtcaccccgtggacacgccggcctccatcctcctgcaagtctagtcagcgcctcgtcncatagtgaataggaaacacctaatatgtactggtacctgactaagaacgtcaggccacgccctaccgaaccgtacctcctagtactttaattacgtaacgtttccaagttcgttttaagtttggagttcgaccagacgacggtcctcgtaggtcggcgacgggtacgggttacggaacgggacctacggtaacttttacgaaccgtaacgtaacgtaaaaaccgttcggaacgggtaccggggtacgggtacggg

SEQ ID NO: 258036 - DNA, 543 bp, Homo sapiens
  misc_feature: GYAE6OF02F3MRB.29.21.B10.1.454.CMB.1.raw
  modified_base (276)..(276): a, c, t, g, unknown or other
  misc_feature (276)..(276): n is a, c, g, or t
  modified_base (464)..(464): a, c, t, g, unknown or other
  misc_feature (464)..(464): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctccgtggggctgctaatgctctggatacctggatccagtggagatattgagatgacccagactccactctctntgtcctcacccctggacacggccggcctccatcctcctgcagtctagtcagacgcctcgtgcatagtgataggaaagtactatatgtactggtactgacgaagagtcgaggccacgcctaccacgactcctagtatttatagtaacgtttccaaggttcgtttagttttgggagttcgcctaagacgngtactcgaagtcgcagggcggtcgacgggtacaggttacttacaactacgtacggaaatcgacggtccgggtagacggg

SEQ ID NO: 258037 - DNA, 760 bp, Homo sapiens
  misc_feature: GYAE6OF02GQ0W6.29.21.B10.1.454.CMB.1.raw
  modified_base (202)..(202): a, c, t, g, unknown or other
  misc_feature (202)..(202): n is a, c, g, or t
tcagatagagtactcacgaccggtgctcgatttagtgtcgtcgcaaggagagagggggtcgaggctggaactgaggagcaggtgggggcacgttctccctctaacactctcccctgttgaagctctttgtgacgggcgagctcagccctgagtggtgacttcgcaggcgtagactttgtgtttctcgtagtctccctgcctngtctccgtgggctgctaatcgctcgtggactaccgtggatccgagtggagtatagttgagtatcgaccgagactccaactctcgttactcgttcccgtcctacccctggacctacgcccggtccctccacgttccgtccgttcgaccgtaacgttaccttacgtcgacggtaacgccgttccgtagtcccgtaattagggtacgtaacgttacgggtaaaacgtaacccgttaagttacgttacggttacgttacgggtttaacccgtgggtacctaaacgggtaaacggttccaaacgggggacccctaaagggttccccctaaacccggtaacccgtaacccttccgttaaggttaacgttttaggttaacggtaaaccttttccgtaaaagttccggttttaaggttttacggagttaccgaccgtaacgtaccggacggttctacggtcgtacgggaccgtaggggtaccggtaccggtaaagggaccgttagttaccgttacgacgtaaacgttacgaaaacgttacgaccgggtacggggttaccggaaggg

SEQ ID NO: 258038 - DNA, 523 bp, Homo sapiens
  misc_feature: GYAE6OF02HGS10.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggatccagtggagatattgagatgacccagacctccactctctctgtccgtccaccctggacacgccggcctccatctcctgacaagtctagtcagacgcctcgtgcatagtcgataggaaatactatatgtactgtacctgacagagtcaggccagcctaccacgtactcctgtatttatagtaacgttacaagtcgtttagtttgagtgccagacgagtctacgagtgcgaggcggtacgagggacagtacttacactacgtagaaactgacggtccgggtaggacggg

SEQ ID NO: 258039 - DNA, 774 bp, Homo sapiens
  misc_feature: GYAE6OF02HXF1Y.29.21.B10.1.454.CMB.1.raw
  modified_base (171)..(171): a, c, t, g, unknown or other
  misc_feature (171)..(171): n is a, c, g, or t
  modified_base (204)..(204): a, c, t, g, unknown or other
  misc_feature (204)..(204): n is a, c, g, or t
  modified_base (749)..(749): a, c, t, g, unknown or other
  misc_feature (749)..(749): n is a, c, g, or t
tcagatagagtactcacgaccggtgctcgatttagtgtcgtcgcaagagaggagggggtgatcaggacttctcagttcatcttctcaccatgaggctccctgctcagctccgtggggctgctaatgctctggactaccgtggactccaggtggagatattgagatcgaccngactccactctctcgtcgtccgccaccgtgacncgccggcctccactctctgactagtctagtcagacgtcctcggtacgactaagtaggtagtaacgtaaggaaacgtaaccgttaattacggttacgttaaccggttaccggttaacccttagaccggtaacggtaaacggttccgaaccggtacccgaacccgtcccgtacccgaacggtaccctttaccgttaagtttaactttacggtaacgttaaccggttttaaccgtaacggtttcgttttaaggtttacgggacgttaccggaaccgttaacgtaccgtacggtaccgttaccggtaggggtaccgtacgggtacgggtacccgggtaggtaacgggtaaccgtacggttaacgtttacaaaccgttaacgttaacgaaaacgttcggaaccgggggttcgggtaacgggtacggtacgtaggacggtttagggttcggttacgttacgtttaagttttaagtacgttacgtacgtagtacgtaacgttaattacgtagttaccgttagttaccgtttacgtacggaccgtacggtacncgtacttaggacttacgaacgtacg

SEQ ID NO: 258040 - DNA, 603 bp, Homo sapiens
  misc_feature: GYAE6OF02GBHRN.29.21.B10.1.454.CMB.1.raw
  modified_base (245)..(245): a, c, t, g, unknown or other
  misc_feature (245)..(245): n is a, c, g, or t
  modified_base (388)..(388): a, c, t, g, unknown or other
  misc_feature (388)..(388): n is a, c, g, or t
tcagatagagtactcacgaccggtgctcgatttagtgtcgtcgcaagagaggagggggtgatcaggacttctcagttcatcttctcaccatgaggctccctgctcagctccgtggggctgctaatgctctggatacctggatccagtggagatattgagatcgacccagactccactctctctgtccgtccacccctggacacggcccgcctccatcctcctgacaagtctagtcagcgcctcgngcagtagtgaagtaggaaacgtacttatagtgtacgtacggtacctgacaaggtaacgtcacggccacgccctccaacgtcctcgtgtatttacgtagtacgtttaccagtttcgtttagtttcggagtcgtacgaagaacgngtctacggaggtcggcgacggcgggtacgagggacagtacttacactagtaagaactcggacggtcgggtaggacggcgtagggaggtagtggttaggtactttaagtttagttagttcgatacgtgtaagtaacgtttacagttacttcggttacgttcggtttcgggaccgtagggacccgtacgtccggttacggaactactaacggtaacg

SEQ ID NO: 258041 - DNA, 782 bp, Homo sapiens
  misc_feature: GYAE6OF02JC1PA.29.21.B10.1.454.CMB.1.raw
tcagatagagtactcacgaccggtgctcgatttagtgtcgtcgcaagagacgaggggtggatcaggacttctcgagttccagtcttctcaccactgaggcgtccctgcgtcagctcctcgggctcgcgtaactgctctgatacctggatccagtggagatagttgagatagaccagactcactactctctcgtccgtcaccctcggtacacgccggtcccgtcctactctcctacgacgtacgtacgttacgtacgtaacgtacgtccgtcggtacgtacgtacgtacgtacgtacggttaacggtaacgtaacgttaacgttaacgttacggttacgttacggttaccgtacgtaacgtaacggtaacgtacgtaacggtaccgtaccgtaccgtacccgtaaccgtaaccgttaccgttacgttaacgtttaacgttaacgttaacgttaaccgtaacggttaacggtttacggtttaacggtaacggtacgtacgtaacgtaacgtaacggtacgtacgtaacggtacggtacggtacggtacgggtacggtaacggtaacgtaacgttaacgttaacgtaacgtaacgtaacgtaacgtaacggtacggtacgggtacggtacgtacggtacggtaacgtacgtacgttacgtacgttacgtttaacgttacgttacgtacgtaacgtacgttaacgttacgttaacgtacgtacgttacgttacgttaacgttacggtacggtacggtacgtaccgtacgtacgtacgtacgtaacg

SEQ ID NO: 258042 - DNA, 628 bp, Homo sapiens
  misc_feature: GYAE6OF02GYN8Y.29.21.B10.1.454.CMB.1.raw
  modified_base (307)..(307): a, c, t, g, unknown or other
  misc_feature (307)..(307): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagtactttgtgtttctcgtagtctccctgctcagctcgtgggctgctatgctctggataccgtggactccgaggtggagtattagttgagtatcgaacccagtacctccacttctctctcgtcctccaccctggaccncggccccggcctaccactcctcctcgacaagttctacgtcaggacgtcctcgtgactagtagtaggagtaaggaaaactcttatagtcgtacgtcgtaccgtgacgagacgtcgacgccacgccctaccgacgtacctcgtagttatttagacgttaacgttccgaagtttcgtttagtttggacgtcgaccgtagacgtgtacctagtacggtggaccgtcggggaccgggtacgaacgggttaacgtacggttaacttacccgaacgttaacgtacggtaaaacggtcccgggtacgggttaccggggtagtaccgggg

SEQ ID NO: 258043 - DNA, 734 bp, Homo sapiens
  misc_feature: GYAE6OF02IHZ9W.29.21.B10.1.454.CMB.1.raw
tcagatagagtactcacgaccggtgctcgatttagtgtcgtcgcaagagaggagggggactgatcaggacttctcagttcatcttctcaccatgaggcctccctgctcagctccgtggggctgactaatgctctggataccgtggatccagtggagtatattgagatgacccagacctccacttctcttctcgtcctcctaccccgtggacacggcccgacctccatcctctgcaagtctagcagacgcctcggtgctagtaggtgagtacggaaactacttaatatagttaaccgttcggtaacctggacaagggtaagtccggacgaccgtaccgtcccgtaccgtactaccgtacgttattaagtagtacgtttaacttaacgtacgtttagttttcggttacggtacgtaccgacgaacgtacggtacgtcggtacggtacggcgggtacggtacggggtaccgggtacggaacggtaacgtgtttaaaccagtaccgtaaataaacggtaaccgtaccgggtacggggtacggtagggaacggtcggtaaggtcggttaaggttttcggtacgttttagttaagttttacgagttccaaagttgttaaccgttaaacgttagttccggttacgtttaccggttccttttaccgggtttacggttaacccggcccgggttaaactaccggtttacccgaggttaaccgtaccgtaaccggttaaacccgg

SEQ ID NO: 258044 - DNA, 608 bp, Homo sapiens
  misc_feature: GYAE6OF02FW1T4.29.21.B10.1.454.CMB.1.raw
  modified_base (214)..(214): a, c, t, g, unknown or other
  misc_feature (214)..(214): n is a, c, g, or t
tcagatagagtactcacgaccggtgctcgatttagtgtcgtcgcaagaggagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtcnctgctgaggctgtaggtgcttgtccttgctaatcggctctggataccgtggatccagtggagtatacgttgagtatcgaaccctagactaccgactctctctcgtccgtcaccccgtgacagccgcctccatctctgcagtctagtcagactcctcgtcgcgtagtagtacgagtacggaaagtacccttaatacgtacgtaacgttcgggtaccgttagacgtaggtaaccgtcacgggccaacgtcccgtaccgaacggtcctaccgttagtaacttttagtacggtaacgttttccgaagttccgtttagtttcgggaagttcggaccgtaacggtaaccgtaggtcttaccgtaggttaccggaccgaacggtcgggtaccggtaacggg

SEQ ID NO: 258045 - DNA, 598 bp, Homo sapiens
  misc_feature: GYAE6OF02F25CL.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctccttggctgctaatgctctggatacctggatccagtggagatattgagtatcgaacccagacctccactctctctcgtccgtccaccccgtggacacggcccggtcctcccatcctcctgaccaagttcctagtcaagcgcctcgtagctagtagtgatacggaaacgtactaatatcgtacttcggtacctgacgagtaagtacgacggccacgccctaccgaccgtactcccgttagtactttaagtacgtaacgtttaccgtaacggttcgtttaagtttcggtagtcgacgtacgacgtacgtccgtagtacgtcgtacgcgacgggtcgtacggacgtagtacgttacgacgtacgtaaggtaaacgtcgacggccgggtaggtacggg

SEQ ID NO: 258046 - DNA, 654 bp, Homo sapiens
  misc_feature: GYAE6OF02ILVBJ.29.21.B10.1.454.CMB.1.raw
tcagatagagtactcacgaccggtgctcgatttagtgtcgtcgcaagggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctcctgctcagctccgtggggctgctaatgctctggactacctggactccgagtggagatattgagatgacccagacctccactctctctcgtcccgtccaccccgtggaccacggcccggcctccatcctccgtgactaagttctagtcagtcgcctcgtgcagtagtgagtaggaaacgaccttatagttacgtacgtggtacctgacgtaagaacgtcgacggacccacgtccctaccgaaccggtaccttccgttaggtaactttttacgaggtttaaacgtttccgaaaggtttcggttttaagttttagggagttaccgaccgtaaggtaaccgacggtacgtacgaacgggttccggacggtacggggtaccggggtaccggaagggaccgtaaggttaacctttacgaaactacggtaagtaaaacgtcggaacggggttaccgggaggtacggg

SEQ ID NO: 258047 - DNA, 677 bp, Homo sapiens
  misc_feature: GYAE6OF02GQ6GH.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctccgtggggctgctaatgctcgtggactacctggactccaggtggagatattgagatcgaccagacctccactctctctcgtcccgtccaccccgtcggaccacggcccggccctaccacttccctccgtcgacaacgttcctacgtcaacgaccgtccctcggtgacaataggtagtaaggtaggaaaacgtacctaagtagttacggttacgttacgggttacctgtaccgtaaggtaacgtaccggtaaccggacccgaccgtcccgtacccgaaccggtaccttcccgtaggtttaactttagttacgtttaaccgtttaaccgtaaggtttacgttttagttttaggacggttaccgaaccgtaggaacgttacgcggttcaagggtcggtacgagggtccgggtaggaacggtacgtaggtacttaccagtaacgtaaggaaatcgggaagggccgggtaggtacggg

SEQ ID NO: 258048 - DNA, 858 bp, Homo sapiens
  misc_feature: GYAE6OF02H96KR.29.21.B10.1.454.CMB.1.raw
tcagatagagtactcacgaccggtgctcgatttagtgtcgtcgcaaggagagaggggtcaggctggaactgaggagcaggtgggggcacttctccctctaacactctcccctgttgaagctctttgtgacgggcgagctcaggccctgagtgggtgacttcgcaggcgtagtacttttgtgtttctcgttagtcctccctgctcagtcctccgtgggctgactaatcgactcgtaggtactaccgtggtactaccgtaggtagggtaagtagttaagtttaggaagtaacgttaccggaaaccccgaacggtaacccttaccccgtaacccttcctttccgtttacccgttaccgggtttacccccggttacccccgttaacccccggttaccgggaacccgtaaccgggtccccccgggtaccccttacccgtaacctttccccgttacccgtcgtaaccgttaaacgttccgttaaccgttacgaacggtaccgttccgtaccggtacgtaccgtaagttaacgttaggtaacggtaaaggtaaaacgtacttaattacgttacgttacggttacgttacgtagtacgtaaggacgtaccgacggaccacgtcctacccgaacgtaccttcgtaagttaacttttaagtacgttaacgtttacgtaacgtttacgttttaggttttacggaccgttacgaccgtaagaccggtacgtaccgttacggaggtacgggacgtaccggggtacggttaccggaagggtaaccgtacggttaaccgtttaacccgtaacgttaacggtaaaacgtaaccggtttaacgggtaacgggttaccggggtagggtaaccgggg

SEQ ID NO: 258049 - DNA, 682 bp, Homo sapiens
  misc_feature: GYAE6OF02G0F4V.29.21.B10.1.454.CMB.1.raw
  modified_base (226)..(226): a, c, t, g, unknown or other
  misc_feature (226)..(226): n is a, c, g, or t
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
tcagatagagtactcacgaccggtgctcgatttagtgtcgtcgcaaggagagagggggtcaggctggaactgaggagcaggtggggggcacttctccctctaacactctcccctgttgaagctctttgtgacgggcgagctcaggccctgatgggtgacttcgcaggcgtagtactttgtgtttctcgtagttcctccctgctcagtctccgtggggctgctaatncttntggatacctggactccagtgganattattcgaagtatcgacccgagactccaactctactctcgtccctaccaccccgtaggaccacggcccggccctcctatccctcctaggactaacggttcttaagccgaagtacgccctagtacgactaagtagtacgtaatacggaaactacctataagtcgtacgtcgggtaacctggaccagtacgtacgacgggacccacgtccctaaccgacggttacccttcgtaggttaactttaggtaccgtttaacgttcccgtaagttacgttttaaggttcgggacgtttagacccgtaaggacctacggtcctaggtaacgggtggtaaccgtcgggtaccgggtaggaacgggtaccgtaacggtttacttaccgaaccgtttacgaacgaaacgttccgggagggtacccgggttgggtaacgg

SEQ ID NO: 258050 - DNA, 707 bp, Homo sapiens
  misc_feature: GYAE6OF02JW836.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagtctcctgggctgctatgctctggactacctgatccgagtggagatattagagatcgaccagactccactctctctcgtccgtccacccgtggacgaccgcccggaccttccgacttccgtccgtcacgtaacgtctacgtacgaagtcgcctcgtacgctagtacggtgtaagtacggaaaacgtaccttaagttacgttaacgtacgtacgggtttacctacggtaacgtaacggtaaacgtaccgaacggaaccccgtaacgcccgttacccgaaccgtacccgttaccgtaagttaacgtttaacgtacgtaaaccgtttaccgaacgtttcgttttaacgtttcggtaacgttcgaccgtaaggtactacgggttactacggtacggttcgaccgtacgggtccggtaacggtaaacggggtcttaaacggttaccgtttaacgaaccgttaacggtaaagtaaaccggttccggaacgggtaccggggttaggtaacggg

SEQ ID NO: 258051 - DNA, 585 bp, Homo sapiens
  misc_feature: GYAE6OF02GXADR.29.21.B10.1.454.CMB.1.raw
  modified_base (329)..(329): a, c, t, g, unknown or other
  misc_feature (329)..(329): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggactccagtggagatagttgagatgaccagactccactctctctgtcctcacccgtggacacgccggcctccatcctcctgcaagttctagtcagnccgtcgtgcatagtgataggaaagtacctaatatgtacgtcgtaacctgacaaggtaacgtcgacggaccacggcctaccgaaccgacttcccgtagtattttagtacgttaaacgtttcaaaggttcgtttattcggtagtcgccaagtacgaggtcttcaaggttcggacgacggtcgggtacgtaagggaccaaggttactttacgaacgtaacgtaagtaaaacgtccgaacgggtccggggtaggtacggg

SEQ ID NO: 258052 - DNA, 705 bp, Homo sapiens
  misc_feature: GYAE6OF02G2458.29.21.B10.1.454.CMB.1.raw
  modified_base (233)..(233): a, c, t, g, unknown or other
  misc_feature (233)..(233): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacggcgagctcaggccctgagtgggtcgacttcgcaggcgtagtactttgtgtttctcgtagtctccctgctcagctcgtgggctgactatgctcgtgactccnggtactcaggtgggatacttagttgagtacgtcgaaccgacgtacctccacttcctcttcgtcgtacccgtcctaccccgttaggaccgaccggccccggtacctcccgtacttcctaccgtcgaactacgttctacgtacgacgtcgtcctacgtgtctagtacgtcggtaaagtaaggaaacgttaaccttagttaacgttacgttacgttaccgggtactacggccgtaaggtaccgtacgaccggccttacgacccgttcccgaacgttacccgtttaccgtagttagtttaactaggttaacgtttaccgtaagtttaccgggttttaacgtttaggtaccgttcggtaccgtaacgacgttaacgtcgtacgtaacggtggaccgtacgggttcgggacgtaccggaaggtctaacgttacctaacgaacgtagtaaaccgtcggtacgggtaccggggatacggg

SEQ ID NO: 258053 - DNA, 614 bp, Homo sapiens
  misc_feature: GYAE6OF02FTM3I.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctctgggctgctaatgctctggatacctggactccaggtggagatattgagatcgaccagacctccactctctctcgtcccgtcccacccgtggaccgacgccccggtcctaccctacttccttcctcgacctaaacgttcctaagtcgaagtacgtcccgttcgtgacctaattaggtgaagtaaggaaacgtactaatagtgtacgtcgtactgacaagtagtacgacgccacgccctaccgacgacctccttaagttactttagtagttaacgttaccgaagtttcgtttagtttggacgtcgaccgagccgtagtcctacgaggtcgcgtacgggccgggttagaagggtacctaaggttcttacaaccgagttaacaaacgttcgggacgggttccgggtaggacgg

SEQ ID NO: 258054 - DNA, 740 bp, Homo sapiens
  misc_feature: GYAE6OF02JZHH4.29.21.B10.1.454.CMB.1.raw
  modified_base (328)..(328): a, c, t, g, unknown or other
  misc_feature (328)..(328): n is a, c, g, or t
tcagatagagtactcacgaccggtgctcgatttagtgtcgtcgcaaggagagaggggtcgaggctggaactgaggagcaggtgggggcacttctccctctaacactcctcccctgttgaagctctttgtgacgggcgagctcaggccctgatgggtgacttcgcgaggcgtagactttgtgtttctcgtagtcctccctgctcagctccgtgggctgactatcgctctggactaccgtggacttccgaggtggagtattattgagtagtcgaacccgacgtaccttaccactccttctccgttgttccccgtccaacccctggaaccncggcccgcctcccattcctccctagacctaacggttcctaacggttacaggtacctccgttcgtacgacctagttaaggtcgtaacggtaacggaaaactaccttaagttacgttacgggttacctaagggttacccgtaggacctaacgggtaacgtccgtaacggtaccccacggtccccttaccgaacccggtaccttacccggtaagttaacctttttaagtaccggttaacctttaaccgtaaggtttacggtttttaacgtttagggttaccgtcgttaaccgacggtaaccgacggtactaccggtaaggtcggtacgtacgggtcccgggttaagaccgggttaacacgttaagttacccgaatacgtaacgtaaccggtacgacgggtccgggtagtaccggg

SEQ ID NO: 258055 - DNA, 602 bp, Homo sapiens
  misc_feature: GYAE6OF02G7GSA.29.21.B10.1.454.CMB.1.raw
  modified_base (219)..(219): a, c, t, g, unknown or other
  misc_feature (219)..(219): n is a, c, g, or t
  modified_base (347)..(347): a, c, t, g, unknown or other
  misc_feature (347)..(347): n is a, c, g, or t
  modified_base (454)..(454): a, c, t, g, unknown or other
  misc_feature (454)..(454): n is a, c, g, or t
  modified_base (479)..(479): a, c, t, g, unknown or other
  misc_feature (479)..(479): n is a, c, g, or t
  modified_base (562)..(562): a, c, t, g, unknown or other
  misc_feature (562)..(562): n is a, c, g, or t
tcagatagagtactcacgaccggtgctcgatttagtgtcgtcgcaagaggagaagggggtcaggctggaactgaggagcaggtgggggcaccttctccctctaacactctcccctgttgaagctctttgtgacgggcgagctcaggcctgatgggtgacttcgcaggcgtagactttgtgtttctcgtagtctgtcgtttgctcacgccgtcgagggtnctgctggagcgtgtaggtgctgtccttgactaagtcgctcgtaggactaccgtggactccgaggtggatatagttgagtatcgaaccgagtcctcctacgtctcctcgtcgtcctccaccgtcggacncgccgtcctcgtctccgtcgagactacgtctacgcgacgacctcgttcgcacgtagtagtcgtaacgtaaggtaactacgtagttagttcgttacgttacgttacgngtacgaagtacgtacgacgtacccncgtacctacccgactccgttcgtaagtttaacttcgtaagttaaccgttacgagtttcgtttagttcggacgtcgtaccgtancgtcgtactaggtacgtggaccgtggtaccggagtaccgg

SEQ ID NO: 258056 - DNA, 675 bp, Homo sapiens
  misc_feature: GYAE6OF02H9HTZ.29.21.B10.1.454.CMB.1.raw
  modified_base (312)..(312): a, c, t, g, unknown or other
  misc_feature (312)..(312): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctccgtggggctgctatgctcgtggactaccgtggactccgaggtggagtatagttgagatcgacccagacctccaccttcttctctcgtcccgtcccaccctcggaccncggcccggtcccctacctacttcctcccgtcgacctaacggttcttacgtaccgaggaccggttccttacggtcgtacgtaactagggttagaacggttaacgggaaaacgtaccttaattagttacgtaacgttcgggttaccctgacgaacgtacgtacgacggacccacgtccctaccgaccgtaccttcgtagttatttacgttaaggtacgtttaccgagtttgttttagtttggtacgttcgaccgtagacgtacggtcgtagtacgtcggtggacggtcgggacggtacgggaacgtacggtactttaccgaacgtacgtaacaaacgtaccggtacgggaccgggtaggaccggg

SEQ ID NO: 258057 - DNA, 690 bp, Homo sapiens
  misc_feature: GYAE6OF02JJFJA.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtctccctgctcagctcctggggctgctaatgctctggatacctggactccgaggtggagtattattgagatcgacccagacctccactctctctcgtcccgtccacccctgggaccacggcccgcctccatcctctgactaagtctagtacagacgaccctcgtcggactacgtaggtacgaataacgggaaacgtacccttaagttaacgttacggtaaccgtttcgggtaacccttcgggaactaacgggtaaacgtccggaaccggtcccgacgtccccgtaccgtaccggtaaccttccgttagttaacttttacgtacggttaacgtttcctaaagttcggttttacggtttacggaacggttcgacccgtaaaggtccgtacgggttactacgtagggtcgtacgtacgggtcgggtacggaaacgggtactaacggttacgttacgaaccgtacggtaagtaaaccgtccggaggggttaccgggtggtaacgg

SEQ ID NO: 258058 - DNA, 947 bp, Homo sapiens
  misc_feature: GYAE6OF02JQJJE.29.21.B10.1.454.CMB.1.raw
  modified_base (264)..(264): a, c, t, g, unknown or other
  misc_feature (264)..(264): n is a, c, g, or t
tcagatagagtactcacgaccggtgctcgatttagtgtcgtcgcaaggagagagggggtcaggctggaactgaggagcaggtgggggcacttctccctctaacactctcccctgttgagctctttgtgacgggcgagctcaggccctgatgggtgacttcgcaggcgtagtactttgtgtttctcgtagtctccctgctcacgctccgtcggggctgctaatgtctcgtggactaccgtggactccagttcggagtatattgangtacgaccagactccgaccttctctcgttcgtcctcctaccccgtaggtaccaccggtcccggtccttacctcttccttcccgtgaccgtaacggttccgtacgtaccgacggacgtcccgtcggtacggactaacgtacgtacggtaagtaacgggtaaaacgtaacccttaagtaaccggttacggttaaaccgttcccgggtttaacgtaacgggttaccgtaaaacggggttaacccggttaccggaacccggggtaaccgtacccggtacccccgttaacccgttaaaccgggtaacccccttccgggtttaaacgtttaaaccgtttttacggttaaaacccggggttttaacgttttaaccccgggttaaacggttttaacccggttttttaggtttttaggggaaacccggttccggtaacccgggtaaacccgtaacgggttacgggtttaaccgggttaccgtaaccgggtttacggggtaccccgtagggggttaaccccgggggtacgggtaaaacgggggttaccccggttaaacgggtttaaccccggttttttaaacccgtaaaacccgggtaaaccgggtttaaacccggtttaaaaaccgggttacccccggggaaaacggggggggttttttaacccgggggaccggggtttttaaacccggggg

SEQ ID NO: 258059 - DNA, 838 bp, Homo sapiens
  misc_feature: GYAE6OF02F0XN5.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtcctccctgctcacgctccgtggggcctggcctaatcgcttccgtggacttaccgtggtactccgaggtcggagtattacgttggagatacgacccagtacctcacttcgtactcgttcgtcccgtccaccccgtggacgtcggcccgtccgtcctactccgtccgtcgtaacgtacgtccttaggtaccgaaggtaccgtcccgttggttacgaccgtaagttacggtaggtaaaggtaacgggaaaaccgttaccttaaagtacgttacggttaaccggttacgggtttaacccgtacggaaccgttaacggtaacgttacccggtaaggccccttaaaccggtccccgttaaccggaaaccccggttccctttaacccggtttacgtttaaacgtttttaacggtaacgggtttttaaacccggtttaaccgtaaacggtttttccggttttaaacggtttttacgggacgtttaccgacccgggtaaacgtaccggacggttcctaggttacggtacgggaacggttaccggggtaccgggttcggaaacgggttactaacgggtttaccgtttaacgacccggttaacggtaaaccggtaaaagttcccggtaaaccgggggttcgggtagggttaaacccggg

SEQ ID NO: 258060 - DNA, 731 bp, Homo sapiens
  misc_feature: GYAE6OF02F7QQ0.29.21.B10.1.454.CMB.1.raw
  modified_base (205)..(205): a, c, t, g, unknown or other
  misc_feature (205)..(205): n is a, c, g, or t
  modified_base (266)..(266): a, c, t, g, unknown or other
  misc_feature (266)..(266): n is a, c, g, or t
  modified_base (499)..(499): a, c, t, g, unknown or other
  misc_feature (499)..(499): n is a, c, g, or t
tcagatagagtactcacgaccggtgctcgatttagtgtcgtcgcaaggagaggagggggtcaggctggaactgaggagcaggtgggggcacttctccctctaacactctccctgttgaagctctttgtgacgggcgagctcaggccctgatgggtgacttcgcaggcgtagtactttgttgtttctcgtacgtcctccctgctcncgctccgtggggctagactatgtctcgtggactacctggactccgaggtagagtatatganatacgaccagtcctacctactctctctcgtccgacctacccgtaggacgtcggcccgtcctaccgacttcctccgtacgaccgtaacgtttaccgacgttaccgaacgtccgttcccgttcgtacgacgtaagttaggtaagtaagtaacgggtaaaactaacctttaagttaacttcggttaacgtaccggttacgtacgacggaacgtaacggtccgaacggccctaaccncccgtaaccgtaccttccgtaccgttagtttaacgtttaacggttaacgttaaccgttacgtaacggtttgttttaagtttcggacggtttacgaccgtaagtaccgtacggtccttaggacgggttccgacgtcggggtacggaaccggtaagggtacctaacggttaacgttaccgaacggttaacgtaacgggtaaaccaccgggtacgggggtacgggtaggtacggg

SEQ ID NO: 258061 - DNA, 934 bp, Homo sapiens
  misc_feature: GYAE6OF02IWQYL.29.21.B10.1.454.CMB.1.raw
  modified_base (827)..(827): a, c, t, g, unknown or other
  misc_feature (827)..(827): n is a, c, g, or t
tcagatagagtactcacgaccggtgctcgatttagtgtcgtcgcaagaggaggagggggactgatcaggacttctcagttcatcttctccacatgaggctccctgctcagctcctggggctgctaatgctctggatacctggatccagtggagtatattgagtatgacccagactccacgtctctctcgtccgtccacccgtgacagcccggcctcatcctctcgactaagtctacgtcgagacgtcctacgtacgaccagttaaggtcgtacgttaacggggaaaaactcccttaagtaacgtttcggttaaccgttcggggttaaaccccttcgggaccggtaacggtaaacgggtttcccggaaacggggtcccccgaaacgggtcccccccgtttacccgaaacccggtaccgtttccccggttaaggtttaaacgttttttaacgggtacgtttaaaaccggggttttaacccaaaacggggtttaccggttttttaacgggttttttaccggggtaagttcccgggtaaccccgaaacgggtaacccgtaaacgggggtccttaaccggtacgggttcggggacccgttaggggtacccggggtttaccggaaaggggtaccttacgggtaactttaccgaaaccgtttacgtaacggttaaaagtccggtacggggtacccggggggttagtaaccgggtacgttagggtacggggttacgtttgggtttaccgggtaattttacggttttaacggtttaacgttcgttaaaggtacgtttaacgggaaaccttttaacggttaaccgtaccggggtttntttacccggttttaccggtttaaccggttttaacccggggacccggttaacggggttcccttaaccgggtttcccgttaacgggttaacccgtagtttaaaacccgg

SEQ ID NO: 258062 - DNA, 759 bp, Homo sapiens
  misc_feature: GYAE6OF02GKE89.29.21.B10.1.454.CMB.1.raw
  modified_base (276)..(276): a, c, t, g, unknown or other
  misc_feature (276)..(276): n is a, c, g, or t
  modified_base (751)..(751): a, c, t, g, unknown or other
  misc_feature (751)..(751): n is a, c, g, or t
tcagatagagtactcacgaccggtgctcgatttagtgtcgtcgcaaggtaggtaggagggggtcaggctggaactgaggagcaggtggggcacttctccctctaacgactctccctgttgaagcgtctttgtgacgggtcgagctcgaggccctgactggtgacttcgcaggtccgtagtacgttttgtgtttcctacgttagtctccctggtcttcgagccttccgtggggctagcctaagtggctcgtggactaccgtggactccgaagtgganatagttgaggtatcgaaccctagaacctcctaacctcgtcttacgtacggtcccgtacaccccgtggaaccgacggtcccggtcctcctaacgtccgttaccgtgaccgtaaagtccttacggttaccgaacggttacggtcccctggtacgtaccttaaggtaggtacgaacgttaacgggaaacctaccgttaagtacttacggttacgttcgggtaaccctggacgtaaacgagtccgtaaacggcctaacggtccttaccgaacgtaccgtccgttaggttaatttaccgtaacggttactttacggaacggtttacttttagggtttaccggaggttaccgaccggtaagtacccggtaacgggtttcctaccggtagggttcccggaacgtcgggttaaccgggacgaacgggtaccgtaagtacctttaccgacggtactaacggaaacgtccgtacggacccgggtntacccggg

SEQ ID NO: 258063 - DNA, 578 bp, Homo sapiens
  misc_feature: GYAE6OF02G8DY1.29.21.B10.1.454.CMB.1.raw
  modified_base (430)..(430): a, c, t, g, unknown or other
  misc_feature (430)..(430): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcagctcaggccctgatgggtgacttcgcaggcgtagactttgtgtttctcgtagtctccctgctcagctcctggggctgctaatgctctggatacctggatccagtggagatagtgagatgacccagacctccactctctctgtccgtacacccctggaccagccggcctccatcctcctgacaagtcgtagtcagacgcctcgtgcagtagtgagtaggaaactacctaatagtgtactggtaacctggacagaacgtcgaggccagcctccaacgtacctccgtagtaatttanacgtaacgtttccaaagttcgtttaatttggagttcgccaaggtacgagtctcaggttcggctaggtcgggtacaaggggtacctaggtaccttttacgaactaccgttaaggtaaacttccgaacgggtacccggggtaggtaacgg

SEQ ID NO: 258064 - DNA, 772 bp, Homo sapiens
  misc_feature: GYAE6OF02GZO4V.29.21.B10.1.454.CMB.1.raw
  modified_base (222)..(222): a, c, t, g, unknown or other
  misc_feature (222)..(222): n is a, c, g, or t
  modified_base (300)..(300): a, c, t, g, unknown or other
  misc_feature (300)..(300): n is a, c, g, or t
tcagatagagtactcacgaccggtgctcgatttagtgtcgtcgcaagagaggagggggactgatcaggacttctcagttcatcttctcaccatgaggctccctgctcagctcctgggctgctaatgctctggatacctggatccagtggagatattgagatcgacccagacctccactctctcgtcgtccgtccacccgtggacacggccggcctccatccncctgcaagtctagtccaagcgtcctgacgactaagtagtagaggtaaggaaactacctatagtgtaacgtacggtccngacaaggtacgtcgacgccgacgtccctaccgaccgtactcccgtagttaattttacgtaaggtttaaccttaccgaaggtttacgtttttaggttttagggacgttacgaaccgtaaggacgtacggtctaacgggtaggtcgggaccgtaggggtccgggtaacggaagggtaaccttaagttactttaccgaaccgtaaacgtaagtaaaaccgttcgggaccggggttacgggggtacggaaccggttaggtagggaaacgggttggttaggtttaccgggttaacttttaaaggtttttattaaccggttggtaaccgttaagtaaccgggttaaaaccgtttacggtttaccgacggtttacttttacccgttttaacggtttaacggggttttaccgggaacccgggtaaccgggtttaccgtaccgtttacccgggtaacggaacgtttaacccgaaaaccggg

SEQ ID NO: 258065 - DNA, 846 bp, Homo sapiens
  misc_feature: GYAE6OF02HRC2C.29.21.B10.1.454.CMB.1.raw
  modified_base (157)..(157): a, c, t, g, unknown or other
  misc_feature (157)..(157): n is a, c, g, or t
tcagatagagtactcacgaccggtgctcgatttagtgtcgtcgcaaggagagaggggggtcaggctggaactgaggagcaggtgggggcacttctccctctaacactctcccctgttgaagctctttgtgacgggcgagctcaggccctgatgggtnacttcgcaggcgtagtactttgtgtttcctcgtagtcctccgtgtctctacgctccgtgggcgtcgactagtcgtcgtacggtacgtacgtacggtaggtacctccgttacggttgggtactaagttagttacggtacgtaggttaccgaaaccccgtaggtaccctacccgaacgtttcggtacttacgttacggttacccgtaacccgtaccccgttacgggaaccctaaccggtaccccgggtaccccttaccgttacctttcccgttacccgttaccggtaccgttaacccggttacccgtacgggtaaccgtacccgtaccggtccccgttacggtaccgtcctaacggttaggtacgtaacggttacggaaacggttacttaacgtacgtttaccggtacgttacggtaccgttacgacggttaacgtacggttaacggaaccggtacccgagttacccgttacccggtaacggttacccgttaccgttaaggttacttttaaacggtacgttaaccggttaactaccggttaccgtttacgggtaccgtaaccgttcgtaccgtaacgttacgtaaccgttcgttaacgtacggtagtacgttacggtaccggaggtggtaccctaggtaacctacgtaacgtaggtacgaacggttaccggacggtccgggtacggtacgg

SEQ ID NO: 258066 - DNA, 655 bp, Homo sapiens
  misc_feature: GYAE6OF02I68PC.29.21.B10.1.454.CMB.1.raw
  modified_base (222)..(222): a, c, t, g, unknown or other
  misc_feature (222)..(222): n is a, c, g, or t
  modified_base (233)..(233): a, c, t, g, unknown or other
  misc_feature (233)..(233): n is a, c, g, or t
  modified_base (252)..(252): a, c, t, g, unknown or other
  misc_feature (252)..(252): n is a, c, g, or t
  modified_base (282)..(282): a, c, t, g, unknown or other
  misc_feature (282)..(282): n is a, c, g, or t
  modified_base (308)..(308): a, c, t, g, unknown or other
  misc_feature (308)..(308): n is a, c, g, or t
tcagatagagtactcacgaccggtgctcgatttagtgtcgtcgcaaggagagagggggtcaggctggaactgaggagcaggtgggggcacttctccctctaacactctccctgttgaagctctttgtgacgggcgagctcaggcctgatgggtgacttcgcaggcgtagactttgtgtttctcgtagtctccctgctcagctcctgggctgactaatgctcnggatacctggntccgagtggagatattganatgacccagactccactctctctgtcctcnccccgtagacacgccggcctcatccncctgcaaggtctagtctagacgtccgtcgtgctaatggttacgagttaggaaacgtaccttaatagtacgttacgtacggtaacctcgacgtaacgacgttacgaacgggtccaacgtaccctaccgtaccgtaccgttcccgtaggttaaacttttgttaacgttaacgtttaacccgtaaggtttccgtttaaggtttttgaacgttcgtaccgaacgtacgtagggtctacgtacggttcggccgtagttccggggtacgtaaggggtacctaaacggtacgtttaccaacggttaacgaacgttaaaacgtacggtaacgggcccgggtttagggaacccggg

SEQ ID NO: 258067 - DNA, 648 bp, Homo sapiens
  misc_feature: GYAE6OF02FRWK1.29.21.B10.1.454.CMB.1.raw
  modified_base (199)..(200): a, c, t, g, unknown or other
  misc_feature (199)..(200): n is a, c, g, or t
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
  modified_base (223)..(223): a, c, t, g, unknown or other
  misc_feature (223)..(223): n is a, c, g, or t
  modified_base (255)..(255): a, c, t, g, unknown or other
  misc_feature (255)..(255): n is a, c, g, or t
  modified_base (328)..(328): a, c, t, g, unknown or other
  misc_feature (328)..(328): n is a, c, g, or t
  modified_base (358)..(358): a, c, t, g, unknown or other
  misc_feature (358)..(358): n is a, c, g, or t
  modified_base (467)..(467): a, c, t, g, unknown or other
  misc_feature (467)..(467): n is a, c, g, or t
  modified_base (523)..(523): a, c, t, g, unknown or other
  misc_feature (523)..(523): n is a, c, g, or t
tcagatagagtactcacgaccggtgctcgatttagtgtcgtcgcaaggagagaggggggtcaggctggaactgaggagcaggtgggggcacttctcctctaacactctcccctgttgaagcttctttgtgacgggcgagctcagcctgatgggtgtactcgcaggcgtagctttgtgtttctcgtagtctccctgctcnnctcgngggtctagctaangtctntggactccgtgactcagtgacgtatattgganatccgaccacgtactcccacttctctactcgtccgtccaccccgtaggaccgacgcccgtcctccgactctcncgactaagttctagtacagacgtccttcgngtcattacggagagtacggaagtacctaagtacgttgttacggtacgtacgcgtacgtaagtaactcggaacgcccgtaaccgacccttccgacttaacccgtcggttnttaattaagttaccggttaacggttaccttaaggtttaaccgttttagttttaggnggttaccgaccgtaaccgaagtacggtcctacgaggttggaccggtgaaccgggtgaaaccgggatacgtttactaaccgacgaacgttaacgtaaactcggtaccggtcggggacggttaacgg

SEQ ID NO: 258068 - DNA, 707 bp, Homo sapiens
  misc_feature: GYAE6OF02HN3CP.29.21.B10.1.454.CMB.1.raw
tcagatagagtactcacgaccggtgctcgatttagtgtcgtcgcaaggagagaggggggtcaggctggaactgaggagcaggtggggggcacttctccctctaacactctcccctgttgaagctctttgtgacgggcgagctcaggccctgagtgggtgacttcgcaggcgtagactttgtgtttctcgtagtctccctgctcagctccgtggggctgctaatgctctggactacctggactccgaggtggagtattagttgagatcgacccagacctccactcttctcctcgtccgtcccaccccgtcggacgcgtcccggccctcctactcctcctgccaagtctagtcgaagcgcctcgtcgactagtaagtggtaagtaacgggaaaactaccgttaatacgttacggtttaaccgtcgggttaccgtagcgtaaacggtaacggtccgaacggcccgaccgtacccacccgtaccgtaaccttcctagttacttttagacgtttaacgttacctaaggttacgttttacgtttagggacgttcgacgtacgacgtacgtacgtacgtacggtcggcggtacgggtaccggggttacggtaacggggaaccgttagttaacccgtttaccggaaaccgttaaccgttaaacggtaaaaaccgttccgggtaaccggggttaccggggggtacgggtaacgggg

SEQ ID NO: 258069 - DNA, 724 bp, Homo sapiens
  misc_feature: GYAE6OF02JAAA8.29.21.B10.1.454.CMB.1.raw
  modified_base (263)..(263): a, c, t, g, unknown or other
  misc_feature (263)..(263): n is a, c, g, or t
tcagatagagtactcacgaccggtgctcgatttagtgtcgtcgcaagagaggagggggttgatcaggacttctcagttcatcttctcaccatgaggctccctgctcagcctccgtggggctgctaactcgctcgtggactaccgtggatccgagtggagatattgagatcgacccagcctccactctcgtctcgtaccgtactacccgtgacacggccgcctacacgtcctcctagactaagttctagtcgagactccgtcgngcagtaggtagactaggaaacgtacttagtagtcgtactaggtacctgacgtaaggagtccgacggtccacgtccctaccgacgtacctcgtagttaactttagacgttaacggtttaaccaaggtttaccgtttaagtttagggcgttacgaccgtaagtaccgaagtccgtagtaagggtcgacggcggtacggggtacgaacgggtacgaacggttacttaaccggaactaacgtaagtaaacggtccggtacgggacggggttacgggaacgtcggtaaggtaggttacggttggttacgttacgtttaacttttagtacttgtaaccgtaagtaaccgtaacttaaggttacctaggttacctttaggttaaccgtttaccggtttacggggaaccggtaacccggggttacttaccggtaccggttacggtacttaaacccgtagtaaaacccgg

SEQ ID NO: 258070 - DNA, 626 bp, Homo sapiens
  misc_feature: GYAE6OF02F4M6Y.29.21.B10.1.454.CMB.1.raw
  modified_base (395)..(395): a, c, t, g, unknown or other
  misc_feature (395)..(395): n is a, c, g, or t
  modified_base (417)..(417): a, c, t, g, unknown or other
  misc_feature (417)..(417): n is a, c, g, or t
tcagatagagtactcacgaccggtgctcgatttagtgtcgtcgcaaggagagagggggtcaggctggaactgaggagcaggtgggggcacttctccctctaacactctccctgttgaagctctttgtgacgggcgagctcaggccctgatgggtgacttcgcaggcgtagtacttttgtgtttctcgttagtcctccctgctcagtcctcgtgggctgactaatcgctcgtggactaccgtagactaccgaggtacggagtattagttggagtatacgaacccagaccttcctaccttcttcgtcgttcggtcccgtacccacccggtggaccgcggcccgtcctccgtacgtcctaccgtcgactacgttctacgtcgacgtcgtcctcgtacnctagtcgtagagtacggaaacnctagtagttacgtacttcggactagcgtaaggtactacggacgtcctacgcctacgacgtctcgttatacttagtacgtactacgtagttattgttgaacgtcgacgtacgtagacgtctaagtcggacgtcgacgggtccggtaggacggacttagttcctacggtaactaacggttacgaaggtcggtacgggtacggtggtaccgg

SEQ ID NO: 258071 - DNA, 699 bp, Homo sapiens
  misc_feature: GYAE6OF02HZ1FY.29.21.B10.1.454.CMB.1.raw
  modified_base (272)..(272): a, c, t, g, unknown or other
  misc_feature (272)..(272): n is a, c, g, or t
  modified_base (384)..(384): a, c, t, g, unknown or other
  misc_feature (384)..(384): n is a, c, g, or t
tcagatagagtactcacgaccggtgctcgatttagtgtcgtcgcaagagaggagggggactgatcaggacttctcagttcatcttctcacatgaggctccctgctcagctccgtgggctgctaatgctcgtggactacctggactccgaggtggagtatattgagatcgaccagacctccactctctctacgtccgtacccacccgtggaccacgcccgtccctccactccgtcctgacctaacgttctacgtacgagaccgtccttacggngactaagttagtacgtaaggtaacgggtaaactaccttatacgttcgtacgttcggtacctagacgtaagacgttacgacgtaccgaccgccctaccgacgtacctacgttnttaactttagtaagttaccgttacgtaacgttagtttagtttacggcgtacaccgagtacgcggtactacgtcggtacggacgtacgggtcgggtaacggaggtactagtacttacgaacgtacgtaaacgaacgtcggacgggtacgggtacggtcgtacggaggtaggtacgttaggttcgtaactttaagttactttacgtgtactacgttaacgttaactaacgtttgacgttcgtttacgttacggttacgttacgacccgggttacggacctttacggaaccggttacgtaacccgtataaaacccggg

SEQ ID NO: 258072 - DNA, 601 bp, Homo sapiens
  misc_feature: GYAE6OF02G3QU4.29.21.B10.1.454.CMB.1.raw
  modified_base (308)..(308): a, c, t, g, unknown or other
  misc_feature (308)..(308): n is a, c, g, or t
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagactttgtgtttctcgtagtcctccctgctcagctccgtggggctgctaatgctcgtggataccgtggactccgagtggagatagttgagatcgacccagacctccactctctctcgtcccgtccaccccgtggaccncggcccgtcctccatcctccgtcgactaacgttctacgtacagacgtcccgttcgtcgactaataggtgaagtacggaaactaccttaataacgtcgttacgtcggtactcgacgtaagacgtcgacgccacgtccctacccacgtacctcgtagttatttagtacgttacgttaccaagttcgtttagtttggagtcgactacgacgacgctacgaggtcggagacggacgggtacgaagggaactagtattccgagtaacgtaagaacgtcggacgggtcggtaggtacgg

SEQ ID NO: 258073 - DNA, 674 bp, Homo sapiens
  misc_feature: GYAE6OF02ICUIZ.29.21.B10.1.454.CMB.1.raw
  modified_base (439)..(439): a, c, t, g, unknown or other
  misc_feature (439)..(439): n is a, c, g, or t
  modified_base (443)..(443): a, c, t, g, unknown or other
  misc_feature (443)..(443): n is a, c, g, or t
  modified_base (453)..(453): a, c, t, g, unknown or other
  misc_feature (453)..(453): n is a, c, g, or t
  modified_base (475)..(475): a, c, t, g, unknown or other
  misc_feature (475)..(475): n is a, c, g, or t
  modified_base (537)..(537): a, c, t, g, unknown or other
  misc_feature (537)..(537): n is a, c, g, or t
  modified_base (593)..(593): a, c, t, g, unknown or other
  misc_feature (593)..(593): n is a, c, g, or t
tcagatagagtactcacgaccggtgctcgatttagtgtcgtcgcaagagaggagggggactgatcaggacttctcagttcatcttctcaccatgaggcctccctgctcagctccgtggggctgctaatgctcgtggataccgtggactccgaggtggagattattgagatcgaacccagacctcctactctctcgtcgtccgtcccaccctggaccacggccccgcctcctactccttcctgactaagttcgtagtacgacgaccgtcctcggtctacgtaagttacggtgtaagtaagggaaacgtaccttattagttacgttacgtccggtacctggacaagtacgcgaccgtccacgccctaccgacgtacctcgttacgttatttacgtaagttaccgttactaagttgtttagtttggacgtacgacgagacgngtcnggtagtcggngcggtcggaggagacgtattanaccaagtacgtaaagaacgttcggaggtaccgggtgacgtcgtaggagttggttcggtttanagtttagttttacttagtcgtagttacgttacgaacgtttaacgtagttacggttntttaacgttaccgggtttacgtttccgggaaccgttacgggtacccttcggtaccgtaacgttaacccgttactaacccgg

SEQ ID NO: 258074 - DNA, 734 bp, Homo sapiens
  misc_feature: GYAE6OF02JZT5O.29.21.B10.1.454.CMB.1.raw
  modified_base (312)..(312): a, c, t, g, unknown or other
  misc_feature (312)..(312): n is a, c, g, or t
tcagatagagtactcacgaccggtgctcgatttagtgtcgtcgcaaggagagagggggtcaggctggaactgaggagcaggtgggggcacttctccctctaacactctccctgttgaagctctttgtgacgggcgagctcacggccctgatgggtgacgttcgcgaggcgtagtactttgtgtttctcgtagtcctccctgctcagtctcgtgggctgctaatgctcgtgtataccgtggactcgaggtggagtatagtgagtatcgaccagcctacctacttctctctacgtccctccctacccgtggacnccggccgtccctccgtactcctccgtacgactaacgttcgtacgtacgaagtccgtccgtcggtactactagttaaggtacgtaaggtaacggtaaaacttaaccgttaagtacgttacggttaccgttacggttacccgtagaaccgtaaagggtaccacccggtaacgacccgaacggtacccccgttaaacgacccgtacttaccgtaattacttttaaacgacgtttaaaccgttacgtaacgttttcgggttttaaacgttttggaccgttcgtacccgagtaaccgcggttcctaggtaggttcccggaggtacgggtaccggggttaacggacggtttaaacgtcgttaaacccttcgtaaaccgtaaccgtaagggtaacccgttacggacgggggttacggcgggttaaccgg

SEQ ID NO: 258075 - DNA, 789 bp, Homo sapiens
  misc_feature: GYAE6OF02IGFEL.29.21.B10.1.454.CMB.1.raw
  modified_base (98)..(98): a, c, t, g, unknown or other
  misc_feature (98)..(98): n is a, c, g, or t
tcagatagagtactcacgaccggtgctcgatttagtgtcgtcgcaaggagagaggggtcaggctggaactgaggagcaggtgggggcacttctccctntaacactctcccctgttgaagctctttgtgacgggcgagctcaggccctgatgggtgacttcgcaggcgtcgagtactttgttcgtttactcggttacgtcctcccgtgtccttacgacgtccgttccggtggggtctcgtactaagtcgtctcgtaggtactaccgtaggtactcggtaggtaggtaagtattaagttcggaagtaacgtaccgaaccgtacgtaaccttcctacttctaccttcgttccggtccccgttaccctaccccgtacggaaccgccggtcccccgtaccttccgtaaccttcctacccgtacgtaaccgtaacgttacgtaccggtacgtaacgtccggttacccgtttcggtaacgccgttaaaggttacgtaggtaaacggtaaacgggtaaacctaacgttacgttacgttacggttaacggttcgtaactacgacgtaaaggtacgacggaccgtcgtaaccgccgttaccgtaaccgttcttaacgttagtttacgttagttaaccgttaacgtttaaccgaggtttacgttttaagttacgggctaaccgggtacgtaacggacgtcggtactaggtacggtcgtacggcgggttaccgacggaacggtacgttacgttacaacccgtataaccgttaagtaccgtacgggtccggtggttaaccgg

SEQ ID NO: 258076 - DNA, 901 bp, Homo sapiens
  misc_feature: GYAE6OF02JWHUE.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcaggccctgatgggtgacttcgcaggcgtagtactttgtgtttctcgtagtcctccctgtctcgacgctccgttgggctgtctaatcgcttcgtggtactaccgtaggactaccgtaggtgggatagttattacggaagtacgtacgaacccgaacgtaccttacccgtaaccttccttccgttcgtaccggttccccggttaccctaacccccggtcggtaaccgaccgggtccccgggtcccctacccggtacttccccgtccgtacgtacccgtaacggttaccgttaaccggttaccgaacgggtaaccgtcccgttaccggttaccgtaccgttaaggttacggtacggtaaacggttacggggtaaaaaccgtaaccccgttaaagttaccggttaccggttaaccggttaccggttaaccgtttacgaccggtaaggaaccggttccgaaccgggtaccctacgaccccgttaccgaacccgggttaccttacccggtttaggtaactttttaacggtacggtttaaacccggttcccgtaaacggtttccggtttttaaggttttcgggtagttcccgtaaacccgttagggacccgttaccgggttacttccggtaacggggtaccgtacgggtaccgggttaacggggtacgaaacgggggttaacgtaaccgtttaccgggttaactaacccggttaaccgttaaccgaaaccggtttgggaaccccgggttgggggtaacggtaccggg

SEQ ID NO: 258077 - DNA, 788 bp, Homo sapiens
  misc_feature: GYAE6OF02FIMPB.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacggcgagctcaggccctgatgggtgacttcgcgaggcgtagtactttgtgtttctcgtagtcctcctgctcagctccgtgggtctgctaatcgtcttcgtaggactaccgtggatccgaggtggagtattacgttagaacgtagtacgacccagtaccgtacctacctcttccgtccttccggttcccgtacccgtacccgtgggaccaccggtccccggtaccctccctaaccgttcctaccgtacgtaaccgttaacggttaccgttagtaccgaaacggtccgtccggttacggtcgtaactaacgttacggtacgtaacggtaacggaaaccgttaaccgtaagtttaaccgttacgttaccggttacggttaccgtagtaaccgtaaacggtaacgttaccgacggtacccgtaccgtacccgtacccgtaaccgtaccgtcccgttaagttaacgttttacggttaaccgttaacgtttaaccgttaacggttaggtttttacgtttaggtacgttacgtacgtaaggtacctacgggtacctcggtagtacgcgtaccgggtcgggtaacggtaacgggtactaacggttacttaacccggacgttaacgtaaacgtaacggtaccggtacggggtacgggtaggtacggg

SEQ ID NO: 258078 - DNA, 839 bp, Homo sapiens
  misc_feature: GYAE6OF02IU945.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacgggcgagctcgaggccctgagtgggtgacttcgcaggcgtagtactttgttgtttcctcgttagttcctcccgtgtcctcgacgtcgtccgtggggctcgactaagtcgtccttcgtacggactaccgtggtactccgaggtaggagtagtagttaggagtacgtaccgaacccgtaacgtacccgttaccccacgttccttccgttaccgttccggttccccgtaccccgtacccccggtaggacccgaccggtccccggtacccttcccgtacgttcccgtccccggttacgaccgtaacgttacgtacgtacgacggtaccgtcccgttcggtacgacgttaacgtaggtacgtaaggtaaacggtaaaaccgttaactttaacgtacgttacggttaccggtaccgggtttaaccgtacggaaccgtaacgggtaaacgtcccggaacggtaccccgtaaccgtccccgtaccgaaccgttaccccttcgttaagttaacttttaacgggtaacgtttaaaccgtttaccggttaaacgttttacggttttttacggttagggtaaccgttacggtacccgtaaggtaaccggtcgttaccgtacggtacgggtcgaacggtacggtccggtaacggaggtaacctacggttacttaccgaacgtaacgttaacgaacggttcggaccgggttcggtaggtacg

SEQ ID NO: 258079 - DNA, 703 bp, Homo sapiens
  misc_feature: GYAE6OF02F9GF8.29.21.B10.1.454.CMB.1.raw
  modified_base (164)..(164): a, c, t, g, unknown or other
  misc_feature (164)..(164): n is a, c, g, or t
  modified_base (219)..(219): a, c, t, g, unknown or other
  misc_feature (219)..(219): n is a, c, g, or t
  modified_base (630)..(630): a, c, t, g, unknown or other
  misc_feature (630)..(630): n is a, c, g, or t
tcagatagagtactcacgaccggtgctcgatttagtgtcgtcgcaagaggagagggggtgatcaggacttctcagttcatcttctcaccatcgaggctccctgctcagctcctggggctgctaatgctctggatccgtggactccaggtggagtatagttgagntcgacccagactccacgtctctctgtccgtccacccgtaggaccgagccggtccncctactcctccgtgaacgtaacgtctaggaccgtaaggaccgtccgtcgtgacctagttaggtagagttaacggaaacgtacttatagttcgttaactcggtacctaggactaagacgtcgacggccacgtccccgtacgtaaccgtaccgtacctagttactttaacgtacggttaaacctttacccggtaaggttcggtttacgtttggaacggttacgaaccgtaacggttaccgaacggttcccgtaggtacgggtacgggcgtagggtaccgggtacggaacgggtatacgttacgttacgtaacgtacgtaagaaaccgtggtacgggcgggtaggcgtccgtaggagtacgttaggtagtaccttagttagttcgttagacttagtacgtacgttaagttacgngtacgtttcggtacgttaccggttcgacggtaacgttaccgacgttacggagtaccgtaacgtactaaaccgg

SEQ ID NO: 258080 - DNA, 629 bp, Homo sapiens
  misc_feature: GYAE6OF02IMADY.29.21.B10.1.454.CMB.1.raw
  modified_base (104)..(104): a, c, t, g, unknown or other
  misc_feature (104)..(104): n is a, c, g, or t
  modified_base (128)..(128): a, c, t, g, unknown or other
  misc_feature (128)..(128): n is a, c, g, or t
  modified_base (210)..(210): a, c, t, g, unknown or other
  misc_feature (210)..(210): n is a, c, g, or t
  modified_base (250)..(250): a, c, t, g, unknown or other
  misc_feature (250)..(250): n is a, c, g, or t
  modified_base (342)..(342): a, c, t, g, unknown or other
  misc_feature (342)..(342): n is a, c, g, or t
  modified_base (378)..(378): a, c, t, g, unknown or other
  misc_feature (378)..(378): n is a, c, g, or t
  modified_base (388)..(388): a, c, t, g, unknown or other
  misc_feature (388)..(388): n is a, c, g, or t
  modified_base (465)..(465): a, c, t, g, unknown or other
  misc_feature (465)..(465): n is a, c, g, or t
tcagatagagtactcacgaccggtgctcgatttagtgtcgtcgcaagagaggagggggtgatcaggacttctcagttcatcttctcaccatgagctccctgctnagctccgtgggctgctaatgctcnggactaccgtggactccgaggtggatatattgagtatcgacccagtacctcactctctcgtcgtaccgtccacccgtgaacncgccgcctctatctctgactaagtctagcgagctctgtanactataggtagagtaacggaaactactatagtcgttaacgtcgtacgtctacgaaggtacgcgacgaccacgtcccaccgtacgtctccgtnttattacgagttacgtataggttctttagtcgggancgtacacggntccggtactgtagggtcgacgtacgggtcgggacgtagggtacaagttacgttacaacgttaaccgtaaggtaaacncgggtaacgggtcgggtaggtcggtcgtaggtacggttagtcggttacgtatttaacgttatgtactagtaacgtcggttaaacttacgtacgtagtccgtttaggttacctttaacgggtcggtacggtaaccgtcgtacgtcgactactacggtactaacgg

SEQ ID NO: 258081 - DNA, 957 bp, Homo sapiens
  misc_feature: GYAE6OF02I8A0W.29.21.B10.1.454.CMB.1.raw
  modified_base (876)..(876): a, c, t, g, unknown or other
  misc_feature (876)..(876): n is a, c, g, or t
tcagatagagtactcacgaccggtgctcgatttagtgtcgtcgcaaggagagagggggtcaggctggaactgaggagcaggtgggggcacttctccctctaacactctcccgtgttgaagtctctttgtgacgggcgagctcacggccctgagtgggtcgacttcgcgaggcgtagactttgtcgttctcgtagtctcctgactcgagtctccgtggggtctagtactaagtcgtactcgtaggacttaccgtaggtactccgtaaggtggaagtaagttaacgtggtaacgtacgttacgaaccgtaacgtacccttaatcccctaacgttaccgttaccgttaccgttacgttaccccgttaccggtaaccccgtaacggggtaacccgtaccgtaccccggtacccgttaccgtaacctttaccgttacccgtaacggtaaccgttaaacggtttaccgtaaacggttaccgtaacgtaaccggtacccgttacggtaacgtaccgttaagttaaggtttaacggaaaacggttaacggtaaaacgttaacctttaaacgttaaaccggtttaaccggttaaccgttacgggttaaccgtaaacgggtaacgtaaacggtaaacggtaccgtaaaccgggtcccgtaaaccggtaacccttaacccggtaaacccgttaaccggttaaccgtttaaacggttaacgttttaaaccggttaaaccggttaaacggttttaacccgtttaaacgggtttaacggttttaaacggtttacgggtaaccgttaaccggtaaaccggtaacggttaaccgtacggttaacccgttaacggaaccggtaacgggtaccggtaacggtaacggggtaacncgggttaaacggttaaccggttaacgttaacgtaacgttaaacgtaacggtaacggtaacgggttacggaccgggtaacgg

SEQ ID NO: 258082 - DNA, 811 bp, Homo sapiens
  misc_feature: GYAE6OF02GSD0T.29.21.B10.1.454.CMB.1.raw
tcagatagagtactcacgaccggtgctcgatttagtgtcgtcgcaaggagagagggggtcaggctggaactgaggagcaggtgggggcacttctccctctaacactctcccctgttgaagctctttgtgacggcgagctcaggccctgatgggtgacttcgcaggcgtagactttgtgttctcgtagtctcctgctcagtctcgtgggctgactaagtgtccgtctcggactaccgtggtactccgaaggtgggtagtagtaagtttcggaagtactacgaaccccgtaagccttacccacttctaccgttctacggttccccgtaccctaaccccggtggaaccgacggtccccggtcctaccctacttccgttccgtaggacctaaacggttcacggttaccaaggtacctaccccggttcgtcgtaccgtaaaggttcgtaaggggtaacgttaaaggggaaacctaaccgttaagttaacggttacggttaacgttaccgggtaaccttcgggaacaaacgggttaaacgttccgaacgggtacccctaaaccggtccaccccgttaacgtaacccgttccgtaaggtttaacgttttaacgtacggtttaaccgtttccgaaacggttttacgttttaacggtggtaaacgttccgacctaaaggtaccgtacgggttccctggtaaggaccgggttacgaaccgggtccgggttaaggaacgggttaactacgttacgtttacccgaaacgttaacggtaacccgttaaagcccgggtaaccggggttccgggtaggtaaccggg

SEQ ID NO: 258083 - DNA, 311 bp, Homo sapiens
  misc_feature: GYAE6OF01A7UYF.19.73.G07.1.454.CMB.1.raw
  modified_base (307)..(311): a, c, t, g, unknown or other
  misc_feature (307)..(311): n is a, c, g, or t
tcagtactctcgtgcacgaccggtgctcgatttagctctacgctcaggggagctctgggagaggagccccagccttgggattcccaagtgtttcattcagtgatcaggactgaacacagaggactcaccatggagtttgggctgagctggattttccttgctgctattttaaagcctcaccaagggcccatcggtcttcccctggcgccctgctccaggagcacctccgagagcacagcggccctgggctgcctggtcaaggactacttcccacgagagtactgagcgggctggcaaggcgcatagnnnnn

SEQ ID NO: 258084 - DNA, 244 bp, Homo sapiens
  misc_feature: GYAE6OF01EEHIK.19.73.G07.1.454.CMB.1.raw
  modified_base (241)..(244): a, c, t, g, unknown or other
  misc_feature (241)..(244): n is a, c, g, or t
tcagtactctcgtgcacgaccggtgctcgatttagctctacgctcagggtcttcgtggctcacgtccaccaccacgcatgtgacctcaggggtccgggagatcatgagggtgtccttgggtttgggggaagaggaagactgacggtcccccaggagttcaggtgctgggcacagcggcctgggctgcctggtcaaggactacttccacgagagtactgagcgggctggcaaggcgcatagnnnn

SEQ ID NO: 258085 - DNA, 267 bp, Homo sapiens
  misc_feature: GYAE6OF01AL4CV.19.73.G07.1.454.CMB.1.raw
  modified_base (246)..(267): a, c, t, g, unknown or other
  misc_feature (246)..(267): n is a, c, g, or t
tcagtactctcgtgcacgaccggtgctcgatttagctctacgctcagggtcttcgtggctcacgtccaccaccacgcatgtgacctcaggggtccgggagatcatgagggtgtccttgggttttgggggaagaggaagactgacggtccccccaggagttcaggtgctgggcacagcggccctgggctgcctggtcaaggactacttcccacgagagtactgagcgggctggcaaggcgcagtagnnnnnnnnnnnnnnnnnnnnnn

SEQ ID NO: 258086 - DNA, 246 bp, Homo sapiens
  misc_feature: GYAE6OF01B3W64.19.73.G07.1.454.CMB.1.raw
  modified_base (242)..(246): a, c, t, g, unknown or other
  misc_feature (242)..(246): n is a, c, g, or t
tcagtactctcgtgcacgaccggtgctcgatttagctctacgctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttcccacgagatactgagcgggctggcaaggcgcatagnnnnn

SEQ ID NO: 258087 - DNA, 315 bp, Homo sapiens
  misc_feature: GYAE6OF01DP7JV.19.73.G07.1.454.CMB.1.raw
  modified_base (310)..(315): a, c, t, g, unknown or other
  misc_feature (310)..(315): n is a, c, g, or t
tcagtactctcgtgcacgaccggtgctcgatttagctctacgctcaggggagctctgggagaggagccccagccttgggattcccaagtgttttcattcagtgatcaggactgaacacagaggactcaccatggagtttgggctgagctggattttccttgctgctattttaaagcctccaccaagggcccatcggtcttccccctggcgccctgctccaggagcacctccgagagcacagcggccctgggctgcctggtcaaggactacttcccacgagagtactgagcgggctggcaaggcgcatagnnnnnn

SEQ ID NO: 258088 - DNA, 246 bp, Homo sapiens
  misc_feature: GYAE6OF01APC5X.19.73.G07.1.454.CMB.1.raw
  modified_base (241)..(246): a, c, t, g, unknown or other
  misc_feature (241)..(246): n is a, c, g, or t
tcagtactctcgtgcacgaccggtgctcgatttagctctacgctcagggtcttcgtggctcacgtccaccaccacgcatgtgacctcaggggtccgggagatcatgagggtgtccttgggtttgggggaagaggaagactgacggtcccccaggagttcaggtgctgggcacagcggcccggctgcctggtcaaggactacttcccacgagagtactgagcgggctggcaaggcgcatagnnnnnn

SEQ ID NO: 258089 - DNA, 314 bp, Homo sapiens
  misc_feature: GYAE6OF01AFR5P.19.73.G07.1.454.CMB.1.raw
  modified_base (309)..(314): a, c, t, g, unknown or other
  misc_feature (309)..(314): n is a, c, g, or t
tcagtactctcgtgcacgaccggtgctcgatttagctctacgctcaggggagctctgggagaggagccccagccttgggattcccaagtgttttcattcagtgatcaggactgaacacagaggactcaccatggagtttgggctgagctggattttccttgctgctatttaaagcctccaccaagggcccatcggtcttcccctggcgccctgctccaggagcacctccgagagcacagcggccctgggctgcctggtcaaggacctacttcccacgagagtactgagcgggctggcaaggcgcatagnnnnnn

SEQ ID NO: 258090 - DNA, 300 bp, Homo sapiens
  misc_feature: GYAE6OF01B3O03.19.73.G07.1.454.CMB.1.raw
  modified_base (218)..(218): a, c, t, g, unknown or other
  misc_feature (218)..(218): n is a, c, g, or t
  modified_base (275)..(275): a, c, t, g, unknown or other
  misc_feature (275)..(275): n is a, c, g, or t
  modified_base (298)..(300): a, c, t, g, unknown or other
  misc_feature (298)..(300): n is a, c, g, or t
tcagtactctcgtgcacgaccggtgctcgatttagctctacgctcaggggagctctgggagaggagccccagccttgggattcccaagtgttttcattcagtgatcaggactgaacacagaggactcaccatggagtttggctgagctggattttcctgctgctatttaaagcctccaccaaggcccatcggtcttcccctggcgcctgctccaggancactccgagagcacaggcgcctgggctgcctggtcaaggctactccacgagagtacngagcgggctggcaaggcgcatgnnn

SEQ ID NO: 258091 - DNA, 390 bp, Homo sapiens
  misc_feature: GYAE6OF01BVJKG.19.73.G07.1.454.CMB.1.raw
  modified_base (146)..(146): a, c, t, g, unknown or other
  misc_feature (146)..(146): n is a, c, g, or t
  modified_base (225)..(225): a, c, t, g, unknown or other
  misc_feature (225)..(225): n is a, c, g, or t
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
  modified_base (258)..(258): a, c, t, g, unknown or other
  misc_feature (258)..(258): n is a, c, g, or t
  modified_base (372)..(390): a, c, t, g, unknown or other
  misc_feature (372)..(390): n is a, c, g, or t
tcagtactctcgtgcacgaccggtgctcgatttagctctacgctcaggggagctctgggagaggagccccagccttgggattcccaagtgttttcattcagtgatcaggactagaacagagagactcacagtggtaggttggctgngtcgtggttacttttcctgctgtactttaaaagtttaaacgccctaccaacgaacggcctagttccggtcccttcccgnggccncctgcctacgagcncctaccgcgagacncaacgcggccgtccgtggctcgccgttggacaaacggtaccttacccgtacccgaaggagtaaacgttcagggacgggccgggtatcgggaacgaaaggtcccgaataagtggnnnnnnnnnnnnnnnnnnn

SEQ ID NO: 258092 - DNA, 423 bp, Homo sapiens
  misc_feature: GYAE6OF01C7AHV.19.73.G07.1.454.CMB.1.raw
  modified_base (396)..(423): a, c, t, g, unknown or other
  misc_feature (396)..(423): n is a, c, g, or t
tcagtactctcgtgcacgaccggtgctcgatttagctctacgctcaggggagctctgggagaggagccccagccttgggattcccaagttgttttcattcagtgatcaggactgaacacagaggactcacatggagttgggctgagctggtacttttcctgctgtacttaattttaaaaacgccctaccaaccgaacgggccccaagttccggtccttcccccccgtgggccgccctggcctccgaggacgccaccgtccgaagacgccacgacggccggccctggggctcgccgttgggtaccaaaacgggtacctttaacccttaccccgaaggaaacgacgttaccgtaggaacggccggggtctagggacccgaaaggccgtacaagtaagnnnnnnnnnnnnnnnnnnnnnnnnnnnn

SEQ ID NO: 258093 - DNA, 333 bp, Homo sapiens
  misc_feature: GYAE6OF01BNH6H.19.73.G07.1.454.CMB.1.raw
  modified_base (214)..(214): a, c, t, g, unknown or other
  misc_feature (214)..(214): n is a, c, g, or t
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
  modified_base (319)..(333): a, c, t, g, unknown or other
  misc_feature (319)..(333): n is a, c, g, or t
tcagtactctcgtgcacgaccggtgctcgatttagctctacgctcaggggagctctgggagaggagccccagccttgggattcccaagtgttttcattcagtgatcaggactgaacacagaggactcaccatggagtttgggctgagctggtattttccttgctgcttaattttaaaagcctccaccaagggcccatcggtcttccccctggcnccctgcctccgaggacgcacctcganagcacnggccgcctgggctgcctggtcaaggactactcccagagagtactgaggcgggctggccaagggccgcataggnnnnnnnnnnnnnnn

SEQ ID NO: 258094 - DNA, 251 bp, Homo sapiens
  misc_feature: GYAE6OF02IOSO8.19.73.G07.1.454.CMB.1.raw
  modified_base (242)..(251): a, c, t, g, unknown or other
  misc_feature (242)..(251): n is a, c, g, or t
tcagtactctcgtgcacgaccggtgctcgatttagctctacgctcagggtcttcgtggctcacgtccaccaccacgcatgtgacctcaggggtccgggagatcatgagggtgtccttgggtttggggaagaggaagactgacggtcccccaggagttcaggtgctgggcacagcggccctgggctgcctggtcaaggactacttcccacgagagtactgagcgggctggcaaggcgcatagnnnnnnnnnn

SEQ ID NO: 258095 - DNA, 246 bp, Homo sapiens
  misc_feature: GYAE6OF02GE4B0.19.73.G07.1.454.CMB.1.raw
  modified_base (243)..(246): a, c, t, g, unknown or other
  misc_feature (243)..(246): n is a, c, g, or t
tcagtactctcgtgcacgaccggtgctcgatttagctctacgctcagggtcttcgtggctcacgtccaccaccacgcatgtgacctcaggggtccgggagatcatgagggtgtccttgggtttgggggaagaggaagactgacggtcccccaggagttcaggtgctgggcacagcggccctgggctgcctggtcaaggactacttcccacgagagtactgagcgggctggcaaggcgcatagnnnn

SEQ ID NO: 258096 - DNA, 259 bp, Homo sapiens
  misc_feature: GYAE6OF02I5FVD.19.73.G07.1.454.CMB.1.raw
  modified_base (247)..(259): a, c, t, g, unknown or other
  misc_feature (247)..(259): n is a, c, g, or t
tcagtactctcgtgcacgaccggtgctcgatttagctctacgctcagggtcgttcgtggctcacgtccaccaccacgcatgtgacctcaggggtccgggagatcatgagggtgtccttgggttttggggggaagaggaagactgacggtcccccaggagttcaggtgctgggcacagcggccctgggctgcctggtcaaggactacttccccacgagagtactgagcgggctggcaaggcgcatagnnnnnnnnnnnnn

SEQ ID NO: 258097 - DNA, 251 bp, Homo sapiens
  misc_feature: GYAE6OF02IPD27.19.73.G07.1.454.CMB.1.raw
  modified_base (246)..(251): a, c, t, g, unknown or other
  misc_feature (246)..(251): n is a, c, g, or t
tcagtactctcgtgcacgaccggtgctcgatttagctctacgctcagggtcttcgtggctcacgtccaccaccacgcatgtgacctcaggggtccgggagatcatgagggtgtccttgggttttggggggaagaggaagactgacggtccccccaggagttcaggtgctgggcacagcggccctgggctgcctggtcaaggactacttcccacgagagtactgagcgggctggcaaggcgcatagnnnnnn

SEQ ID NO: 258098 - DNA, 249 bp, Homo sapiens
  misc_feature: GYAE6OF02ICA3C.19.73.G07.1.454.CMB.1.raw
  modified_base (243)..(249): a, c, t, g, unknown or other
  misc_feature (243)..(249): n is a, c, g, or t
tcagtactctcgtgcacgaccggtgctcgatttagctctacgctcagggtcttcgtggctcacgtccaccaccacgcatgtgacctcaggggtccgggagatcatgagggtgtccttgggtttggggggaagaggaagactgacggtccccccaggagttcaggtgctgggcacagcggcctgggctgcctggtcaaggactacttccacgagagtactgagcgggctggcaaggcgcatagnnnnnnn

SEQ ID NO: 258099 - DNA, 319 bp, Homo sapiens
  misc_feature: GYAE6OF02IL8U6.19.73.G07.1.454.CMB.1.raw
  modified_base (212)..(212): a, c, t, g, unknown or other
  misc_feature (212)..(212): n is a, c, g, or t
  modified_base (310)..(319): a, c, t, g, unknown or other
  misc_feature (310)..(319): n is a, c, g, or t
tcagtactctcgtgcacgaccggtgctcgatttagctctacgctcagggggagctctgggagaggagccccagccttgggattcccaagtgttttcattcagtgatcaggactgaacacagaggactcaccatggagtttgggctgagctggtattttccttgctgcttattttaaaagcctccaccaaggcccatcggtcttcccctggcnccctgctccaggagcacctccgagagcacagccggccctgggctgcctggtcaaggctactcccagagagtactgagcggctggcaaggcgacatagnnnnnnnnnn

SEQ ID NO: 258100 - DNA, 466 bp, Homo sapiens
  misc_feature: GYAE6OF02GRQB1.19.73.G07.1.454.CMB.1.raw
  modified_base (403)..(404): a, c, t, g, unknown or other
  misc_feature (403)..(404): n is a, c, g, or t
  modified_base (406)..(406): a, c, t, g, unknown or other
  misc_feature (406)..(406): n is a, c, g, or t
  modified_base (408)..(408): a, c, t, g, unknown or other
  misc_feature (408)..(408): n is a, c, g, or t
  modified_base (410)..(411): a, c, t, g, unknown or other
  misc_feature (410)..(411): n is a, c, g, or t
  modified_base (413)..(466): a, c, t, g, unknown or other
  misc_feature (413)..(466): n is a, c, g, or t
tcagtactctcgtgcacgaccggtgctcgatttagctctacgctcagggggagctctgggagaggagccccagccttgggattcccaagtgttttcattcagtgatcaggactgaacacagaggactcaccatggagtttgggctgagctggattttcctgctgcttaatttaaaacgcctccaccaacgggcccatcggtccttcccccgtggccgccctgcctccgaggacgccaccctccgaggacgcacgacggccggcccgtggggctcggcccgttagggtacgaaacgggtaccttacccgttccccgaacggtaacggtaacggttaaccgcgggaacggggcccggggtacggttcgggaaccggtaaacggggcccgaacgtaacgtaacggnngngngnngnnnnnnnnnnnnnnnnnnnnnnnnnnnnnnnnnnnnnnnnnnnnnnnnnnnnnn

SEQ ID NO: 258101 - DNA, 115 bp, Homo sapiens
  misc_feature: GYAE6OF01C6XZH.51.68.G02.1.454.CMB.1.raw
  modified_base (115)..(115): a, c, t, g, unknown or other
  misc_feature (115)..(115): n is a, c, g, or t
tcagcgatcgtatacacgaccggtgctcgatttagtcgatagtgaagggaaggcagcgtcactctgttcccaccctcctctcgtagcactctgagcggctggcaaggcgcatagn

SEQ ID NO: 258102 - DNA, 118 bp, Homo sapiens
  misc_feature: GYAE6OF01BXU8W.51.68.G02.1.454.CMB.1.raw
  modified_base (118)..(118): a, c, t, g, unknown or other
  misc_feature (118)..(118): n is a, c, g, or t
tcagcgatcgtatacacgaccggtgctcgatttagtcgatagtgaagggaaagggcagcgtcactctgttcccaccctcctctcgtagcactctgagcgggctggcaaggcgcatagn

SEQ ID NO: 258103 - DNA, 117 bp, Homo sapiens
  misc_feature: GYAE6OF01DBEHA.51.68.G02.1.454.CMB.1.raw
tcagcgatcgtatacacgaccggtgctcgatttagtcgatagtgaagggaaagggcagcgtcactctgttcccaccctcctctcgtagcactctgagcgggctggcaaggcgcatag

SEQ ID NO: 258104 - DNA, 116 bp, Homo sapiens
  misc_feature: GYAE6OF01A3KX4.51.68.G02.1.454.CMB.1.raw
tcagcgatcgtatacacgaccggtgctcgatttagtcgatagtgaagggaaagggcagcgtcactctgttcccgccctcctctcgtagcactctgagcggctggcaaggcgcatag

SEQ ID NO: 258105 - DNA, 118 bp, Homo sapiens; identical to SEQ ID NO: 258102
  misc_feature: GYAE6OF01DW4A4.51.68.G02.1.454.CMB.1.raw
  modified_base (118)..(118): a, c, t, g, unknown or other
  misc_feature (118)..(118): n is a, c, g, or t

SEQ ID NO: 258106 - DNA, 118 bp, Homo sapiens; identical to SEQ ID NO: 258102
  misc_feature: GYAE6OF01DV5XD.51.68.G02.1.454.CMB.1.raw
  modified_base (118)..(118): a, c, t, g, unknown or other
  misc_feature (118)..(118): n is a, c, g, or t

SEQ ID NO: 258107 - DNA, 118 bp, Homo sapiens; identical to SEQ ID NO: 258102
  misc_feature: GYAE6OF01DUXUI.51.68.G02.1.454.CMB.1.raw
  modified_base (118)..(118): a, c, t, g, unknown or other
  misc_feature (118)..(118): n is a, c, g, or t

SEQ ID NO: 258108 - DNA, 118 bp, Homo sapiens; identical to SEQ ID NO: 258102
  misc_feature: GYAE6OF01EYL6A.51.68.G02.1.454.CMB.1.raw
  modified_base (118)..(118): a, c, t, g, unknown or other
  misc_feature (118)..(118): n is a, c, g, or t

SEQ ID NO: 258109 - DNA, 116 bp, Homo sapiens; identical to SEQ ID NO: 258104
  misc_feature: GYAE6OF01CEA69.51.68.G02.1.454.CMB.1.raw

SEQ ID NO: 258110 - DNA, 134 bp, Homo sapiens
  misc_feature: GYAE6OF01CO2NT.51.68.G02.1.454.CMB.1.raw
  modified_base (119)..(134): a, c, t, g, unknown or other
  misc_feature (119)..(134): n is a, c, g, or t
tcagcgatcgtatacacgaccggtgctcgatttagtcgatagtgaagggaaagggcagcgtcactctgttcccaccctcctctcgtagcactctgagcgggctggtcaaggcgcatagnnnnnnnnnnnnnnnn

SEQ ID NO: 258111 - DNA, 118 bp, Homo sapiens
  misc_feature: GYAE6OF02FT62C.51.68.G02.1.454.CMB.1.raw
  modified_base (117)..(118): a, c, t, g, unknown or other
  misc_feature (117)..(118): n is a, c, g, or t
tcagcgatcgtatacacgaccggtgctcgatttagtcgatagtgaagggaagggcagcgtcactctgttcccgccctcctctcgtagcactctgagcgggctggcaaggcgcatagnn

SEQ ID NO: 258112 - DNA, 118 bp, Homo sapiens
  misc_feature: GYAE6OF02ICBG0.51.68.G02.1.454.CMB.1.raw
  modified_base (117)..(118): a, c, t, g, unknown or other
  misc_feature (117)..(118): n is a, c, g, or t
tcagcgatcgtatacacgaccggtgctcgatttagtcgatagtgaagggaaagggcagcgtcactctttcccgccctcctctcgtagcactctgagcgggctggcaaggcgcatagnn

SEQ ID NO: 258113 - DNA, 115 bp, Homo sapiens
  misc_feature: GYAE6OF02GAPM0.51.68.G02.1.454.CMB.1.raw
  modified_base (115)..(115): a, c, t, g, unknown or other
  misc_feature (115)..(115): n is a, c, g, or t
tcagcgatcgtatacacgaccggtgctcgatttagtcgatagtgaaggaagggcagcgtcactctgttcccacctcctctcgtagcactctgagcgggctggcaaggcgcatagn

SEQ ID NO: 258114 - DNA, 116 bp, Homo sapiens
  misc_feature: GYAE6OF02GPU9E.51.68.G02.1.454.CMB.1.raw
  modified_base (116)..(116): a, c, t, g, unknown or other
  misc_feature (116)..(116): n is a, c, g, or t
tcagcgatcgtatacacgaccggtgctcgatttagtcgatagtgaagggaagggcagcgtcactctgttcccgccctcctctcgtagcactctgagcggctggcaaggcgcatagn

SEQ ID NO: 258115 - DNA, 125 bp, Homo sapiens
  misc_feature: GYAE6OF02GBL8F.51.68.G02.1.454.CMB.1.raw
  modified_base (118)..(125): a, c, t, g, unknown or other
  misc_feature (118)..(125): n is a, c, g, or t
tcagcgatcgtatacacgaccggtgctcgatttagtcgatagtgaagggaaagggcagcgtcactctgttcccaccctcctctcgtagcactctgagcgggctggcaaggcgcatagnnnnnnnn

SEQ ID NO: 258116 - DNA, 116 bp, Homo sapiens
  misc_feature: GYAE6OF02FOB1S.51.68.G02.1.454.CMB.1.raw
tcagcgatcgtatacacgaccggtgctcgatttagtcgatagtgaagggaagggcagcgtcactctgttcccgccctcctctcgtagcactctgagcgggctggcaaggcgcatag

SEQ ID NO: 258117 - DNA, 117 bp, Homo sapiens
  misc_feature: GYAE6OF02FQ3Q1.51.68.G02.1.454.CMB.1.raw
  modified_base (97)..(97): a, c, t, g, unknown or other
  misc_feature (97)..(97): n is a, c, g, or t
tcagcgatcgtatacacgaccggtgctcgatttagtcgatagtgaagggaaagggcagcgtcactctgttcccaccctcctctcgtagcactctgancgggctggcaaggcgcatag

SEQ ID NO: 258118 - DNA, 117 bp, Homo sapiens
  misc_feature: GYAE6OF02G9T5F.51.68.G02.1.454.CMB.1.raw
  modified_base (112)..(112): a, c, t, g, unknown or other
  misc_feature (112)..(112): n is a, c, g, or t
tcagcgatcgtatacacgaccggtgctcgatttagtcgatagtgaagggaaagggcagcgtcactctgttcccgccctcctctcgtagcactctgagcgggctggcaaggcncatag

SEQ ID NO: 258119 - DNA, 125 bp, Homo sapiens; identical to SEQ ID NO: 258115
  misc_feature: GYAE6OF02FPDG6.51.68.G02.1.454.CMB.1.raw
  modified_base (118)..(125): a, c, t, g, unknown or other
  misc_feature (118)..(125): n is a, c, g, or t

SEQ ID NO: 258120 - DNA, 487 bp, Homo sapiens
  misc_feature: GYAE6OF01CX1QY.34.88.H11.1.454.CMB.1.raw
tcagtacacgtgatcacgaccggtgctcgatttagcgacagcgagaacacacaaaggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaagagtcaccctctcctgcagggccagccagagtgttagcagcaacttggcctggtaccagcagaaacctggccaggctcccaggctcctcatctatggtgcatccaccagggccactggtatcccagccaggttcagtggcagtgggtctgggacagagttcactctcaccatcagcagtctgcagtctgaagtattttgctagtttatactgtcagcactataatagtgcctcgatcaccttcggccaagggcagactggagattaaacgactagtggctgcac

SEQ ID NO: 258121 - DNA, 521 bp, Homo sapiens
  misc_feature: GYAE6OF01CGYSC.34.88.H11.1.454.CMB.1.raw
  modified_base (204)..(204): a, c, t, g, unknown or other
  misc_feature (204)..(204): n is a, c, g, or t
  modified_base (396)..(396): a, c, t, g, unknown or other
  misc_feature (396)..(396): n is a, c, g, or t
tcagtacacgtgatcacgaccggtgctcgatttagcgacagcgagaacacacaaaggggagaactgctcagttaggacccagacggaaccatggaagccccagcgcagcttctcttcctcctgctactctggctccagataccactggagaaatagtgatgacgcagtctccagccaccgtgtctgtgtctaccgaggggaaangtcaccctctcctgcagggccagccagagtgttagcagcaacttggcctggtaccagcagaaacctggccaggctccaggcctcctcatctatggtgcatccacagggcctatggtactcccagccaggttcagtggcagtgggtctgggacagaattcactctcaccatcagcagcctgcagtctgaagtnttttgctagtttatactgtcagctagtataatacgtgccgtacgggacttcggaccgtaagggacctaaggtcggtaattacgaaaacgacgttggtacggacgttacggacaacctgtcttacg

SEQ ID NO: 258122 - DNA, 570 bp, Homo sapiens
  misc_feature: GYAE6OF01EH9HB.34.88.H11.1.454.CMB.1.raw
  modified_base (205)..(205): a, c, t, g, unknown or other
  misc_feature (205)..(205): n is a, c, g, or t
  modified_base (303)..(303): a, c, t, g, unknown or other
  misc_feature (303)..(303): n is a, c, g, or t
  modified_base (411)..(411): a, c, t, g, unknown or other
  misc_feature (411)..(411): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaangtcaccctctcctgcagggccagccagagtgtagcagcaacttggcctggtaccagcagaaacctggccaggcctcccaggcctcctcatctatggtncactccaccgagggccactggtactcccagcccaggttcaggtggcaggtgggtctggggacaggtaattcactctcaccatcagcagccctgctagtctagaagttntttgactagttttattactgtacagtctaagttataagtaaccgtggacccgttaccggggacgttcggaccgaaacgggtaaccgtaaggggtcgtaaagttaccgaaaacggtacgttgggtacgggtacctacgacccaacctacgtccgttacgg

SEQ ID NO: 258123 - DNA, 520 bp, Homo sapiens
  misc_feature: GYAE6OF01B7XV4.34.88.H11.1.454.CMB.1.raw
  modified_base (302)..(302): a, c, t, g, unknown or other
  misc_feature (302)..(302): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaagagtcaccctctcctgcagggccagccagagtgttagcagcaacttggcctggtaccagcagaacctggccaggctcccaggctcctcatctatggtncatccacagggccagtggactcccagccaggttcagtgcagtggtctgggacagaattcactctcacatcagcagccctgcagtctagaagtatttgctagtttatactgtacagacagttataataacgtggtccgtaccggggtacgttcggaccgaaagggaccgaagggtacggaaatacgaaacgaacgtgtacggctagacaccagtcgtcg

SEQ ID NO: 258124 - DNA, 550 bp, Homo sapiens
  misc_feature: GYAE6OF01AJC25.34.88.H11.1.454.CMB.1.raw
  modified_base (205)..(205): a, c, t, g, unknown or other
  misc_feature (205)..(205): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaanagtcaccctctcctgcagggccagccagagtgttagcagcaacttggcctggtaccagcagaacctggccaggctcccaggctcctcattaatggtgcatacctacgagggcccactggcactcccagacaggttcagtggacaggtgggtctggggacaggtacttcactcctcaccatcagcagtacttgacgtcctagtaagtatttgactagttatattactgtacagtactaatacgtacgaacgacgctacgtggtcgggtcgttaccggaccgtaacgggaccgtaagggtacggaaagtaccgaaaacgtacgtggtacggtactcggcgacctacg

SEQ ID NO: 258125 - DNA, 525 bp, Homo sapiens
  misc_feature: GYAE6OF01DEQKZ.34.88.H11.1.454.CMB.1.raw
  modified_base (302)..(302): a, c, t, g, unknown or other
  misc_feature (302)..(302): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtcggtgtctccaggggaaagagtcaccctctcctgcagggccagccagagtgttagcagcaacttggcctggtaccagcagaaacctggccaggctccaggctcctcatctatggtncatccaccagggccactggtactcccagccaggttcagtggcagtggtctgggacagaattcactctacaccatcagcagcctgcagtctgaagtattttgctagtttattactgtcagtctagtataataacgtggccgttcggggacgttcggaccgaagggaccgtaagggtaggaacttacgaaacgtaacgtaggtggacgtcgacacactctgtacc

SEQ ID NO: 258126 - DNA, 564 bp, Homo sapiens
  misc_feature: GYAE6OF01BXMX0.34.88.H11.1.454.CMB.1.raw
  modified_base (206)..(206): a, c, t, g, unknown or other
  misc_feature (206)..(206): n is a, c, g, or t
  modified_base (306)..(306): a, c, t, g, unknown or other
  misc_feature (306)..(306): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaangtcaccctctcctgcagggccagccagagtgtagcagcaacttggcctggtaccagcaagaaacctggccaggcctcccgaggcctcctcatctatggtncatccacagggccagtggtactcccagccaggttcagtgcagtgggtctgggacagaattcactctcacatcagcagcctgcagtctagaagtattttgcttagtttattactgtacagactagttaataagttaacgtgggtacccgtacggggaccgttcggaccgaaacggggtaaccgtaagggtacggtaaagttaccgaaaacggtaaccgttggtacgggtaccttacggacccaacctagttccgttacg

SEQ ID NO: 258127 - DNA, 545 bp, Homo sapiens
  misc_feature: GYAE6OF01EA5XI.34.88.H11.1.454.CMB.1.raw
  modified_base (306)..(306): a, c, t, g, unknown or other
  misc_feature (306)..(306): n is a, c, g, or t
  modified_base (434)..(434): a, c, t, g, unknown or other
  misc_feature (434)..(434): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaagaatcaccctctcctgcagggccagtcagagtgttggcagcaacttagcctggtaccagcagaaacctggccaggctcccagacgtcctcatctatgctacnctccacagggccactgctatccagccaggttcaggtggctaggtgggtctgggactagtacgttcacgtctcgaccatcgagcagcctgcagtctgaatcttctgtacttactttatacgtgtcagtntacgttactaagtaggtcggtaccgtggaccgttcggaccgtaaacggggacctaaagggtacggtaaaataccggaaaagtacgtggtacggactacggacctacgtacg

SEQ ID NO: 258128 - DNA, 507 bp, Homo sapiens
  misc_feature: GYAE6OF01ANW1B.34.88.H11.1.454.CMB.1.raw
  modified_base (205)..(205): a, c, t, g, unknown or other
  misc_feature (205)..(205): n is a, c, g, or t
  modified_base (501)..(501): a, c, t, g, unknown or other
  misc_feature (501)..(501): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaanagtcaccctctcctgcagggccagccagagtgttagcagcaacttggcctggtaccagcagaacctggccaggctccaggctctcatctatggtgcatccacagggccactggtactcccagccaggttcagtggcagtggctgggacagaattcactctcaccatcagcagccctgcagtcagagtatttgctagtttatactgtcagctagtataatactggccgtaccgggtacgttcggaccgaacgggacgaacggtggaacttacgaaacgtactgtcggtctagacacngtatcg

SEQ ID NO: 258129 - DNA, 495 bp, Homo sapiens
  misc_feature: GYAE6OF01BA8SR.34.88.H11.1.454.CMB.1.raw
  modified_base (470)..(470): a, c, t, g, unknown or other
  misc_feature (470)..(470): n is a, c, g, or t
  modified_base (487)..(487): a, c, t, g, unknown or other
  misc_feature (487)..(487): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagatactactggagaaatagtgatgacgcagtctccagccaccctgtctgtgtcccccaggggaaagagccatcctctcctgcagggccagtcagagtattagcaccaacttagcctggtaccagcagaaacctggccagactcccaggctcctcatctatggtgcatccaccagggcccactggtatcccaggcaggttcagtggcagtgggtctgggacagagttcactctcaccatcagcagtctgcagtctgaagtatttgctagtttattactgtcagctactataatagtcgctcgatcacgttcgaccaagggcacgatagganacgttaacgactgtagntcgcacta

SEQ ID NO: 258130 - DNA, 511 bp, Homo sapiens
  misc_feature: GYAE6OF01CLLDD.34.88.H11.1.454.CMB.1.raw
  modified_base (205)..(205): a, c, t, g, unknown or other
  misc_feature (205)..(205): n is a, c, g, or t
  modified_base (302)..(302): a, c, t, g, unknown or other
  misc_feature (302)..(302): n is a, c, g, or t
  modified_base (506)..(506): a, c, t, g, unknown or other
  misc_feature (506)..(506): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaangtcaccctctcctgcagggccagccagagtgttagcagcaacttggcctggtaccagcagaaacctggccaggctcccaggctcctcatctatggtncatccaccagggcccacgtggtactcccagccaggttccaggtggcaggtgggtctggggacagaattcactctcaccatcagcagcctgcagtctgaagtatttgcttagttttattactgtcagctagtataatactcggcctccggggacttcggaccgaagggaccgaaggtcgaattacgaacgactgtggctgacacntctcg

SEQ ID NO: 258131 - DNA, 533 bp, Homo sapiens
  misc_feature: GYAE6OF01AZRSH.34.88.H11.1.454.CMB.1.raw
  modified_base (205)..(205): a, c, t, g, unknown or other
  misc_feature (205)..(205): n is a, c, g, or t
  modified_base (301)..(301): a, c, t, g, unknown or other
  misc_feature (301)..(301): n is a, c, g, or t
  modified_base (402)..(402): a, c, t, g, unknown or other
  misc_feature (402)..(402): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaanagtcaccctctcctgcagggccagccagagtgttagcagcaacttggcctggtaccagcagaacctggccaggctccaggctcctcatctatggtncatccaccagggcccacgtggtactcccagccaggttcaggtggcaggtgggtctgggacagtaattcactctcacatcagcagcctgcagtctagaagtntttgctagtttattactgtcagtactagtaataagtaactggacccgttaccggggtacgttccgggaccgtaacgggaccgaagggtcggtaacttacgaaacgtagtggtacgctacgacactgtctcg

SEQ ID NO: 258132 - DNA, 565 bp, Homo sapiens
  misc_feature: GYAE6OF01BI6YJ.34.88.H11.1.454.CMB.1.raw
  modified_base (207)..(207): a, c, t, g, unknown or other
  misc_feature (207)..(207): n is a, c, g, or t
  modified_base (558)..(558): a, c, t, g, unknown or other
  misc_feature (558)..(558): n is a, c, g, or t
tcagtacacgtgatcacgaccggtgctcgatttagcgacagcgagaacacacaaagggggaggaactgctcagttaggacccagacggaaccatggaagcccccagcgcagcttctcttcctcctgctactctggctcccagataccactggagaaatagtgatgacgcagtctccagccaccgtgtctgtgtctccgaggggaaanagtccaccctctcctgcagggccagccagagtgttagcagcaacttggcctggtaccagcagaacctggccaggctcccaggctcctcatctatggtgcactcccaccgagggcccacgtggtactccccgagccgaggttccaggttcggcgtaggtcgggtctggggaacaggtaattccaccttctaccaccatccacgcacgccctgactagttccgtagtaagttattttgacttagtttattactgtcagtctaagtataagtacgtcggtccgtaccgggtacgttcggaccgtaaggaccgtaaggtagtaattacgaaacgtacgtgacggtctgaccactntcgtacg

SEQ ID NO: 258133 - DNA, 531 bp, Homo sapiens
  misc_feature: GYAE6OF01B9JFX.34.88.H11.1.454.CMB.1.raw
  modified_base (205)..(205): a, c, t, g, unknown or other
  misc_feature (205)..(205): n is a, c, g, or t
  modified_base (401)..(401): a, c, t, g, unknown or other
  misc_feature (401)..(401): n is a, c, g, or t
  modified_base (524)..(524): a, c, t, g, unknown or other
  misc_feature (524)..(524): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaanagtcaccctctcctgcagggccagccagagtgttagcagcaacttggcctggtaccagcagaaacctggccaggctccaggctcctcatctatggtgcatccaccagggccactggtactcccagccaggttcaggtggcagtgggtctggggacagaattcactctcaccatcagcagccctgcagtctgaagtnttttgacttagttttattactgtcagtactagttataataacgtggcccgtccggggaccgttcggaccgaacgggaccaagggtcggtaattacgaaacgacgtggtacgtctcgacacctntcgtacg

SEQ ID NO: 258134 - DNA, 529 bp, Homo sapiens
  misc_feature: GYAE6OF01CB5N8.34.88.H11.1.454.CMB.1.raw
  modified_base (205)..(205): a, c, t, g, unknown or other
  misc_feature (205)..(205): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaangtcaccctctcctgcagggccagccagagtgttagcagcaacttggcctggtaccagcagaacctggccaggctccaggctcctcatctatggtgcatccaccaggggccacgtggtactcccagccaggttcaggtggcaggtgggtctgggacagattcactctcaccatcagcagccctgcagtctagaagtatttgcttagtttattactgtactagtactagttataataacgtggtaccgtccggggtacgttcggaccgaacgggaccgtaaggtcggtaagttacgaacgacgtagtggtctagcacctgtcgtcg

SEQ ID NO: 258135 - DNA, 537 bp, Homo sapiens
  misc_feature: GYAE6OF01ECX8D.34.88.H11.1.454.CMB.1.raw
  modified_base (205)..(205): a, c, t, g, unknown or other
  misc_feature (205)..(205): n is a, c, g, or t
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctctcctgcagggccagtcagagtgttggcagcaacttagcctggtaccagcagaaacctggccaggctccagagtcctcatctatgctacactccaccacgggccactcgctattccagcctaggttcagtggctaggtgggtctggggactaggtacgttcactctaccacctatcagcacgcctgctagtctagaagtnttcngtctacttttatactgtacagtctagttactaataggtcggtccgtggtaccgttccggaccgaagggaccgtaagggtaggtaaactacgaaacgacttgggtacgctggccacgtacg

SEQ ID NO: 258136 - DNA, 527 bp, Homo sapiens
  misc_feature: GYAE6OF01C4VHC.34.88.H11.1.454.CMB.1.raw
  modified_base (204)..(204): a, c, t, g, unknown or other
  misc_feature (204)..(204): n is a, c, g, or t
  modified_base (399)..(399): a, c, t, g, unknown or other
  misc_feature (399)..(399): n is a, c, g, or t
  modified_base (521)..(521): a, c, t, g, unknown or other
  misc_feature (521)..(521): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaanagtcaccctctcctgcagggccagccagagtgttagcagcaacttggcctggtaccagcagaacctggccaggctcccaggctcctcatctatggtgcatccaccagggccacgtggtactcccagccaggttccagtggcagtgggctgggacagaattcactctcactatcagcagcctgcagtctagaagtnttttgcttagttttattactgtacagtactaagttaataatacgtcggtccgtcggggtacgttcggaccgaacgggaccgaaggtggtaaattacgaaacgtacgtgtcgtactgacaccntcgtcg

SEQ ID NO: 258137 - DNA, 547 bp, Homo sapiens
  misc_feature: GYAE6OF01EJ8GG.34.88.H11.1.454.CMB.1.raw
  modified_base (205)..(205): a, c, t, g, unknown or other
  misc_feature (205)..(205): n is a, c, g, or t
  modified_base (302)..(302): a, c, t, g, unknown or other
  misc_feature (302)..(302): n is a, c, g, or t
  modified_base (402)..(402): a, c, t, g, unknown or other
  misc_feature (402)..(402): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaanagtcaccctctcctgcagggccagccagagtgttagcagcaacttggcctggtaccagcagaacctggccaggctcccaggctcctcatctatggtncatccacagggccactggtactcccagcccaggttcagtggcaggtgggtctggggacagtaattcactctcaccatcagcagcctgcagtctagaagtnttttgctagtttattactgtcagtctagtataataacgtggacccgtaccgggggtacgttccgggaccgtaacggggtaccgaagggtacggtaattacgaaacggtaacgtaggtacggtctagacctaaccgtattcgtacg

SEQ ID NO: 258138 - DNA, 519 bp, Homo sapiens
  misc_feature: GYAE6OF01B0XEI.34.88.H11.1.454.CMB.1.raw
  modified_base (205)..(205): a, c, t, g, unknown or other
  misc_feature (205)..(205): n is a, c, g, or t
  modified_base (241)..(241): a, c, t, g, unknown or other
  misc_feature (241)..(241): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacacagtctccaggcaccctgtctttgtctccaggggaaangccaccctctcctgcagggccagtcagagtgttaangcatctacttagcctggtaccagcagaaacctggccagcctcccagacctcctcattaatggtgcatactacacgggcccctggcactcccagacaggttcagtggcaggtgggtctggacagacttcactctcaccatcagcagacgtggacgccgtagaagtatttgctagttgttattattgtcagcagctatcattcggtctaccgtactacgtttcggccgagggaccaaggcgtaggacgactacgaaacgtaacgtggtaggctgctaccg

SEQ ID NO: 258139 - DNA, 560 bp, Homo sapiens
  misc_feature: GYAE6OF01DSA04.34.88.H11.1.454.CMB.1.raw
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaagagtcaccctctcctgcagggccagtcagagtgttagcagcaacttggcctggtaccagcagaaacctggccaggctcccaggcctcctcatctatggtgcatccacagggcccactggtactcccagccaggttcagtggcaggtgggtctgggacagaattcactctcaccatcagcagcctgcagtctagaatatttgcttagttttatactgtcagtcaagttataactaacgtcggaccgtccggggtacgttccggaccgtaaacgggaaccgtaaagggtcggtaaatttaccgaaaaccggtaacgttcgggtacggacgttcggacctaaccctagttcgttaccgg

SEQ ID NO: 258140 - DNA, 561 bp, Homo sapiens
  misc_feature: GYAE6OF01CYAVG.34.88.H11.1.454.CMB.1.raw
  modified_base (205)..(205): a, c, t, g, unknown or other
  misc_feature (205)..(205): n is a, c, g, or t
  modified_base (303)..(303): a, c, t, g, unknown or other
  misc_feature (303)..(303): n is a, c, g, or t
  modified_base (347)..(347): a, c, t, g, unknown or other
  misc_feature (347)..(347): n is a, c, g, or t
  modified_base (376)..(376): a, c, t, g, unknown or other
  misc_feature (376)..(376): n is a, c, g, or t
  modified_base (409)..(409): a, c, t, g, unknown or other
  misc_feature (409)..(409): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaangtcaccctctcctgcagggccagccagagtgttagcagcaacttagcctggtaccagcagaaacctggccagcctcccagacctcctcattaatggtncatactacacgggcccctggcactcccagacaggttcagtggcnggtgggtctgggacagtacttcgacttcncaccatccaccagtactggacgtcctagaagtnttttgctagtgtacttactagtacaactagttgtctacacgtaccacggtacggtacggttccggaccgtaaacgggaccgtaaagggtacggaaacgtaacgtaaacgaacgtacggtacggactacgtaccaactatctggttccttacg

SEQ ID NO: 258141 - DNA, 559 bp, Homo sapiens
  misc_feature: GYAE6OF01EGAOO.34.88.H11.1.454.CMB.1.raw
  modified_base (337)..(337): a, c, t, g, unknown or other
  misc_feature (337)..(337): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaagagtccaccctctcctgcagggccagccagagtgttagcagcaacttggcctggtaccagcagaaacctggccaggcctcccgaggcctcctcatcgtagtggtgcactccaccgacgggccacgtggtacncccagcctaggttcagtggctaggtcgggtctgggacagtaattcactctacactatcagcagcctgactagtctagaagttatttgacttagtttattacgtgtacagtactaagttattagtacgttccctccgtacttaccgttacgttacgggacggtaacgggaaccgtaagggtgaagtactaacgaaacgtacgtggtacgaccgtgccgaccta

SEQ ID NO: 258142 - DNA, 564 bp, Homo sapiens
  misc_feature: GYAE6OF01A4OKY.34.88.H11.1.454.CMB.1.raw
  modified_base (206)..(206): a, c, t, g, unknown or other
  misc_feature (206)..(206): n is a, c, g, or t
  modified_base (305)..(305): a, c, t, g, unknown or other
  misc_feature (305)..(305): n is a, c, g, or t
  modified_base (407)..(407): a, c, t, g, unknown or other
  misc_feature (407)..(407): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaanagtcaccctctcctgcagggccagccagagtgttagcagcaacttggcctggtaccagcagaacctggccaggcctcccaggctcctcatctagtggtncatcccacgaggccacgtggtactcccagcccagttcaggtgctaggtgggtctggggacagtaattcactcacacatcagcagcctgcagtctagtaagtntttgacttagtttacttacgtgtacagtactagttactaattaccgtggtaccccggtacggggtaccgttcgggaccgtaaagggacccgtaagggtacggtaattaccgtaaacgacgttggtacggaccgtacgacgtaacctagttcgtccgg

SEQ ID NO: 258143 - DNA, 550 bp, Homo sapiens
  misc_feature: GYAE6OF01AVXG3.34.88.H11.1.454.CMB.1.raw
  modified_base (206)..(206): a, c, t, g, unknown or other
  misc_feature (206)..(206): n is a, c, g, or t
  modified_base (294)..(294): a, c, t, g, unknown or other
  misc_feature (294)..(294): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccacttggagaaatagtgatgacgcagtctccagccaccgtgtctgtgtctccgaggggaanagtcaccctctcctgcagggccagccagagtgttagcagcaacttggcctggtaccagcagaacctggccaggctcccaggctccgtnatctatggtgcatccacgagggccactggtactcccagcccaggttcagtcggcagtgggtctggggacaggtaattcactctcaccatcagcagccctaggctacgtctagaagtattttcgcttagttttatactgtcagtactagtataattacgtcggccgtacgggacgttcggaccgtaagggaccgaagggtcggtaattacgaaaacggtacttggtacggtactcggaccaccgtagttcgttacgg

SEQ ID NO: 258144 - DNA, 544 bp, Homo sapiens
  misc_feature: GYAE6OF01BMFJ9.34.88.H11.1.454.CMB.1.raw
  modified_base (205)..(205): a, c, t, g, unknown or other
  misc_feature (205)..(205): n is a, c, g, or t
  modified_base (302)..(302): a, c, t, g, unknown or other
  misc_feature (302)..(302): n is a, c, g, or t
  modified_base (377)..(377): a, c, t, g, unknown or other
  misc_feature (377)..(377): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaanagtcaccctctcctgcagggccagccagagtgttagcagcaacttggcctggtaccagcagaacctggccaggctcccaggctcctcatctatggtncatccaccgagggccactggtactcccagccaggttcagtggcaggtcggtctgggacagtaattcactctcacntcagcagcctgcagtctagaattatttgacttagttttacttactgtacagtctaagtataacgtacgtggtcccgtacggggaccgttccgggacctaacggggacctaaggggtcgtaattacgaaacgacgttgacggtactacgacctacctagtccgttacg

SEQ ID NO: 258145 - DNA, 602 bp, Homo sapiens
  misc_feature: GYAE6OF01CKU0U.34.88.H11.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (233)..(233): a, c, t, g, unknown or other
  misc_feature (233)..(233): n is a, c, g, or t
  modified_base (260)..(260): a, c, t, g, unknown or other
  misc_feature (260)..(260): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaanagtcaccctntcctgcagggccagccagngtgtagcagcaacttggcctggtaccngcagaacctggccaggctcccaggcctcctnatctatggtncatcccacgacgggcccagtggtaactcccgaaggtcccaggttcaaggtggccgtaggttggggtctggggaacaggtaactttccgaacttctacaccatcacgtcacgccctgacagtctagaacgtattttgacttagtttattactgtactagtctagttaactaagtaacgtcggtaccgtaccggggtacgttccgggaccgtaacgggaccgtaaagggtacggtaagttaaccgtaaaacggtaacgttacggttacggtaccgttacgacccgtaccgtagttcgttaccg

SEQ ID NO: 258146 - DNA, 595 bp, Homo sapiens
  misc_feature: GYAE6OF01EN0GG.34.88.H11.1.454.CMB.1.raw
  modified_base (206)..(206): a, c, t, g, unknown or other
  misc_feature (206)..(206): n is a, c, g, or t
  modified_base (303)..(303): a, c, t, g, unknown or other
  misc_feature (303)..(303): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaanagtcaccctctcctgcagggccagccagagtgttagcagcaacttggcctggtaccagcagaacctggccaggctcccaggctcctcatctatggtncactccaccagggccactggtactcccagcccaggttcaggtgcaggtgggtctgggacagattcactctcacatcagcacgcctgcagttcagtaagtatttgacttagttttacttactgtacagtacgtaagttaataacgttacgttacgggacccgttaccggggggtaccgttccgggaccggtaaacggggtaacccgtaaaggggttacggtaaacgttaaccggaaaaccggtaacgttcgggtacgggtaccgtacggaccctaaccgtagttccgttacgg

SEQ ID NO: 258147 - DNA, 559 bp, Homo sapiens
  misc_feature: GYAE6OF01A2958.34.88.H11.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (553)..(553): a, c, t, g, unknown or other
  misc_feature (553)..(553): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaanatcaccctntcctgcagggccagccagagtgtagcagcaacttggcctggtaccagcagaaacctggccaggcctcccaggcctcctcatctagtggtgccatcccaccgagggcccacgtcgggtactccccgagcccgtaggttccaggtcggcgtaggtgggtctgggacaggtaacttcacgtctacacctagtcagctacgccctgcagtcgtagaagttatttgcttagttttactactgtcagtactagtaataatacgttcggccgtcgggtacgttcggaccgtaacgggacgtaagggtcgtaattacgaaacgtacgtgtaggtctagaccacgtntcgtcg

SEQ ID NO: 258148 - DNA, 581 bp, Homo sapiens
  misc_feature: GYAE6OF01EVV37.34.88.H11.1.454.CMB.1.raw
  modified_base (207)..(207): a, c, t, g, unknown or other
  misc_feature (207)..(207): n is a, c, g, or t
  modified_base (304)..(304): a, c, t, g, unknown or other
  misc_feature (304)..(304): n is a, c, g, or t
  modified_base (444)..(444): a, c, t, g, unknown or other
  misc_feature (444)..(444): n is a, c, g, or t
  modified_base (575)..(575): a, c, t, g, unknown or other
  misc_feature (575)..(575): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaagngtcaccctctcctgcagggccagccagagtgtagcagcaacttggcctggtaccagcaagaacctggccaggcctccaggcctctcatctagtggtncatccacgagggccacgtggtactcccagccctaggttccaggtggctagggttcgggtctaggggaactaggtaactttccacgttcctaccgtacctagtaccagcctacgtcccgtgctaggttcctagtaacgttnttttgacttaagttttacttacgtgtacagtctaagttataagtacgtcggtaccgtcggggtacgttccggaccgtaacgggaccgtaaggtcgtaacttacgaaacgtacgtgacgtctagacaccgtntcgtcg

SEQ ID NO: 258149 - DNA, 587 bp, Homo sapiens
  misc_feature: GYAE6OF01CUFWC.34.88.H11.1.454.CMB.1.raw
  modified_base (205)..(205): a, c, t, g, unknown or other
  misc_feature (205)..(205): n is a, c, g, or t
  modified_base (305)..(305): a, c, t, g, unknown or other
  misc_feature (305)..(305): n is a, c, g, or t
  modified_base (309)..(309): a, c, t, g, unknown or other
  misc_feature (309)..(309): n is a, c, g, or t
  modified_base (427)..(427): a, c, t, g, unknown or other
  misc_feature (427)..(427): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctcgaggggaaanagtccaccctctcctgcagggccagccagagtgttagcagcaacttggccctaggtaccagcaagaaacctggccaggcctcccaggcctcctcatctanggtncactccacgagggccagtcggtactcccagccgtaggttcaggtcggctaggtgggtctaggggacaggtaacttccacgtcctacacctatcagcacgcctgctagtctagaagttntttgacttagtttatacttgctaagtctaagtaactaagtacgtcgggtcccgtcgggggtaaccgtaccgggaccgtaaacggggtaccgtaaagggtacggtaacgttaaccgtaaaacggtacgtggttacggcgtacgacctaacgtgttcgtacg

SEQ ID NO: 258150 - DNA, 672 bp, Homo sapiens
  misc_feature: GYAE6OF01BMV9F.34.88.H11.1.454.CMB.1.raw
tcagtacacgtgatcacgaccggtgctcgattttagcgacagcgagaacgacacgaaagggggaggaactcgcctcgtacgttagggaccctagacggaacctagtggaagccccagcgcagcttctcttcctctgctactctggcttcccgagataccacttgggtagtaaattagtgatttaggacgcagtctcagccaccgtgtctggtgtctccgagggggaagcgtcaccctctccgtggccagggccagcccaggtagtgttacgcacgctaacgttcggacccttaggttaccaggtctaagaaccgtggaccagggcctacccgaggtcctcccgtcgacttcgtaggtcgggtcactaactcccgacggacgggtaccctacggttaggtactacccgagtcccgtaggttacagtggactaggttgggtcagggaactagtacttcgaacgtctacgaccactaccacgacgtacgtaggaacgtaccgtagaacgttagtttcgacgttaggttagtttacttacgttagtacgtaacgtaggttacgttctacgacgtacgtacggtacggtaccggtcggacgtaagggacgtaaggttagaacgtacgaaacggtacgtagggtcgacgttacggaccgtagtcgttcggtcgtaccg

SEQ ID NO: 258151 - DNA, 529 bp, Homo sapiens
  misc_feature: GYAE6OF01DUYET.34.88.H11.1.454.CMB.1.raw
  modified_base (204)..(204): a, c, t, g, unknown or other
  misc_feature (204)..(204): n is a, c, g, or t
  modified_base (301)..(301): a, c, t, g, unknown or other
  misc_feature (301)..(301): n is a, c, g, or t
  modified_base (409)..(409): a, c, t, g, unknown or other
  misc_feature (409)..(409): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaanagtcaccctctcctgcagggccagccagagtgttagcagcaacttggcctggtaccagcagaacctggccaggctcccaggctcctcatctatggtncatccaccgagggccacgtggtactcccagcccaggttccaggtcggctaggtgggtctggggacagaattcactctcaccatcagcacgcctgcagtctagtaagtnttttgcttagttttattacgtgtcagtcaagtataatacgtggccgtcggggacttcggaccgaaggaccgaaggtacggtaattacgaaacgacgtgtaggtctacgaccactgtctcg

SEQ ID NO: 258152 - DNA, 585 bp, Homo sapiens
  misc_feature: GYAE6OF01CUSCE.34.88.H11.1.454.CMB.1.raw
  modified_base (205)..(205): a, c, t, g, unknown or other
  misc_feature (205)..(205): n is a, c, g, or t
  modified_base (400)..(400): a, c, t, g, unknown or other
  misc_feature (400)..(400): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaanagtcaccctctcctgcagggccagccagagtgttagcagcaacttggcctggtaccagcagaaacctggccaggctcccaggctcctcatctatggtgcatccaccagggccactggtatcccagccaggttcagtggcaggtcgggtctgggacagaattcactctcaccatcagcagcctgcagtctgaagtnttttgcttagtttatactgtcagtcagttaataacgttaacgtcgggtacccgtccgggggtaaccgttaccgggacccggtaaacggggtacccgtaaaggggtacggtaaactttaaccggaaaaaccggtaacgttagggttacgggtaccgttacggacctaacccagtttccgttaccgg

SEQ ID NO: 258153 - DNA, 618 bp, Homo sapiens
  misc_feature: GYAE6OF01D7R53.34.88.H11.1.454.CMB.1.raw
  modified_base (208)..(208): a, c, t, g, unknown or other
  misc_feature (208)..(208): n is a, c, g, or t
  modified_base (305)..(305): a, c, t, g, unknown or other
  misc_feature (305)..(305): n is a, c, g, or t
  modified_base (389)..(389): a, c, t, g, unknown or other
  misc_feature (389)..(389): n is a, c, g, or t
  modified_base (421)..(421): a, c, t, g, unknown or other
  misc_feature (421)..(421): n is a, c, g, or t
tcagtacacgtgatcacgaccggtgctcgatttagcgacagcgagaacacgacaaagggggaggaactgctcagttaggacccagacggaaccatcggaagccccagcgcagcttctcttcctcctgctactctggctcccagataccactggagaaatagtgatgacgcagtctccagccaccgtgtctgtgtctccagggggaaangtccaccctctcctgcagggacagccagagtgttagcagcaacttggcctggtaccagcagaacctggccaggctcccaggctcctcatctatggtncactccaccgagggcccacgtcggtactcccgagcccagggttcaggtcggctaggtcgggtctgggacagtaacttcacttcncacatcagcacgcctgactagtctagaagttntttgacttagtttacttacgtgtacacgtactaagttaactaaacgttaaccgttcgggtacccggttacccgggggtacgtttaccgggaacccgtaaacggggtaacccgtaaggggttacggtaaacgtttaaccggaaaaccggtaacggttcgggtacggtaccgtacggaccctaacctcgttcgttaccg

SEQ ID NO: 258154 - DNA, 558 bp, Homo sapiens
  misc_feature: GYAE6OF01CD0FC.34.88.H11.1.454.CMB.1.raw
  modified_base (408)..(408): a, c, t, g, unknown or other
  misc_feature (408)..(408): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaagagtcaccctctcctgcagggccagccagagtgttagcagcaacttggcctggtaccagcagaaacctggccaggctcccagacctcctcatctatggtgcatccacagggccactggtactcccagccaggttcaggtggctaggtgggtctggggacagtaattcactctacaccatcagcagcctgcagtctagaacgttntttgcttagttttatactgtacagtctaagttataatacgtcggtacccgttcggggtacgttccgggaccgaaacgggtaccgtaaagggtcggtaaattaccggaaacgtacgttggtacggtctacggacctacgtcgttcgttacg

SEQ ID NO: 258155 - DNA, 540 bp, Homo sapiens
  misc_feature: GYAE6OF01AGFLP.34.88.H11.1.454.CMB.1.raw
  modified_base (292)..(292): a, c, t, g, unknown or other
  misc_feature (292)..(292): n is a, c, g, or t
  modified_base (304)..(304): a, c, t, g, unknown or other
  misc_feature (304)..(304): n is a, c, g, or t
  modified_base (385)..(385): a, c, t, g, unknown or other
  misc_feature (385)..(385): n is a, c, g, or t
  modified_base (403)..(403): a, c, t, g, unknown or other
  misc_feature (403)..(403): n is a, c, g, or t
  modified_base (425)..(425): a, c, t, g, unknown or other
  misc_feature (425)..(425): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaagagtcaccctctcctgcagggccagccagagtgttagcagcaacttggcctggtaccagcagaacctggccaggctcccaggcctccncatctatgggtncactcccaccgagggcccactggtactcccagccctaggttcagtggcaggtgggctgggactaggattcgactctcaccntcagcacgcctgcagtcngagtatttgcttagttacttangttacagtctagtataatactcggaccgttcgggacgttcggacgaacgggaccgtaaggtcggtaattaccgaaacgaacgttgtaccggacgtacgacctacgtattcgtacg

SEQ ID NO: 258156 - DNA, 602 bp, Homo sapiens
  misc_feature: GYAE6OF01BW7ER.34.88.H11.1.454.CMB.1.raw
  modified_base (206)..(206): a, c, t, g, unknown or other
  misc_feature (206)..(206): n is a, c, g, or t
  modified_base (401)..(401): a, c, t, g, unknown or other
  misc_feature (401)..(401): n is a, c, g, or t
  modified_base (433)..(433): a, c, t, g, unknown or other
  misc_feature (433)..(433): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaanagtccaccctctcctgcagggccagccagagtgttagcagcaacttggcctggtaccagcagaacctggccaggctcccgaggcctcctcatctagtggtcgactactcccgacgacgggcccacgtggtactcccgagccgtaggttcaggtggctaggtgggtctaggggacaggtaacttcacttcacaccntcacgctagcctagactagtctacgtaagttnttttgaccttaggttttacttacgtgtacagtacgtaagttaataagtaaccgtcgggacccgttaccggggtacgttcggaacccgtaacgggtaaccgtaagggtacggtaattaccgaaaacggtacgttaggacggtacctacgaccgtaccttagttcgtacgg

SEQ ID NO: 258157 - DNA, 682 bp, Homo sapiens
  misc_feature: GYAE6OF01CEMJL.34.88.H11.1.454.CMB.1.raw
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (318)..(318): a, c, t, g, unknown or other
  misc_feature (318)..(318): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaangtccaccctntcctgcagggccagccagagtgtagcagcaacttggcctggtaccagcaagaacctggccaggctcccgaggcctcctcatctagtggtcgctatcccacgngggtccacgtggtacctcccgaggtcccgtaggtttccaggttcggactagggttcgggtctacgggggaacaggtaaactttccgaaccgttccgtaccaacccgtagtaccgaacggtacctaacggtcccgttacgccgtaacgttaccgtaggtaaacgttagttttacggactttaggttttaacttacgttagtactaaggtccttaagttacgttaaagttaccgttcggtacccggttaccgggggtaaccgttacgggaacccgtaaacggggaacccgtaaggggttacggtaaacgttacgaaacggtaacgtcggttacgtaccgtacggaccgtacctacgttcgttaccg

SEQ ID NO: 258158 - DNA, 630 bp, Homo sapiens
  misc_feature: GYAE6OF01BH3NI.34.88.H11.1.454.CMB.1.raw
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccaccggagaaattgtgttgacgcagtctccagccaccctgtctttgtctccaggggacagagccacctctcctgcgggccagtcagagtattagtagcttacttctagcctggtatcagcagaacctggcctggccgccaggcctcctcatctataatgcctatagcagggccactcggctccagactaggtcagtcggcaggtgggtctgggcaggtactcacgtctcaccgtatcacgcgagacgtggacgtccgtagaacgttatttacgtacgtagttagtttaactttagtttacgtacgtagtactagactacgtacctacggttacccggttaccgtaacccgtttacgttaccggtttttcgggacccggtaacgggggtaaccgtaaaccggtcggttacgggaacggttaccgtaaaccggtaaaaccggtaacggtttacggtacggtacggttaccgaccgtacccgttaacg

SEQ ID NO: 258159 - DNA, 590 bp, Homo sapiens
  misc_feature: GYAE6OF01D2UUG.34.88.H11.1.454.CMB.1.raw
  modified_base (448)..(448): a, c, t, g, unknown or other
  misc_feature (448)..(448): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaagaatccaccctctcctgcagggccagccagagtgttagcagctaacgttcggcctggtaccagaccaagaaacctggccacggcctcccgaggcctcctcatctagtggtcgctactcccacgacgggccctacgtcggtactcccgacgcctaggttcaggtcggcgtagggtcgggtacgtgggactaggtaacttccactctccaacctatcagcacgtcctgactagtctagtaagttntttgacttagttttatctgtacagtactaattaagtaagttaacggtcgtaccctacggtactccgtaccgttcggaacccgtaagggacctacggagtacggaataacgttaaacgtcgttaggacgcgtagccctaaccg

SEQ ID NO: 258160 - DNA, 547 bp, Homo sapiens
  misc_feature: GYAE6OF01BTKQZ.34.88.H11.1.454.CMB.1.raw
  modified_base (204)..(204): a, c, t, g, unknown or other
  misc_feature (204)..(204): n is a, c, g, or t
  modified_base (540)..(540): a, c, t, g, unknown or other
  misc_feature (540)..(540): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaanagccaccctctcctgcagggccagtcagagtgttggcagcaacttagcctggtaccagcagaacctggccaggcctccagcgtcctcatctatcgactacatccacagggcccactgcttactccagccaggttcagtggctaggtggtcgtgggactagacgttcactctacaccatcgagcagcctgctagtctagaagtattctgtcttactttattactgtactagtcctagttacttaagtaggtcgtacgtgggtaccgttcggaccggtaaacgggaccgtaagggtacggtaaacgtaccgaaacggtacgtggtacggactcgaccnccgtacg

SEQ ID NO: 258161 - DNA, 634 bp, Homo sapiens
  misc_feature: GYAE6OF01DY39E.34.88.H11.1.454.CMB.1.raw
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
  modified_base (310)..(310): a, c, t, g, unknown or other
  misc_feature (310)..(310): n is a, c, g, or t
  modified_base (500)..(500): a, c, t, g, unknown or other
  misc_feature (500)..(500): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaatagtgatgacgcagtctccagccaccgtgtctgtcgtctccgaggggaaangtccacccctntcctgcagggccagccagagtgttagcagcaacttggcctggtaccagcaagaacctggaccaggcctccgaggcctacctcatctatggtcnctactcccgaacagggccctaacgtcggtactccccaggtcccagggtttaccagggtcggtccaagggttcggggtacctagggggaacctaggttaaacttccaaacttccgttcaaccgactaccaggcacggccctaggacctagtcgtaagaagttgtttacgtacttaagttttaacttacgtnttacgagtactagttaataaacgtacgtcgggtacccgtaccggggacttcgggaaccgtaacgggaaccggtaaggtcgtaaagttaacgaaccgtaacgttgtacggctaggacctacgtagttcgttaccg

SEQ ID NO: 258162 - DNA, 703 bp, Homo sapiens
  misc_feature: GYAE6OF01DKP45.34.88.H11.1.454.CMB.1.raw
  modified_base (297)..(297): a, c, t, g, unknown or other
  misc_feature (297)..(297): n is a, c, g, or t
  modified_base (354)..(354): a, c, t, g, unknown or other
  misc_feature (354)..(354): n is a, c, g, or t
  modified_base (693)..(693): a, c, t, g, unknown or other
  misc_feature (693)..(693): n is a, c, g, or t
tcagtacacgtgatcacgaccggtgctcgatttagcgacagcgagaacgacacgaaagggggaggaactgctcagttaggacccagacggaaccatggaacgcccagcgcagcttctcttcctcctgctactctggctaccgagataccactggaagaaatgtgatgacgctagtcctcagccacgtgtctgtcgtactcgaaggggaaatcgtccaccctctcgtgcgacgggccaaggcctaggtagtgttaggctaacgctaacgttcggcctggtaaccagacaacgtaaccnggaccctaaggcctaccgaggtccttcctacattcagtggtacactaacctccgacncgggtacctacgtcggtactcccgagtccctaggttcaggtccggtacgagggttcgggtactacggggaacaagtaacttccactttccacacctacgtacgacgccgtaacggtccctaggtaccgaagtttcctaagggtaaagttacgttttaggacctttaaggttttacctagtaccggtaataccgggtaactaagttaaacctaacgttaaccgtccgggtaacccggttacgggggaccgtttaacgggaacccggaaacgggtaaccgaaacggggttacgaaacgtttacccgaaagttacgtcggtacgtacgagtacccaaccgtntaaccgttcg

SEQ ID NO: 258163 - DNA, 615 bp, Homo sapiens
  misc_feature: GYAE6OF01DM8GS.34.88.H11.1.454.CMB.1.raw
  modified_base (206)..(206): a, c, t, g, unknown or other
  misc_feature (206)..(206): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (455)..(455): a, c, t, g, unknown or other
  misc_feature (455)..(455): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaangtcaccctctcctgcgagggccagccagagtgtagcagcaattggcctggtaccagcagaacctggccaggctccgaggctcctnatctatggtncactccaccgagggccacgtggtactcccaggccaggttcaggtggcaggtgggtcgtgggactaggtattcgactcctcaccatcgaacgcgacgtccgtgactagtccgtagaagttattttcgactttagttttactactggttacaagtntaagttaattaagtaccggttcggtcccggttaccggggtaccgttacccgggaccgaaacggggtaaccgtaagggttaaccggtaagtttaaccgaaaacgggttaaccgttgggtaacgggtaccgttacggaccgtaacccgttgttccggttacg

SEQ ID NO: 258164 - DNA, 615 bp, Homo sapiens
  misc_feature: GYAE6OF01AZZQL.34.88.H11.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaangtcaccctntcctgcagggccagccagagtgttagcagcaacttggcctgtaccagcagaacctgcaggcctaccgagtcctctcatctagtggtcgctactccaaccgcggcctacgtcggtacctcccgagtaccgtaggtcgaggtcggacgtaggtcgggtcggtacggacacgtaccgttcaccgttcacctacctactaccgaaccgacgtacggtacggacgtaccgtagtaacggttgttttacgacgttagttacgttactttacgtacgtactaaacgttcgttacggtcttacgactacgtacggtacggtaccggtaccgacggtaacggaaccgtaagggtacgaaacgtaacgaacggtacgtaggtcgacgtcgaccactcgttcgtcgttaccg

SEQ ID NO: 258165 - DNA, 623 bp, Homo sapiens
  misc_feature: GYAE6OF01BY1P5.34.88.H11.1.454.CMB.1.raw
  modified_base (432)..(432): a, c, t, g, unknown or other
  misc_feature (432)..(432): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
  modified_base (503)..(503): a, c, t, g, unknown or other
  misc_feature (503)..(503): n is a, c, g, or t
  modified_base (527)..(527): a, c, t, g, unknown or other
  misc_feature (527)..(527): n is a, c, g, or t
  modified_base (598)..(598): a, c, t, g, unknown or other
  misc_feature (598)..(598): n is a, c, g, or t
tcagtacacgtgatcacgaccggtgctcgatttagcgacagcgaggaacacgacaaagggggaggaactgctacagttaggacccagacggaaccatggaacgccccagcgctacgtccttctcttcctcctagctactctggctcccgagactaccgacgtaggagaaatgtagatgacgcagtctccagccacgtgtctgtgtcctacgaaggggaaatcgtaccaccctctccgtgcgaacgggccagaccgtaggtagttgttacgacgagtactaacgttcgggtaccttcggtaaccgagacgaacggaaaccgtcggaccgacggtccctacccgacggtcctacctactacttccgtaagtcggtacgacctaactcccgacggacgggccctagtacggtacctccgacgccgtagtcgaggngcgtaggtggtacgaggacagtacttcgactcacactanacgacnctcgacctgactcgtagtacgtagtntttacgattagttactctagtacngtactagtataagtacgcggtccgacggtacgtcggaacgtacggagtaaggtcgtaatacgaacgtacgngtacggtactcgacgtctgtgtacc

SEQ ID NO: 258166 - DNA, 640 bp, Homo sapiens
  misc_feature: GYAE6OF01AXIW6.34.88.H11.1.454.CMB.1.raw
  modified_base (207)..(207): a, c, t, g, unknown or other
  misc_feature (207)..(207): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccgagggggaaangccaccctctcctgcagggccagtcagagtgtggcagcaacttgcctggtaccagcagaacctggccaggcctcccagacgtcctcatcctatcgactacactccacgtaggcctactgctactccagtcctaggttcagtcggctaggttcgggtcgtggggactaggtacgtttcacgttctacacctaactccgacggtccacgtccctggacctaggttaccgtaggtaaacgttctttcgtacgtacctttaccgttttattaaccgttcgtacgtagtaccgtaagtttaccttaaagttaacggttccgggtaccgttacggggtccgttaccgggaccggtaaacggggtaaccgtaaggggtaacggtaaaactaccggaaacggtaacgttcgggtacggtacgtacggtactaacccggtac

SEQ ID NO: 258167 - DNA, 572 bp, Homo sapiens
  misc_feature: GYAE6OF01A0GQD.34.88.H11.1.454.CMB.1.raw
  modified_base (205)..(205): a, c, t, g, unknown or other
  misc_feature (205)..(205): n is a, c, g, or t
  modified_base (302)..(302): a, c, t, g, unknown or other
  misc_feature (302)..(302): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaangtcaccctctcctgcagggccagccagagtgttagcagcaacttggcctggtaccagcagaacctggccaggctcccaggcctcctcatctatggtncatccacgagggccacgtggtactcccagcctaggttcagtcggcaggtcgggtctggggacaggtaccttcgacttctaccacctactcaccagacgtggacgcctagaagtatttgactagtgtattacgtgtacaacgtacgttgttctacgtacacgtacggtcggtaccgttcggaccgtaacgggaccgtaagggtacggaaacgtacgtaaacggtaaccgtacggtaggacgtacgaccgtaaccgacttccgttggttacc

SEQ ID NO: 258168 - DNA, 595 bp, Homo sapiens
  misc_feature: GYAE6OF01AK1T4.34.88.H11.1.454.CMB.1.raw
  modified_base (206)..(206): a, c, t, g, unknown or other
  misc_feature (206)..(206): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaanagtcaccctctcctgcagggccagccagagtgttagcagcaacttggcctggtaccagcacgaacctggccaggcctcccgaggcctcctcatctagtggtgctactcccaccgagggcccagtggtaactcccgagccgtaggttcaggtcggctagggtcgggtcgtgggacagtaacttcactccacaccatcagcacgtccctgcagtctagtaagttactttgcttaagttttacttactcgttactagtataagttaacttaaagtaccgtcgggtacccggttccggggtaaccgttcggacccggtaaagggtacccgtaagggttacggaacttacggaaacgtacgttggtacggtctacggaccacctagttcgtacg

SEQ ID NO: 258169 - DNA, 669 bp, Homo sapiens
  misc_feature: GYAE6OF01A0NKV.34.88.H11.1.454.CMB.1.raw
  modified_base (206)..(206): a, c, t, g, unknown or other
  misc_feature (206)..(206): n is a, c, g, or t
  modified_base (500)..(500): a, c, t, g, unknown or other
  misc_feature (500)..(500): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaagngtccaccctctcctgcgagggccagccaggtagtgttagcagactaacgttcggcctaggtaccacgacgaacggaaacccgtcggacccgacggtccctccccgacggtcccttcctactacgttcctacgtcggtcgaccgtacgtacccgaccgacggggtaccctacggttacggtacctacccgacgtccgtaggttcgaggttcggacgtagggtcgggtacgtgggtactagtacttcgacgttctacaccataccagcctacgtcctagactagtctagtacgttntttacgactttatttattcgtgtacacgtactagttaactaactacggttccgggtacccggtaccgggtacggttaccggaaccggtaaacgggtaaccgtagggtacggtaaataccggtaaacgtacggttcggtacggtacacggtactaccgtgtttccgtacg

SEQ ID NO: 258170 - DNA, 735 bp, Homo sapiens
  misc_feature: GYAE6OF01EIPFM.34.88.H11.1.454.CMB.1.raw
  modified_base (211)..(211): a, c, t, g, unknown or other
  misc_feature (211)..(211): n is a, c, g, or t
  modified_base (237)..(237): a, c, t, g, unknown or other
  misc_feature (237)..(237): n is a, c, g, or t
tcagtacacgtgatcacgaccggtgctcgatttagcgacagcgagaacacacgaaagggggaggaactgctcagttaggacccagacggaaccatggaagccccagcgcagcttctcttcctcctgctactctggcctcccagataccactggaagaaatagtgatcgacgcagtctccagccctacgtgtctgtgtctcgaagggaaagngtccacctctctgcaggccagccagngtgtagcagctaacgttgaccgtggtaccagaccaagtaacctggacccagccctaccacggaccttcctacgtacgttaagtcggtagtacctaattaacccgtaacggcccgggtccccttagggaccctaacgtaccccgaaggtaccgtaggttccgaaggttcggacgtagggttcgggtacgtggggactaacgtcgttaccgacgttcctacctaacctactacccgaaccgtaacggtacgttacggggactacccggttaaggtaacgtttacgtttccgaacgtaacggtttacgtttaaacgttacgttaaccggtaacccttaagggtaacgttttccgggtaaccttaccgaaccgttacgaccggtttaacggggaccgtttacccgggaaccggtaaacgggtaccgtaaagggtaaacggtaaactacggaaaacgttacggtacggacgttacgacgtaccactagttctacgtccttacg

SEQ ID NO: 258171 - DNA, 808 bp, Homo sapiens
  misc_feature: GYAE6OF01EPQWE.34.88.H11.1.454.CMB.1.raw
  modified_base (203)..(203): a, c, t, g, unknown or other
  misc_feature (203)..(203): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggcctccagataccatggagaaatgtgatgacgcagtctccagccaccgtgtctgtgtctcgaggggaaancgtcaccctctcctgcagggccagccagagtgtagcagcctaattcggccttagggtacccaggccaacggtaaaccctggggaccctaacgggtccccttaccccaagggtcccttacccctcgaactttaccgtaaggttcgggtacgcctaacgttccccgaaccggtacggggcccctacggttacgggttaacctcccccgaaggtacccgttaggggtttaccaagggtcggacgtacgggttcgggggtcctagggggtaaacctaacgttaacgttccctaaccgtttccctaaccgtaaccccgtagttacccacgggtacctacgggtcccgttcggaaccgttaaggttacccgtaggttaaacggtttacttttacggtacgttttaacggtttttaatttacccggttagtaaccgtacggtaacgttaagttaaacgttaaccggttaacggttcggggttaccccgggttaccgggggttacggtttacccgggaaccggtaaacggggtaccgtaaagggtacgttaacggttaaccgtaaacggtaacgttcggtacggtccttacgacccgtactacgttcgtacgg

SEQ ID NO: 258172 - DNA, 589 bp, Homo sapiens
  misc_feature: GYAE6OF01EFKOM.34.88.H11.1.454.CMB.1.raw
  modified_base (304)..(304): a, c, t, g, unknown or other
  misc_feature (304)..(304): n is a, c, g, or t
  modified_base (415)..(415): a, c, t, g, unknown or other
  misc_feature (415)..(415): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaagagtccaccctctcctgcagggccagccagagtgttagcagcaacttggcctggtaccagcaagaacctggccaggctccaggctctcatctagtggtncactccacagggccactggtactcccgagcctaggttcaggtggcaggttgggtctagggacagtaacttcgactctacacctatcagcacgcctgctagtctagtaattntttcgctagtttattactgtacagtcaagttataagtacgtcgggtcccgtaccgggggtaccgttccgggaccgtaaacggggtaacccgtaaaggggttacggtaaatttaccggaaaacggtacgtcggttaacgggtctacggacccgtaacccgttagtccgtttacgg

SEQ ID NO: 258173 - DNA, 699 bp, Homo sapiens
  misc_feature: GYAE6OF01BK8OF.34.88.H11.1.454.CMB.1.raw
  modified_base (208)..(208): a, c, t, g, unknown or other
  misc_feature (208)..(208): n is a, c, g, or t
  modified_base (299)..(299): a, c, t, g, unknown or other
  misc_feature (299)..(299): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtcctccgaaggggaaancgtccaccctctctgcagggccagccagagtgtagcagcaacgttcggcctggtaccagccaagaaccgtggccaggcctaccagcgtccntatcgtatcgactacgtactcccgaccgacggccctacgtcgaccttacgtccacgtccgtaggttcaggtcggacgtagggttcggtcgtacgggaactaggtaccgtttaccaccttcctaccgtacctacgtccgaacggtccgacgtcccgtacgtaccgtacggttacgtaaggtaacgttacgtttaccgtaccgttacctttaacgttttaaccgttcgttacgtaccgtacgtaccgttacgttaacgttaacggttaacggttccgggtaccgggtacggtaccgggttaccgggaacccggtaaacgggtaaccggtaacgggtaacggtaaacgtacccggtaaaacggtacggttacgggtacggacccgtcggacccgtacgtaccg

SEQ ID NO: 258174 - DNA, 604 bp, Homo sapiens
  misc_feature: GYAE6OF01DOS8A.34.88.H11.1.454.CMB.1.raw
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaanagtccaccctntcctgcaggccagccagagtgtagcagcaattggcctggtaccagcaagaacctggccacggctcccgaggcctcctcatctagtggtgccatcccgaccgagggcccacgtggtactccccgagtcccgtagggttcagtggctagggtcgggtcgtaggggacaggtaactttccgacttcctacaacctactcgaacgtcaacgtcctgctagtcctagtaagttattttgactttaagtttacttacgtgtactaagtctaaggttactaagtaggtcgtaccggtggtaccggttaccggaccgaagggtaaccgtaaagggtaacggtaaataaccggtaaacgtaacgtggtacggtccttacgaccaactgttcgtacg

SEQ ID NO: 258175 - DNA, 791 bp, Homo sapiens
  misc_feature: GYAE6OF01CNG85.34.88.H11.1.454.CMB.1.raw
tcagtacacgtgatcacgaccggtgctcgatttagcgacagcgagaacacacaaagggggaggaactgctcagttaggacccagacggaaccatggaagccccagcgcagcttctcttcctcctgctactctggctcccagactaccactggagaaatagtgatgacgcagtctccagccaccgtgtctgtcgtctccgaaggggaagacgtccaccctctcctgcgacgggccagccaggtagtgtagcagctaacgttggccctggtaccgagacgaaacggtaaaccgtcggccgaacggccctccccgacggtcccttcctctaattccgtagttcggtcacctacgtacccgaaccgtacgggccctacgtacggtaacctcccgaacggtcccgaagggtttccgaagggtcggtacggtacgggttggggtaccgtagggggtaacctaaggttaacttcccgtaccgttaccctacaaccctacgtaccgaaccggtcgaaccggtccttacggacgtaacggtttccgtaaggtaacgtttacggtttacgtacgttttaacgttttaacgttacgtttaccgtacgtaaacggtaacttaacggttaaacttaacgttacccggtacgggttaccccggggttacggggtacccggttaccgggaaccggtaaaccggggtacggtaaacgggttaacggtaaacgttaaccggaaaaccggttacggtaccgggttacgtacccggtacgaccccgttaacgttcgtttaccgttacccg

SEQ ID NO: 258176 - DNA, 548 bp, Homo sapiens
  misc_feature: GYAE6OF01DNRHW.34.88.H11.1.454.CMB.1.raw
  modified_base (307)..(307): a, c, t, g, unknown or other
  misc_feature (307)..(307): n is a, c, g, or t
  modified_base (410)..(410): a, c, t, g, unknown or other
  misc_feature (410)..(410): n is a, c, g, or t
  modified_base (541)..(541): a, c, t, g, unknown or other
  misc_feature (541)..(541): n is a, c, g, or t
tcagtacacgtgatcacgaccggtgctcgatttagcgacagcgagaacacacaaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaagagtccaccctctcctgcagggccagccagagtgttagcagcaacttggcctggtaccagcaagaaacctggccaggcctcccaggctcctcatctagtggngcatccaccgagggccacgtggtactcccaagcctaggttcagtgcaggtgggtctgggacagaattcactctcacctatcagcagctgcagtctagaagttntttgcttagttttattagtcgtcaagtctagttaataatacgtggtacccgttccgggggattcccggacgaagggaccgtaagggtacgtaattacgaaacgtaacgtggtacggtctacgaccaacctntcgttac

SEQ ID NO: 258177 - DNA, 675 bp, Homo sapiens
  misc_feature: GYAE6OF01DCK59.34.88.H11.1.454.CMB.1.raw
  modified_base (207)..(207): a, c, t, g, unknown or other
  misc_feature (207)..(207): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaagngtccaccctctcctgcagggccagccaggagtgttagcagcaacttggcctaggtaccagcagaacctggccaggcctcccgaggctcctcatctagtggtgcactccaccgagggccacgtcggtactcccgagtccagggttcaggtcggcgtaggtggggtctagggggactaggtaacttccgtacctaccgtcccaacctatacccgaacggctaacgcccttcggaccgtaagttccgttaggtaaacggtttattttacgcgtttaagtttttattaccgttgtaacgtaagtccgtaagtttaacgttaacgttaacgttccggggtacccggtaccgggggtaccgtttacccggggaccgtaaacggggtaccgtaaggggttaaacggtaacgtttaacgaaaccgggtaacgttcgggtacggtccgttacgaccttaacctcgttcgtttaccgg

SEQ ID NO: 258178 - DNA, 144 bp, Homo sapiens
  misc_feature: GYAE6OF01DYY13.34.88.H11.1.454.CMB.1.raw
  modified_base (144)..(144): a, c, t, g, unknown or other
  misc_feature (144)..(144): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctccagactn

SEQ ID NO: 258179 - DNA, 690 bp, Homo sapiens
  misc_feature: GYAE6OF01B9CHN.34.88.H11.1.454.CMB.1.raw
  modified_base (207)..(207): a, c, t, g, unknown or other
  misc_feature (207)..(207): n is a, c, g, or t
tcagtacacgtgatcacgaccggtgctcgatttagcgacagcgagaacacacaaaggggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaancgcccaccctctcctgcgagggccagtcagagtgtggcagcaacttagccgtggtaccagcaagaacctggccaggcctccgagcgtcctcatctatcgactacactacccgacgagggccctacgtcgaccttacgtcccagtaccgtagggtttccacggttggccgtaagggtcgggtacgtggggactaggtacgtttccaaccgttccttaccaacccgtattaccgaacggtaccaaccggtcccgttagacccgtaggttaccgtaaggtaaacgtactttccgtacgttaccttaactttttataccgttacgtaccgtagtacgttaacgttacgttaaagttacggtcgggtaccggttacggggtacccggttaccggaaccggtaaaggggtaccctaaaggggttaacggtaaacctaaccggaaaacggtaacgttggtacggaaccgttacgacccgtaaccgtaacg

SEQ ID NO: 258180 - DNA, 691 bp, Homo sapiens
  misc_feature: GYAE6OF01AFO7V.34.88.H11.1.454.CMB.1.raw
  modified_base (206)..(206): a, c, t, g, unknown or other
  misc_feature (206)..(206): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaangtccaccctctcctgccagggccagccagagtgtagcagcaacttggcctggtaccagcaagaacctggcccaggcctcccgaggcctccgtcattcgtttggcgccgtaccaccgagggcccacgtggccacgtcccgaggacctaggttcaggtggcgaggttcgggtcgtgggactagtaccttcgacctcgtaccacctatccgagaccgtagtacgttaggacgtccgtaggtaacgttacgttttacgacgttaggttacgttaacgtttaccgtgtttaaccgtaacgttacggtttacggttacctaccgtaaccgtaccgttaccgggttacgggtaacccggttacccgggaacccggtaaacggggtaacccgtaaagggggttaaccggtaaaacgtaacccgtaaaacggtaccggttacggtacgggtaccgtacggtaccctaacccgttacgttccgttcggtttaccc

SEQ ID NO: 258181 - DNA, 673 bp, Homo sapiens
  misc_feature: GYAE6OF01CV6XN.34.88.H11.1.454.CMB.1.raw
  modified_base (204)..(204): a, c, t, g, unknown or other
  misc_feature (204)..(204): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctcgaggggaanagtccaccctctcctgcagggccagccagtagtgtagcagcaattggcctaggtaccagacgaacgaaaccctgggaccacgggtcctaccccgaggtcctccctactaactcttacgtggtacgacctacgtacccaaccgaacggggtcccctaaccggttacgggtacctccccgaagtcccgtaagggtttccaagggttcggacgtagggttcggggtacgtacggggactaggaaactttcctaacgtccgtacaaccgtatccgaagacacggtccctgactaagttcctagtaacgttagttttcgactttaagttttacgtactgtacgaagtactaagtaacgtaataccgtcgggtacccgtcggggtacgttaccggacggaaacgggtaccgtaagggtaacgtaacttaacggaaacgtagtacggtacgtccgtacgataaccgtgtcgttacg

SEQ ID NO: 258182 - DNA, 791 bp, Homo sapiens
  misc_feature: GYAE6OF01BVSUX.34.88.H11.1.454.CMB.1.raw
tcagtacacgtgatcacgaccggtgctcgatttagcgacagcgagaacacacaaagggggaggaactgctcagttaggacccagacggaaccatggaagccccagcgcagcttctcttcctcctgctactctggcctcccagactaccactggagaaatagtgatgacgcagtctccagccaccgtgtctgtcgtctccgagggaagcgtccacctctccgtgcgacggccacgccaggagtgtagcagacacgttcggccgtggtaccagacaacgaaaccgtcggaccgacggcctaccccgaggtccctccgtacacttcgtagtggtcgactactaccgtaccgaccgggtcccctggacctaccgtacccgaaggtaaccgtacggttaccgagggttcggacgtacggggttcggggtaccggtacggggacctacggttacctttaccgaccttcctacccaacctactaccaaccgtaggtaccgtaggaccgtaccgtaaggtaaacgtttcgtttcgaacgtttaggtttagttaacgtttcgtacggtactaacgtaccgttaaagttaccggtaccgaacggtaccggttacgtaaccgggttcggggtacccggggttacccgggttaacccgggaaacccgggtaaaaccggggtaaacccgggttaaaacggggttaaacggtaaaaccgttaaacccgggaaaacccgggttaacggttacgggttaaccgggtacccgttaaacggaccccttaaaccgtcggttttaacccgg

SEQ ID NO: 258183 - DNA, 710 bp, Homo sapiens
  misc_feature: GYAE6OF01C4B09.34.88.H11.1.454.CMB.1.raw
  modified_base (210)..(210): a, c, t, g, unknown or other
  misc_feature (210)..(210): n is a, c, g, or t
  modified_base (244)..(244): a, c, t, g, unknown or other
  misc_feature (244)..(244): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtcgtctaccgaaggggaaacncgtccaaccctctcctaggcacgggccagccagngtgtagcagccaagttcggcctaggtaccagactaaacggaaacctgggcccaacggcctaccgaggcctccctacaacttccgtaagtcgggtacacctacgtaccccaaccgacggggtcccaacggttaggtaacctcccgaagggtccctaagggtttcaagggttcggacgtaagggttcgggtactacggggaactaacggtaactttcgtaacctacgttaccaacctagtaccgaacgtcgaaccgggtccttacggacgtaaggttccgtaaggtaaacgttttgtttacggaccttttaaggtttttactacgttagttacctaggtaaccttaagtaagttaacgtaacggtcggtacccgtacggggtacgttaccggacgaaacgggtaccgaagggttacgaacttaacgaaaacggtcgtaggtacgacgtacgaccactagtcgttaacg

SEQ ID NO: 258184 - DNA, 729 bp, Homo sapiens
  misc_feature: GYAE6OF01CDG91.34.88.H11.1.454.CMB.1.raw
  modified_base (207)..(207): a, c, t, g, unknown or other
  misc_feature (207)..(207): n is a, c, g, or t
tcagtacacgtgatcacgaccggtgctcgatttagcgacagcgagaacacacaaagggggaggaactgctcagttaggacccagacggaaccatggaacgccccagcgcagcttctcttccctcctgctactctggcctcccagataccactggaagaattgtgttgacgcagtcgccagacaccctgtctctgtctcgaggggaanacgccaccctctcctgccgagggtcagtcgacgtcgttacctaaccaccgtacttcttccgcctggtaccagcagacgaccgtggccgaggtcctcccgacggcctcctctacttcgtttggcgtccgtcccaccggacgggccacgtcggaccacctacccgagacgtacggttcaggtcggacgtagggtcgggtacgtacgggacaacggtccttaccacgttcctacccgaacctacgtacgaccggtacgtacgtacgtttacggacgttaccgttagtaagttacgttttcgaccgttaagttactttaacgttacggttacgtacgtactaacgtaacttacgtaccggacggtaaccggtctaacgggttcgggtccgggtaaccgggttcccggaaccggggtaaacgggtaaccggtaaggggtaaaccggtaaacgtaacccggtaaaacggtaccggtttaggtacgggtaccgttacccggaacgtaccccgttagttccggtttaccg

SEQ ID NO: 258185 - DNA, 644 bp, Homo sapiens
  misc_feature: GYAE6OF01EI9F1.34.88.H11.1.454.CMB.1.raw
  modified_base (153)..(153): a, c, t, g, unknown or other
  misc_feature (153)..(153): n is a, c, g, or t
  modified_base (206)..(206): a, c, t, g, unknown or other
  misc_feature (206)..(206): n is a, c, g, or t
  modified_base (235)..(235): a, c, t, g, unknown or other
  misc_feature (235)..(235): n is a, c, g, or t
  modified_base (632)..(632): a, c, t, g, unknown or other
  misc_feature (632)..(632): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactgganaaatgtgatgacgcagtctccagcccaccgtgtctgtgtctccgaggggaaangtccaccctctcctgcagggccagccagngtgtagcagcaacttggcctggtaccagcagaacctggaccaggcctcccgaggcctccgtcacttctagtgggtcgctactcccaccgagggtcccacgtcggtactcccgagccgtaggttcaggtcggctaggtcgggtcgtagggacctagtaacttcaccgttcctacacctataccgacgtccgacggtcccgtcgacgtacgttaccgtaggtaagttagttttcggtacgttaagttttacttacgtgtacagtactagttaataacgtacgtcggtacccggtacccggggtacgttccgggaaccggtaacgggtaccgtaaggggtacgtaaagttaaccgaaaccggttacggttggtacgggtacctacggtacctaaccgttnttcggttaccgg

SEQ ID NO: 258186 - DNA, 746 bp, Homo sapiens
  misc_feature: GYAE6OF01C69RE.34.88.H11.1.454.CMB.1.raw
  modified_base (207)..(207): a, c, t, g, unknown or other
  misc_feature (207)..(207): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtcctcgaggggaaagngtccaccctctcctgcgagggccagccagagtgttagcagccaattcggcctaggtaccagaccaacgaaaccgtcggacccacggcctcccgaacggccttcctacgacttccgttagtcgggtacacctaactcccgaaccgacgggcctacgtacggtacctccccgacgtccgtaagggttccagggttggaccgtagggttcggggtacgtaggggactaagtaacttcgaaccttctacgaacctactccgacgaccgtaacgtccctaggacctaaggttcctaagggtaaacggtttactttttcgggactttaacgttttttaaacgtccggtttacgttactaagggtaaccttaaagttaacgttaaacgttaccggtccgggtaccccggggtttaccggggtaccggtttacccgggaaacccggtaaacgggggtaaccgtaaacggggttaacggtaaactttaaacccggaaaacggtaccgttagggaccgtacgtacgaccctaccttagtccgtttaacg

SEQ ID NO: 258187 - DNA, 711 bp, Homo sapiens
  misc_feature: GYAE6OF01DG76R.34.88.H11.1.454.CMB.1.raw
  modified_base (209)..(209): a, c, t, g, unknown or other
  misc_feature (209)..(209): n is a, c, g, or t
  modified_base (705)..(705): a, c, t, g, unknown or other
  misc_feature (705)..(705): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtcgtcctaccgaggggaaanaatccaccctctccgtcgcgacgggccagccagagtgttacgcagctaacgttcggcccgtggtaaccagtacgaaacggaaacccgtggcccgaacggcctaccccgacggtccctcccctactacttccgtagttcggtcggacctaaccgtccccgaaccgaccggggaccctaaccgtcgtacctttacgttaccccgaggaccccgttacggggtttaccaagggttcggccggtaaggttggggtccgtacgggaacgtagtaccggttccaacgttcccacccgaaccgtagtacccgaacggtaccacgtcccgtaggacttacgggtacctagggtaactttacgtttcgtacgtaccttttaacgttttactaaccggttgtaccacgtacgttaacgtataaacggttacgtcgggtccggtaggtcgggttaccgaggtaacgggacgtaagggtacaagacgaaagtcgtaggtgactcgacncgttac

SEQ ID NO: 258188 - DNA, 853 bp, Homo sapiens
  misc_feature: GYAE6OF01BLFK9.34.88.H11.1.454.CMB.1.raw
tcagtacacgtgatcacgaccggtgctcgatttagcgacagcgagaacacacgaaagggggagaactgctcagttaggacccagacggaaccatggaagccccagcgcagcttctcttcctcctgctactctggctcccagactaccacgtggaagaaatagtgatgacgcagtctccacgccacgtgtctgtcgtcctacggaaggggaaagtcgtccacccttctccgtggaccgacgggccagaccgaggtacggttgtacggccagaccgtaacgttcggaccgttacggaccacgacgaacggaacccgtcggacccgacggtccccgtacccgacggtcccttacccgtactaacgttccgtaacggtcggtaccgacctaaccgtaccccgaaccgggtaaccgggtaccccgtaacgttaccgggtaaccctaccccggtacgtacccggttaacggttcgaacgggtcgggtacgtacggggttcgggttacggtacggggtaactaacggttaacctccgtacctcctaacccgtaacctagtacccggacgtacccgtaccggtcccgtacggtaccgtacggtttacggtaaggttaaacggttttaccgtttaggtaacccttttaaggttttaacttccggttaacggtactaacggtaacgtttaacgttaaacgttaaccggtaaccgggttacccggtaaccccggggttaccgggtaaccggttaacccgggaacgggtaaaccccggggtaagttaacggggtaacttaaaccgtaacggtaaaccggtacgtagggtaccgtaccgtaccgaacgtcctagttcgttaacccg

SEQ ID NO: 258189 - DNA, 565 bp, Homo sapiens
  misc_feature: GYAE6OF01AZC9W.34.88.H11.1.454.CMB.1.raw
  modified_base (205)..(205): a, c, t, g, unknown or other
  misc_feature (205)..(205): n is a, c, g, or t
  modified_base (400)..(400): a, c, t, g, unknown or other
  misc_feature (400)..(400): n is a, c, g, or t
  modified_base (427)..(427): a, c, t, g, unknown or other
  misc_feature (427)..(427): n is a, c, g, or t
  modified_base (556)..(556): a, c, t, g, unknown or other
  misc_feature (556)..(556): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaangtcaccctctcctgcagggccagccagagtgttagcagcaacgttggcctggtaccagcagaacctggaccaggcctcccgaggcctcctcatctagtggtgctactccaccgagggcccacgtcggtactcccgagcccaggttccaggtcggctaggtcgggtcgtaggggacagtaacttcaactcacaccntcagcacgtcctgctagtctagaagtntttgattagtttacttactgtacagtactaagttactaataccgtggtcccgtccgggtacgttccggacgaacgggtaccgaggtacgtaattacggaacgtacgtaggacggtctacgacctacgtntccgttacg

SEQ ID NO: 258190 - DNA, 590 bp, Homo sapiens
  misc_feature: GYAE6OF01BAIFD.34.88.H11.1.454.CMB.1.raw
  modified_base (331)..(331): a, c, t, g, unknown or other
  misc_feature (331)..(331): n is a, c, g, or t
  modified_base (419)..(419): a, c, t, g, unknown or other
  misc_feature (419)..(419): n is a, c, g, or t
  modified_base (432)..(432): a, c, t, g, unknown or other
  misc_feature (432)..(432): n is a, c, g, or t
  modified_base (443)..(443): a, c, t, g, unknown or other
  misc_feature (443)..(443): n is a, c, g, or t
  modified_base (458)..(458): a, c, t, g, unknown or other
  misc_feature (458)..(458): n is a, c, g, or t
  modified_base (576)..(576): a, c, t, g, unknown or other
  misc_feature (576)..(576): n is a, c, g, or t
tcagtacacgtgatcacgaccggtgctcgatttagcgacagcgagaacacacaaaggggggaggaactgctcagttaggacccagacggaaccatggaagccccagcgcagcttctcttcctcctgctactctggctcccagataccactggagaaatagtgatgacgcagtctccagccaccgtgtctgtgtcctccgaggggaaagagtccaccctctcctgcgagggccagccagagtgttagcagctaacgttcggcctcggtaccacggcaacgaaaccgtcggaccgacggcctcccgacggtcctcctacattcgtagtggtcncgtactccaccgacggcctacgtcgtacctcccgacgtccgtaggttcgacggtcggcgtgggtcgggtcgtagggactaagtactcnctctacacatcancactctcgacncgtcgtagtacgttnttcgattagtttatcgtgtacagtactagtaactaacgtcggtccggtaccggttacgggacgtaccggacgtaaacgggtacgaaggtacgtaacgtaacgaagtacgtagcgtacncgacactgtcgtcg

SEQ ID NO: 258191 - DNA, 744 bp, Homo sapiens
  misc_feature: GYAE6OF01BFX5F.34.88.H11.1.454.CMB.1.raw
  modified_base (302)..(302): a, c, t, g, unknown or other
  misc_feature (302)..(302): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtccccaggggaaagagccatcctctcctgcagggccagtcagagtattagctaccaacgttacgcctaggtaccagccaagaaacctcggccacggctcccagcgtccctnactctatcgactacactcccaaccgtacgggccctactgaccttacttacccagcccgtacggttacgacgtcggtacgtaggttcggggtccgtagggggtaccagggtacgttcctaccttctacccgtaaccctactacgacgtaccgaaccggtcccttgacctaggttccgtaaggtaagttacgttaccgtacggtacctttaacgtttttaacgtttaccgttcgtaccgtaacggtacgttaacgtttaacgttaaacggtttaacggtcccgggttaccggtaccgggtttaccggggttaccggaacccgggtaaaacgggggtacccggtaaaaggggtaacgggtaaaaccggtaaacccgtaaaacccggggtaacgtttagggtaccgggttaccggttaaccggacctaacccgtcgtttaccccgg

SEQ ID NO: 258192 - DNA, 698 bp, Homo sapiens
  misc_feature: GYAE6OF01DSH6V.34.88.H11.1.454.CMB.1.raw
  modified_base (436)..(436): a, c, t, g, unknown or other
  misc_feature (436)..(436): n is a, c, g, or t
  modified_base (515)..(515): a, c, t, g, unknown or other
  misc_feature (515)..(515): n is a, c, g, or t
tcagtacacgtgatcacgaccggtgctcgatttagcgacagcgagaacacacaaaagggggaggaactgctcagttaggacccagacggaaccatggaagccccagcgcagcttctcttcctcctgctactctggctcccagataccactggaagaaatagtgatgacgcagtctccagccaccgtgtctgtgtcgtcgaggggaaagacgtccaccctctcctgcgagggccagccagagtgtagcagcaacgttggcctggtaccagacaacgaaacctggacccacggcctccccgaggtcctcctacgacttctacgtcggtcgacctacgtcccgaaccgtacgggacctacgtcggtacctcccgagtcccgtaggttcgaggtcggcgtaggtcgggtcgtaggactagtaacttcgactcaccactanccgagaccacgtccgtgacgtaagtcgtaacgtaagtttacgtttagacctttaaggttttaactacgttgactaagtnttaaaacgttaataaccgttaaccggtcgtcccgggttaccggggtaaccggttaacccggaaccgggtaacgggtaaaccggtaaacggggtttaaacggtaaactttaaacccggaaaaacggttacggttacggggtaccggtacggttaacggacccttaccggtattccgtttaccgg

SEQ ID NO: 258193 - DNA, 991 bp, Homo sapiens
  misc_feature: GYAE6OF01CDVHW.34.88.H11.1.454.CMB.1.raw
tcagtacacgtgatcacgaccggtgctcgatttagcgacagcgagaacacgacgaaagggggaggaactgctcagttaggacccagacggaaccagtggaacgcccagcgcagcttctccttcctcctgctactctggcctcccagactaccactggataaattggtgttgacactagtctccgaggctaccctgttcttgtcgtacgaaggggaagacgcctacctctccgtgcgaggccaggtcgaggtcgtagttaagtcgctacgttctacgttacgaccgttcggtaacccaggaccgtaaacgtaaacccgttcgggacccacggttcccctacccgtaacggtacccttcccgttaacgtaagttttaacggtcgggtacgtacctaacgttaaccggtaacccgggaccggggtccccgttcgggaaccctaacccgttaaccccgaaggtaacggttaaccggggtttacgaacgggggttcgggtaacccggttaaggggttacgggggtaccgttaggggggtaaacccttaacggttaacccgttttcccgaaccgttaccggttacccaaaccccgttaacgtccccgaaccgtaaacggggtaccgttacgggggaactttaccccggtaaaggttaaaccggttttaagttttccggaacttaaggggttttacttaaacgtttttaccgaacgtttaacccggtaaacgtttacggggttttacccgtacgtttaaacccccgaaacgtaacccggggtttaaccgggttaccgggggttaaccccggtttaacccgggggaaccccgggaaaagggggttaaacccgtaaaagggggttttaaaccggaaaaaacgttaaacccgggtaaaacccgggtttacgttaggggttaacccgggtacgttaccccggaaacccgttaccggttcggtttaaacccgtttcgggtttcccttaaacccgggtttcccg

SEQ ID NO: 258194 - DNA, 677 bp, Homo sapiens
  misc_feature: GYAE6OF01CC16O.34.88.H11.1.454.CMB.1.raw
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagtaaattgtgttgacgcagtcgccagacaccctgtctctgtctccgaaggggaaagacgccaccctctcctgcgtagggtcagtcaggtcgttactaacaccgtacttccttccgcctcggtaccagcagacgaccgtggaccgaggcctcccgaggtcctcccttctacgttcgtttgggtccgtcccggtccaaccggacgggccctaacgtcggacctactcccgaagcgtagggttcagggtcggcgtgggttacgggtcgtacggggaactacggtaccttccacgttcctacacctacgtcgagcgacgtacgtacgacgtcgtacgtaagttacgtttgacgtaagttatttaacgtttacgtacgtacgaacgtactaagtactacggaacgtacgtactaggttcggttacgggccggttaccggacggtaacgggaaccggtagggtaacgaaacgtaaccggaaaccggtaccgtaccggaccgtacgaccgtacctacgttcgtcgttacccg

SEQ ID NO: 258195 - DNA, 832 bp, Homo sapiens
  misc_feature: GYAE6OF01CRV2D.34.88.H11.1.454.CMB.1.raw
  modified_base (210)..(210): a, c, t, g, unknown or other
  misc_feature (210)..(210): n is a, c, g, or t
tcagtacacgtgatcacgaccggtgctcgatttagcgacagcgagaacacacaaaaggggggaggaactgctcagttaggacccagacggaaccatggaagccccagcgcagcttctcttcctcctgctactctggctcccagataccactggaagaaatagtgatgacgcagtctccagccaccgtgtctgtgtctccgaaggggaaancgtccaccctctcctgcagggccagccagagtgtagcagcaacttggcctggtaccagcaacgtaaaccgtggaccagggccctaccccgacgggtccttcccgtactacgttaccgtaagtgggtacgcctaacctaccccgaaccgaacgggggacccctaacgtttacgggttaaccctacccccgaacggtccccgttaaggggtttaccgtaacggggttacggggcctaacgggggtttcgggggtacccggttaggggggaacctaaacgggtaaaccttttcccgaaaccgtttcccttaaccgaaacccgtaacgttacccgtaaccggaccgtaaaccggtccccgtacggtaccgttaacgggttacccgttaaggtaaaccggtttagttttttcggaacgttttaacgggtttttaactttaaccgtttaggtaccgtaacgtacgtaaaagtttaaacgttaacgttaaacgggttccgggtaccccgggttaccgggggtaaccgtttccggggaacccggtaaacgggaccgttaaaggggttacggtaaacgttaaccgaaaacggtacgtggtacggtcgtacggaccctaacgcgttcgtacg

SEQ ID NO: 258196 - DNA, 884 bp, Homo sapiens
  misc_feature: GYAE6OF01D11MH.34.88.H11.1.454.CMB.1.raw
  modified_base (206)..(206): a, c, t, g, unknown or other
  misc_feature (206)..(206): n is a, c, g, or t
tcagtacacgtgatcacgaccggtgctcgatttagcgacagcgagaacacacaaagggggaggaactgctcagttaggacccagacggaaccatggaaaccccagcgcagcttctcttcctcctgctactctggctcccagatcgccccggagaaattgtgttgacgcagtcgccagaccaccctgtctctgtctccgaggggaanacgccaccctctcctgcgtagggtcagtcagtcgttactaaccaccgtacttcgttcgcctcggtaccagcgagacgaccgtggccgacggcctcccgacggtcctccgtactacgtttccgtttcgggtccgtccgttacccgaccggtaccgggaccctacgtcggacctaaccgtaccccgaagtaccgtaggttacacggtcggacgtacgggtcgggtacgtacggggaacctacggtaccttacgtaccgttcccgtaaccgaacccgtacgttaccgaaggtacccgtaacggttaccgtttacggaccgttaacccgttaagggtaaacgttttacgttttacggaaaccggtttaacggtttaaactttaaccgttttaccgttacggttaaccgaaacggttaacttaaacgttaacgttaccggaaaccggttaccggtaaccgtttaccggttcggggttacccggggttaaccgggtttacccgggaaacccggggttaaaaccggggtaaaccggttaaaacggggtaaaccggttaaaaacccgttaaaccgggtaaaaacccgggttaacggttacggggttaaccgggtaaccgttaccgggtaaacccctttaaccggttaaccggtttacccgtttcgggttacccttttaaaccccgg

SEQ ID NO: 258197 - DNA, 719 bp, Homo sapiens
  misc_feature: GYAE6OF01AVOOW.34.88.H11.1.454.CMB.1.raw
  modified_base (206)..(206): a, c, t, g, unknown or other
  misc_feature (206)..(206): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccatggagaaatagtgatgacgcagtctccagccaccgtgtctgtgtctccgaaggggaaanagtcacccctctcctgcgagggccagccagtagtgtagcagcaacttggcctggtaccagcaagaacctggccaggcctcccaggcctcctcattctagtggtgacctatccccgaccgaggggtaccctacgttcgggtactccccgaagcccgtaaggttccagggttcggccgtaagggttcggggtacgtaggggaacctaggtaacttcaccttccttaccaacctagtaccgaacgtccgaccgccgttcgaccgtaggttacctagggtaaaagtttcgtttttaagacctttaagtttttaactacgttgtacagtactaaggttaacttaaacgttaaccgtcgggtacccggttaccgggggtaccgttaccgggtacccggaaaggggtaaaccccgtaaagggggttcggtaaaaccgtttaacccggtaaaacggttaccggtacgtttacggggacctttaacccgggaccctaacccggtttagtaccgggtttcccg

SEQ ID NO: 258198 - DNA, 669 bp, Homo sapiens
  misc_feature: GYAE6OF01DBML4.34.88.H11.1.454.CMB.1.raw
  modified_base (660)..(660): a, c, t, g, unknown or other
  misc_feature (660)..(660): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagactaccactggagaaatagtgatgacgcagtctccagccaccgtgtctgtgtctaccgagggaaagactccaccctctcctgcgacgggccagccagtagtgttagcgtagactaacgttcggcccgtaggtacccgagaccgtaacgaaacccgtggacccgacggccctccccgacggtcccttacccgtcctacgttctaaggtcggtgacctacctacccgtaacccggacgggaccctacggtacggtaccctaccgacgtccgtaaggttcacggtcggcgtaggtcgggtacgtacgggactaggtaacttccacttccgtaccaccgtatccgtaagccgaacgtccttgactacgttcgagtaagttactttggactttagtttaactcgtgtactagactaattaacgtaactaccggtcggtaccgttaccggggattacccggacggtaaacgggtacgtaggtaacgaacgtttaccggaaagtcgttgacgtcgacgtcaccgtntcgttaccg

SEQ ID NO: 258199 - DNA, 730 bp, Homo sapiens
  misc_feature: GYAE6OF01DI25M.34.88.H11.1.454.CMB.1.raw
  modified_base (209)..(209): a, c, t, g, unknown or other
  misc_feature (209)..(209): n is a, c, g, or t
  modified_base (350)..(350): a, c, t, g, unknown or other
  misc_feature (350)..(350): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggcctcccagataccactggagaaatagtgatgacgcagtctccagccaccgtgtctgtgtcctccgaaggggaaancgtccaccctctaccgtgcgacgggccagccaggtacgttgttacgcagcctaacgttcggcctacggtaccagaccgaaacgaaccgtcggaccgacggccctacccgaggtccctccgtacagttccgtagtcggtacnctacgtcccgacgacgggacctacgtacggtacctccgagtaccgtaggttcaggtcggacgtagggtcgggtacgtacggggactacggtaacttccaaccgtctaccacgtacgtaccgacgccgtacgtccgtacgtacgtagttccggaagttaacgtttacgtttacggacgttaggtttagtttacgtttacgttacggaacctaggtacctaacgtactaccgttcgtaacggttaccgtaccgttaaacccgttacggtttaccggttacccgggaaccggttaacgggtaacccgaaggttaccggtaaacgggaacttaaccggtaaacggtaaacccgtacggttacgggtaccgtacccggtaaccgg

SEQ ID NO: 258200 - DNA, 714 bp, Homo sapiens
  misc_feature: GYAE6OF01AP65W.34.88.H11.1.454.CMB.1.raw
  modified_base (174)..(174): a, c, t, g, unknown or other
  misc_feature (174)..(174): n is a, c, g, or t
  modified_base (206)..(206): a, c, t, g, unknown or other
  misc_feature (206)..(206): n is a, c, g, or t
  modified_base (240)..(240): a, c, t, g, unknown or other
  misc_feature (240)..(240): n is a, c, g, or t
tcagtacacgtgatcacgaccggtgctcgatttagcgacagcgagaacacacgaaagggggaggaactgctcagttaggacccagacggaaccatggaagccccagcgcagcttctcttcctcctgctactctggctcccagataccactggagaaatagtgatgacgcagtcnccagccacgtgtctgtgtctccgaagggaaangtccacctctctgcgaggccagccagagtgtacncagctaacgtggccctaggtaaccagacgaacgaacccgtggacccaggcctacccgaggcctccgtataattctagtacgtagtacggtaccgtaccgaacgcgggacctacgtggacctaccgtcccgaagtccgtaggttacacggttggacgtagtcggggtcgtacgggaccctaagttacccttcgaccttccgactaaccctacgtaaccaccgtaacgacgttacgggacgtaccgtaagtaacgttacgtttaggacgttaagttagtttaacttaacgtacggttaactaaaccgggttaggttccgtaaccgtaccgtaacgtaacgttacggtacgggtacccgtacggtaaccgaaaccgggtaacgtaacggtaacggtaaaacctaacggtaaacccggtacgttaacggtacgggtacccgttaacggaccccgtaaccgttaggtccggtttaaccg

SEQ ID NO: 258201 - DNA, 757 bp, Homo sapiens
  misc_feature: GYAE6OF01BIPFS.34.88.H11.1.454.CMB.1.raw
  modified_base (311)..(311): a, c, t, g, unknown or other
  misc_feature (311)..(311): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaagagtccaccctctcctgcagggccagccagagtgttagcagctaacttggcctggtaccagcagaacctggaccaggcctcccgaggcctcctcatctagtggtcncactcccacgacgggcctacgtcggtactcccgagcccgtaggttcaggtcggacagggttcgggtcgtagggactagtaactttccaccgttcctacgacctactacgacgtactaacggttacttacggacgtaccgttaggtaacggttacgttttacggaccgttaagttaacgtttaactttacgtacgttaccgtaaggtaacctaaacgtttaacgtaaccgggtaaccgggtaacccgtaccgttaacggttcgggggttacccgggggtttacccgggtttaaccccgggggaaacccgggtaaaaaccgggggtaaaccccgggttaaaagggggttaaccgggtaaaaaaccgttaaccccgggtaaaaaacccgggtacgggtttaccgggtacggggttacccggtaccggtaacccggtaaccccttaacgg

SEQ ID NO: 258202 - DNA, 609 bp, Homo sapiens
  misc_feature: GYAE6OF01BLDSP.34.88.H11.1.454.CMB.1.raw
  modified_base (206)..(206): a, c, t, g, unknown or other
  misc_feature (206)..(206): n is a, c, g, or t
  modified_base (306)..(306): a, c, t, g, unknown or other
  misc_feature (306)..(306): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaangtcaccctctcctgcagggccagccagagtgttagcagcaacttggcctggtaccagcaagaacctggccaggcctcccaggcctcctcatctagtggtncatccacgagggccacgtggtactcccagcccaggttcaggtcggctaggtcgggtctggggacaggtaacttcacttctacacctatcagcacgtccctgactagtctagtaagttattttgacttagttttacttacgttcgtacagtactaagttaacttaaagttaaccgtcgggacccggttaccgggggtacgtttaccgggaccgtaaacggggtaacccgtaaaggggtcggtaaacgtttaccgaaaacggttaacgtagggtacggtacgtacggaccaccgtatcggttacg

SEQ ID NO: 258203 - DNA, 821 bp, Homo sapiens
  misc_feature: GYAE6OF01D613D.34.88.H11.1.454.CMB.1.raw
tcagtacacgtgatcacgaccggtgctcgatttagcgacagcgagaacacacaaagggggaggaactgctcagttaggacccagacggaaccatggaagccccagcgcagcttctcttcctcctgctactctggcctcccagactaccactggaagaaatgtgatgacgcagtcctccagcccaccgtgtctgtcgtcctaccggaaggggaaatcgtccacccttctccgtggccgacgggccacgccgaggtagtgttacgcgagacctaacgttcggccgtacggtaaccagaccgaacgtaaaccgtcggacccacggtcctcccgacggtccctcctactacttcgtagtcggtacgacctacctacccgaaccgacgggtaccctacgtacgggtacctccccgacgtaccgtagggttacgaggtcggtacgtagggttcgggtacgtacggggactaacggttactccgtaccgttcctacctaccgtacgtaccgacgtccgtaccgtcccgtacgaccgttaggttaccgtaagttaacggttttaacttttcggtaacttttacggtttttaacgtttaccgttacgttacgtaacgttaacgttaacgtttaaactttaaacgtaaccgggttcccgggtaaccccggggttaaccgggggtttaccgggttaaacccggggaacccgggttaaaaccgggggtaaaccggttaaacggggtttaaaccgtaaaccggtttaaccggaaaaccggttacggttggtaccggtaccggtacgtaaccccgtacgttacgttccgtttccg

SEQ ID NO: 258204 - DNA, 735 bp, Homo sapiens
  misc_feature: GYAE6OF01B323K.34.88.H11.1.454.CMB.1.raw
tcagtacacgtgatcacgaccggtgctcgatttagcgacagcgagaacacacaaagggggaggaactgctcagttaggacccagacggaaccatggaagccccagcgcagcttctcttcctcctgctactctggcctcccagataccactggagaaatagtgatgacgcagtctccagccaccgtgtctgtgtctccgaggggaaagagtccaccctctcctgcagggccagccagagtgttagcagcaacgttggccgtggtaccagaccaagaacccgtcggccacggcctaccccgacgacccttccgtactaagttaacgtggtacgactaataccgtacgaccgggtcccctaggacctaccgtacccgaagaccgtacggttacgacggttggccgtagggttggggtccgtacggggaacgtacgtacctttccgaccgtttacctaccgtaacctactacccgaacccgtaacgtaccgtacgggaccgtaccgtaacggtaggttacgttttacgacgttaggttacgtttaacgtttaacgttacgttaacgtaaccgttggtttcgttaccttaccgaaccgtaccgttacgggtacgggtacccgggtttaccgggaaccggaaccgggtaaccggaaagggttaacggtaaacgtaaaccgtaaacggtacggttcggtacgtacgtaccggtaccaacctagtccgttcgttccgttaccg

SEQ ID NO: 258205 - DNA, 587 bp, Homo sapiens
  misc_feature: GYAE6OF01EC432.34.88.H11.1.454.CMB.1.raw
  modified_base (207)..(207): a, c, t, g, unknown or other
  misc_feature (207)..(207): n is a, c, g, or t
tcagtacacgtgatcacgaccggtgctcgatttagcgacagcgagaacacacaaagggggaggaactgctcagttaggacccagacggaaccatggaagccccagcgcagcttctcttccctcctgctactctggctcccagataccactggagaaatagtgatgacgcagtctccagccaccgtgtctgtgtctccgaggggaaangtccaccctctcctgcagggccagccagagtgttagcagcaacttggcctggtaccagcagaacctggccaggctccagacgtcctcatctatcgctacactccaccagggccactgctacttcagccaggtcagtgcgaggtggtctgggctagactcgactctcaccatcagcagtacttgactccgtagtaagtattttcggatacgttaaattactttacgttacgtactaggtacaattacgtacgtaacgaccgtacgtaccggtggtacggggtccggttaccgggaccggtaaacggggtaacccgaagggtaacgggaaaaccgttaccgaaaacggtaaccggtaggtacgggacgtacgcgtaaacccg

SEQ ID NO: 258206 - DNA, 657 bp, Homo sapiens
  misc_feature: GYAE6OF01CCWGB.34.88.H11.1.454.CMB.1.raw
  modified_base (205)..(205): a, c, t, g, unknown or other
  misc_feature (205)..(205): n is a, c, g, or t
  modified_base (213)..(213): a, c, t, g, unknown or other
  misc_feature (213)..(213): n is a, c, g, or t
  modified_base (217)..(217): a, c, t, g, unknown or other
  misc_feature (217)..(217): n is a, c, g, or t
  modified_base (444)..(444): a, c, t, g, unknown or other
  misc_feature (444)..(444): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaangtcacctntccngcaggccagccagagtctagcagcaacttgcctggaccagctagaaacctggaccaggtcctccccaggctacctcattcgtagtggtgcactcccaccgagggtcccaacgttcggtactcccgaagccgtaggttccaggttggacagggttcgggtcctaggggacctagtaatttccactctacgaccatcgacgcacggtccctgcaggttctaggtaattnttttcgactttagttttattcgtacgttacgagttacgtaagtttactaacgttaaccttcggggtaccccggtaccggggtaacgtttcccggggaacccttaaaccggggggaacccttaaaggggtcggttaaaccttaaccggtaaaaacggttcgttaacgggtccggggttactacccggtataaaccccttgttacccgttaccgg

SEQ ID NO: 258207 - DNA, 581 bp, Homo sapiens
  misc_feature: GYAE6OF01C4LQV.34.88.H11.1.454.CMB.1.raw
  modified_base (206)..(206): a, c, t, g, unknown or other
  misc_feature (206)..(206): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaancgtccaccctctcctgcgagggccagccagagtgtagcagcacttggcctggtaccagacaagaacctggccaggcctcccgaggcctccgtcatctagtggtgcatcccgaccgagggccacgtcggtactcccgagcctaggttcaggtggctggtgggtctaggggactagtattcacgtctacacctancagcncgcctgcagtctagtaagttctttgacttagttttatacttgtactagtactaaggttaataacgtacgtcggtccgtacggggttaccggtcggaaccgaacgggtaccgaagggtaggtaacttaacggaaacgttacgtagggtacgtaccgtacgacctacgtcttcgttacg

SEQ ID NO: 258208 - DNA, 614 bp, Homo sapiens
  misc_feature: GYAE6OF01EG2WV.34.88.H11.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagactaccactggagaaatgtgatgacgcagtctccagccacgtgtctgtgtctccgaggggaaangtcaccctntcctgcagggccagccagagtgtagcagcaacttggcctggtaccagcaagaacctggaccaggctccccaggcctctcgactcgtagtggtcgactactcccaacgagggccctaagttcggtactccccgagtcccgtaagggttcaggtcggctaggtgggtcgtagggacaggtaccttcacgttcctcacactcacgcacgtacgttgacgtaccgtagtaacgttattttagacgttaagttacttaagtttaacgttcgtacgtacgtacgttacggtaccgtacgtaccgtaacgtcggtcccttccgttacgacggtccgtccggttccggaccggtaggacccgtacggacgtaggaacgtaacgtaaacgtacgtacggtcggcgtacg

SEQ ID NO: 258209 - DNA, 651 bp, Homo sapiens
  misc_feature: GYAE6OF01AM5A6.34.88.H11.1.454.CMB.1.raw
  modified_base (210)..(210): a, c, t, g, unknown or other
  misc_feature (210)..(210): n is a, c, g, or t
tcagtacacgtgatcacgaccggtgctcgatttagcgacagcgagaacacacgaaagggggggagaactgctcagttaggacccagacggaaccatggaagcccccagcgcagcttctcttcctcctgctactctggctcccagataccgactggagaaataggtgatgacgcagtctccagccaccgtgtctgtgtctccgaggggaangtccaccctctcctgcagggccagccagagtgtagcagctacgttggcctggtaccagacagaaccgtggaccaggcctaccgaggcctccgtcgatccgtaatcgactcgaccgtaccaacgacgggccctacgtcggcctaccgtcccgagtaccgtaggttcgacggtcggcgtagggttcggtcgtcgggaccgtagtacccttccgtaccttcctaccgacctactaccgaacgtccgtaccgtaccgtaaggtaaccggttaaacttaaggttcgttttacgacctttaaacgttttacttacgttcgtacacggttcctaggtacgtaacgtccgtacgttcggtacccttcggtcgtacggtcccgtccggtaccgggaccgggtacgtaccgacggtacgtaggataacgtacgacgtggtcgcgtcgtacc

SEQ ID NO: 258210 - DNA, 563 bp, Homo sapiens
  misc_feature: GYAE6OF01D0BIU.34.88.H11.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (334)..(334): a, c, t, g, unknown or other
  misc_feature (334)..(334): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctcaggggaangtcaccctntcctgcagggccagccagagtgttagcagcaacttggcctggtaccagcaagaacctggccaggctcccaggctcctacattaagtggtgcactactacgagggcccctggcatcccagacnggttcagtgcagtcggtactgggacagacttcactctacaccactcaccacgacgtcggagtcctaggaagtcgtttagacgtagttagtattacgtgtacaacgtagttggtactacgacacgtacggtcggtaccgttcggaccgtaagggaccaaacggtaggtaaacgtacgaaacggtaacgtcggtacggtactcggtacaaccgtattccttgttcttaccg

SEQ ID NO: 258211 - DNA, 769 bp, Homo sapiens
  misc_feature: GYAE6OF01D1OZK.34.88.H11.1.454.CMB.1.raw
  modified_base (217)..(217): a, c, t, g, unknown or other
  misc_feature (217)..(217): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctccagactaccacgtggagaaagtgtgatggacgcacgtcctccacgccctacgtgtctgtcgtccgtccggaaggggaaancgtccaccctctccgtgccgacgggccagccagtagtgtagcacgacgtaacgttcggccttcggtaccacgacgaacgtaaccgtcggccgacggcctacccgacggtcccttccgtacgtacttacgtacggtggtcgacctaccgtaccgaccggacggtacctacggttacgtaccgtacccgacggtccgttacgggttacgtacgggtcggtacgtaggggtacgggtacgtaggggaactaaggttaacctccgtaacctcgtaaccaccgtactaccggaactccggtacgtaccctcggtaacgtaccggtttactaacggttaagtttacgtttcgtaacgtttacgttttaaagttccgtagtaccgtaacgtaacggttaacgttaactaaaccggtttacgcccggggttacccgggttacggggtccgtaccgggaaaccggttaaacggggaccgttaaaggggttacgtaaacgtaaaccggtacggtaccgggttgtaccgggtactacgtaacccggactttagtcgttacccg

SEQ ID NO: 258212 - DNA, 801 bp, Homo sapiens
  misc_feature: GYAE6OF01EJN81.34.88.H11.1.454.CMB.1.raw
  modified_base (125)..(125): a, c, t, g, unknown or other
  misc_feature (125)..(125): n is a, c, g, or t
  modified_base (792)..(792): a, c, t, g, unknown or other
  misc_feature (792)..(792): n is a, c, g, or t
tcagtacacgtgatcacgaccggtgctcgatttagcgacagcgagaacacacgaaagggggagaactgctcagttacggaccaggacgaacagtggaacgcccagcgcagtcttctcttccgtcngctactcgtggcctaccgagtactaccgagtaggaagaaagtggtgacgtcgaccgctacgtcctaccgacgcccgtacgtgtaccgttgtcgtaccgacgggaagggaactccgtccaccgtcgtcgtcggaccgaacggcaacggtaccgtaaggttacggttacggtacgaaccgacgttaccgtaacggttccggtaaccgtacggtaccaggaaccgaaacggtaacccgtccgggaaccgtcgggtaaccccgtccggtacggttaccctttcggaacctcgtttaacggtcgggttacggtactaaccctacccgtaaccggaaccggaccgggttacccgtaacgtaccgttacccgacccggtacggtaaccggtttcggttaccgaggggtttcgaaccggtttcgggggtacgtttacggaacggtttaacccgaaacgtttacccggttaccggtaaccttccgtaaaccccgtacgtaccgtacgtacggtacgtaccggtacgtaccgacgtacgttaagttcgttacgtacgttagttacgtacgttacgtacgacgttacgtacgttcgactacgtacgtacgtacgtacggtacgacgacggtaacgagaacggtacgacgtaacacggtacgtgcgacgtacgacgtancgtctcgtc

SEQ ID NO: 258213 - DNA, 724 bp, Homo sapiens
  misc_feature: GYAE6OF01E23C6.34.88.H11.1.454.CMB.1.raw
  modified_base (157)..(157): a, c, t, g, unknown or other
  misc_feature (157)..(157): n is a, c, g, or t
  modified_base (212)..(212): a, c, t, g, unknown or other
  misc_feature (212)..(212): n is a, c, g, or t
  modified_base (222)..(222): a, c, t, g, unknown or other
  misc_feature (222)..(222): n is a, c, g, or t
  modified_base (253)..(253): a, c, t, g, unknown or other
  misc_feature (253)..(253): n is a, c, g, or t
tcagtacacgtgatcacgaccggtgctcgatttagcgacagcgagaacacacgaaagggggaggaactgctcagttaggacccagacggaaccatggaagccccagcgcagcttctcttcctcctgctactctggcctcccagactaccactggaanaaatagtgatgacgcagtctccagccaccgtgtctgtcgtctacgagggggaaangtccaccctntcctggcgtaagggccagccaggagttgtancacgacgaacgttcggacctcggtaaccaggacctaaacggtaaaccgtcgggaccacgggtccctacccgacggtcccttaccgtcacgttactaggtggtcgaccaactcccgaaccggacgggacctaacggttcggtaacctccccggtaacgtcccgtaaggttccgaagggtcggaccgtagggttcggggtacgtagggaactaagtaacttccacgttcacctacctactacgacggactacgacccttaggacttaacggtactacggtaacttagttttacgacgtttaagtttaacgtttacgtaggttactaggtaactaaggtaaattaaacgtaacgttcgggtacccggtaccggggtaccgttacgggaccgtaacgggtaaccgtaagggtacgtaacgttacgaaaaccggtacgtacgtacggtacgttacaccgtaccttagtccgttacg

SEQ ID NO: 258214 - DNA, 599 bp, Homo sapiens
  misc_feature: GYAE6OF01E1MK2.34.88.H11.1.454.CMB.1.raw
  modified_base (206)..(206): a, c, t, g, unknown or other
  misc_feature (206)..(206): n is a, c, g, or t
  modified_base (351)..(351): a, c, t, g, unknown or other
  misc_feature (351)..(351): n is a, c, g, or t
tcagtacacgtgatcacgaccggtgctcgatttagcgacagcgagaacacacaaagggggaggaactgctcagttaggacccagacggaaccatggaagcccccagcgcagcttctcttcctcctgctactctggctcccagataccactggagaaatagtgatgacgcagtctccagccaccgtgtctgtgtctccaggggaaangtccaccctctcctgcagggccagccagagtgttagcagcaacttggcctggtaccagcagaacctggccaggctcccaggcctcctcatctatggtgcactccaccgagggccacgtggactccccagcctaggttcagtcggnaggtgggtctgggtacaggtatcactctacaccatccagcagccctgcgtagtacgtggtagttagttttgacttaagttttaacttacgttgtacgaagtacgtaacgttaattaaacgttaaaccggtgggtaccccgttaccgggggtaacgttaccgggaccggaaacgggaacgtaaagggtaggtaaacttaacggaaaacgtaacgtaggtacggtcgttacgacctaactagtcgttacg

SEQ ID NO: 258215 - DNA, 862 bp, Homo sapiens
  misc_feature: GYAE6OF01BJL6E.34.88.H11.1.454.CMB.1.raw
  modified_base (102)..(102): a, c, t, g, unknown or other
  misc_feature (102)..(102): n is a, c, g, or t
  modified_base (847)..(847): a, c, t, g, unknown or other
  misc_feature (847)..(847): n is a, c, g, or t
tcagtacacgtgatcacgaccggtgctcgatttagcgacagcgagaacgacacgaaagggggaggaactgctcgagttaggacccagacggaaccatggaanccccagcgcagcttctcttcctctgctactctggctcccgagactacccgacgtaggaagtaaatagtgactggacgcagtcctcccagcctacgtgtctagtcggtctacggaaggggaactacgtaccacccttctccgtacgacgtaccgggaccacgaccgaggtaggtttagtacgaccacgtactaacgttcgggcccgttacggtaacctagaccgtaacggtaaacccgtggacccgacggtacccctaccggacggtacccttacccttaccgtaaacgtttccgttaaggtccgggtactaacccttaaccggtaccccggaaacccggtacgggtaccccgtaacggttaccgggtaccctacccggaaccggtaccggtttaaccggtacggacggggttaccggaggtttacggggttaccgggtacggttaacgggaacttaacggttaacctttaccggaaccctttccaacccgtaacctacggtacccgaagtacccgtaaacgttccgtacgaacggttaccgtaaggtaacgttaaagtttcgttttaaggaccgttttaattttaacgtacctagggtttaacacgttacgtaaacgtttaacgttaaacgtaccggttcccgggtaccgggttaaccgggtacggttaccgggaaacccggagggtaaaaccgtgggttaaaaccggtacaacggtaaacgtacgtggtaacggtccagtaacnccggttatcgttccg

SEQ ID NO: 258216 - DNA, 799 bp, Homo sapiens
  misc_feature: GYAE6OF01C0FU8.34.88.H11.1.454.CMB.1.raw
  modified_base (217)..(217): a, c, t, g, unknown or other
  misc_feature (217)..(217): n is a, c, g, or t
  modified_base (406)..(406): a, c, t, g, unknown or other
  misc_feature (406)..(406): n is a, c, g, or t
  modified_base (480)..(480): a, c, t, g, unknown or other
  misc_feature (480)..(480): n is a, c, g, or t
tcagtacacgtgatcacgaccggtgctcgatttagcgacagcgagaacacacaaagggggaggaactgctcagttaggacccagaacggaaccatggaacgccccagcgcagcttctcttcctcctgctactctggcctcccagactaccactggaagaaatgtgatgacgcagtcctccagcccaccgtgtctgtcgtcctaccggaaggggaaancgtccaccctctccgtgccgacggccagccgagagttgtagcagcctaacgttcggccgtacggtaccagacgaacgaaccgtcggaccgacggcccgtcccgacggtccctacctctaactcgtaggtcgtccgtacacctacccgaccgacgggacctacgtcgaccctccgagccgtagtcgaggngcgtacggtgggtagtacggaacagttacgtcgtacttccgtactactacgacgtacgacctacggtcccgtanccggttaagtccggtaagttagttttacgtacggttacgtttaacgtttttaagttacggtccggttaacgacggttaacgtttaacggttaaacttaaacccggggttacccgttaccggggggttaccccccggggttaacggggttaccggggttaaccccgtaaacgggggtaaaccccggggtaaaccggtttaaaggggtaaaccgggtttaacccctaaaaccgggttaaaacgggttaccggggtagtttaaaccccgggcccggtttaacggaaccccttttcccggtaagtttcccggttttaaacccg

SEQ ID NO: 258217 - DNA, 769 bp, Homo sapiens
  misc_feature: GYAE6OF01ATJJ8.34.88.H11.1.454.CMB.1.raw
  modified_base (209)..(209): a, c, t, g, unknown or other
  misc_feature (209)..(209): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggcctcccagactaccactggaagaaatagtgatgacgcagtctccagccaccgtgtctgtgtctaccgaggggaanacgtccaccctctccgtagccgacgggccacgccaaggagtcggttacgacgagacctaacgttcggacccgtacggtaccgaacgtacgaacggaaacccgtcggacccgtacggtccctaccccgaacggtccctccgtacctacgttcttaacgtcggtcgtaccgtaccttaccccgaaccggtaccgggtacctaacggttaccgttacccgtaccccgaggtacccgtacgggttaccgcgggttacgaccggtaacgggttcgggtaccggtacggggaactacgggtacggttactaccggtacccttaccaccgtaagtccgaacgacgtacctaccgtcgtaccgtacgttacggtacgtaacgttacgttaccgtagtacctttactttaagttaccgtcttacgagttaccgtaagttaacgtacgttaacggtccgggtacgttaaccgggtaccgggttaccgaaaccgggttaccggaaacgttaagggaacgtaaactcggaaaccgtagttcggtacgtaccgagacctaaccgtcgttaccg

SEQ ID NO: 258218 - DNA, 712 bp, Homo sapiens
  misc_feature: GYAE6OF01D7LOW.34.88.H11.1.454.CMB.1.raw
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggaagaaatagtgatgacgcagtcctccagcccaccgtgtctgtcgtctaccgaaggggaacacgtccaccctctcctgcgacggccagccagagtgtacgcacgtcttacttctacgccgtggtactcagtacaacgtaaaccgtcggccgtcggcccgacccgacggtcctccgtactactactaataatcgtaccttagacgacgacgggacctacgtcggtccgtacccgaagtacgtacggttcgaggttcggcgtagggtcggggtcgtcggggcacgtacttacctccgtccacctaccatcgacgactagtacgtggactcgtagtaagttagtttcgacgttaggttagttaacgtttagttcgtaacgtacgtcgaacgttacgtacttacggtaccgttcccgggttaacccttaacccggtttaaccgttaccgggtttaccggggaacccgggtaaccgggggtaaacccgtaagggttaccgtaacggggttaaaacgtaaccgtaaaacccgggttaaaccgtaccgggttacggtccggtaacccgg

SEQ ID NO: 258219 - DNA, 817 bp, Homo sapiens
  misc_feature: GYAE6OF01AT3TK.34.88.H11.1.454.CMB.1.raw
  modified_base (207)..(207): a, c, t, g, unknown or other
  misc_feature (207)..(207): n is a, c, g, or t
  modified_base (313)..(313): a, c, t, g, unknown or other
  misc_feature (313)..(313): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaaggggaaangtccacccttctcctgcacgggccagccagagtgttagcagcaacgttggcctggtaccagcaaggaacctggccaggcctcccaggcctcctcatctagtcggtnacctatcccgaaccgcgggtccccaacgttcgggtaacctccccgaggtcccgtaacgggtttaccagggttcgggccgtaacggggttcggggttaccgtacggggggaacctaaaggttaaacgtttcccgtaacccgttccttaccgaaacccctacgttaccgaacggtaccgtaaccggtccccgtttacgggacccgtaagggtttacccgttaaggtaaacgggttttacgtttttcggaaccgtttaaggtttttaacgttttaaccttacgggttaccgtaacgggttactaaacggtttaacttaaaaacggttaaccgttacgggtaccccggggttaccggggtaaccgggttttacccgggaacccgggtaaaccggggtaacccgggtaaaggggttacgggtaaaccgtttaacccggtaaaaaccggttaccggttacgggtacgggttcccgtaacggaaccgtaccctaagttcccgtttaaccgg

SEQ ID NO: 258220 - DNA, 787 bp, Homo sapiens
  misc_feature: GYAE6OF01DRNMF.34.88.H11.1.454.CMB.1.raw
  modified_base (251)..(251): a, c, t, g, unknown or other
  misc_feature (251)..(251): n is a, c, g, or t
  modified_base (389)..(389): a, c, t, g, unknown or other
  misc_feature (389)..(389): n is a, c, g, or t
tcagtacacgtgatcacgaccggtgctcgatttagcgacagcgagaacacacgaaagggggaggaactgctcagttaggacccagacggaaccatggaagccccagcgcagcttctcttcctcctgcctactctggcctcccagactaccacgtaggaataaattgtgagtacggaccgtcagtcctcccacgccccacccttggtcctgtcgtccgtaccggaaggggaaatccgccctaccctctccgngcggacggcctagtccgagtgtcgtggacaggctaacgtcgccgtagaccagactaacgaaccgtcggaccacggtccctaccgagtaccgtacctacgcttactactcgacctacgacctacccgacgcgacctcgngtacctctaccgacgccgttagtccgagtccgggagtacggtcggtacgtagggatacggtacttccgaccttcgtaccgtacctacgtccgacgcccgtaccgtaccgtacggtacccgtaggttaaccgtaggttaaccgttcgttaccgttcgttaacctttaactttacggttaccgttacgtacgtaacggtacgttaaccggttaaacgttaacggttaaccggggtccggttaacccgggttaccggggttaacccgggttaaccgggaaccccgggtaaaaccggggtaaccgggttaaacgggttaaacccgtaaaccggttaaacggtaaaacccgggttcgttaaccgggttacgaccggttaacccggtaaccgtccggttaaccg

SEQ ID NO: 258221 - DNA, 790 bp, Homo sapiens
  misc_feature: GYAE6OF01D1QE0.34.88.H11.1.454.CMB.1.raw
  modified_base (206)..(206): a, c, t, g, unknown or other
  misc_feature (206)..(206): n is a, c, g, or t
  modified_base (223)..(223): a, c, t, g, unknown or other
  misc_feature (223)..(223): n is a, c, g, or t
tcagtacacgtgatcacgaccggtgctcgatttagcgacagcgagaacacacgaaagggggaggaactgctcagttaggacccagacggaaccatggaagccccagcgcagcttctcttcctcctgctactctggctcccagactaccacgtggagaatagtgatgacgcagtctcagccaccgtgtctgtctctacgaagggaanacgtcccaccgtctccngacgacggaccagaccagtacgtgttacgcgacgtaccgtaacgttcggaccgtacggtaaccgaggtaccaaacggtaaccgtcggaccgacggtcctaccccggacggtccctacctacgtaacttcgtacggttcggtacgacctaaccttcccgaaaccggaggttaccccgtacgttaaccgggtaccctaccccgaggtaccccgtaagggtttccgaggtcggtacgtgggtcggtaccgtagggacgtaaccgtacgttacccgtactaacccgtaccgtaaccgtacgttacccgacgtaccgaccgtaacccggttgaaccgttagttaccgttaaggttacgttttacgtttagtaaccgttttatttacgtacgttagtacgtaagtacgtaacgttaacgtacggtttaccggacccgggttaccggtacccggggttacgtacccgggaaacggttaaccggtaaacggtaacgggtaaactttaaccggaaacggttaaacggtacggttagaaccggtccgtaacctaccgtaacgttcgttgttaccccg

SEQ ID NO: 258222 - DNA, 659 bp, Homo sapiens
  misc_feature: GYAE6OF01AG7KV.34.88.H11.1.454.CMB.1.raw
  modified_base (209)..(209): a, c, t, g, unknown or other
  misc_feature (209)..(209): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtcctccgaagggggaaanagtccacccctctcctgcagggccagccagagttgtagcagctaacgttggcctggtaccagcaagaaaccgtggacccaggcctaccccgaggtccctcctacactccgttagtggtcgacctactcccgaaccccggaggggccctaaccgtcggaccttacgtttacccgacggtaccgtagggtttcacgggtacgggcgtagggtcggggtcgtagggaactacggtacgttcctaccgtcctaccgaccactacgacgtcacgtcctgactagtctagaactctcgtcgtacttactttacttaactcgtacacgtacgtacgttaacttaagtaacggtcgggtaccggttagggtaccggttaccgggaccggtaaacgggtacgtaaagggtaacggaaacgttaaccgaaaacggtcgtaggtacgagtccgacgcgtac

SEQ ID NO: 258223 - DNA, 845 bp, Homo sapiens
  misc_feature: GYAE6OF01D3IID.34.88.H11.1.454.CMB.1.raw
  modified_base (194)..(194): a, c, t, g, unknown or other
  misc_feature (194)..(194): n is a, c, g, or t
  modified_base (668)..(668): a, c, t, g, unknown or other
  misc_feature (668)..(668): n is a, c, g, or t
tcagtacacgtgatcacgaccggtgctcgatttagcgacagcgagaacacacgaaagggggaggaactgctcagttaggacccagacggaaccatggaacgcccagcgcagcttctcttcctctgctactctcggcctccgagtactccggacccggaagtaattggtgttcgacgctacgtccgccacgaccncctgtctctcgtcgacggaagggaacgccgccctaccgtcctccgtcggtcggacgggttaccacggtccgacggttccgttaaccgtaacccgtacccgttaccgtttccgttcccgtaccggttaccggtaccaacggaccgaacggtaccgttaccggcggacccgtaccggcccgttaccgtcggtccctaccgttcgttaccgtttcggttccgggtcgtaccccggtaccgaccgggtaccggacccgtcggttacggaccctaacgtacccgaggtaccgttacggtacggcggttagacgggtcgggttcggtacggtcggaacctacggtccttacctacccgtcctaaccggaccttcgaacggtcgtaacgtacggtaccgttacgacggttaccgtaagttaaacggttcgttacgtaacggttgtttaacctttagtttaacgtcgtaacgtcgaaccgtntaaccgtcgttacccggttaacgttaacccggttcgttaaccggttaccggtttacggtacccgggtaaaggggtaacccgtaacgggtacggttaccgaagggttaacccgtaaacaaaccgggtacgtttaacggcgttaaccggtcaacccgttctaccgttacgttacccggg

SEQ ID NO: 258224 - DNA, 743 bp, Homo sapiens
  misc_feature: GYAE6OF01E0CCK.34.88.H11.1.454.CMB.1.raw
  modified_base (233)..(233): a, c, t, g, unknown or other
  misc_feature (233)..(233): n is a, c, g, or t
tcagtacacgtgatcacgaccggtgctcgatttagcgacagcgagaacacacgaaagggggaggaactgctcagttaggacccagacggaaccatggaagcccccagcgcagcttctccttcctcctgctactctggcctcccagactaccactggaagaaatagtgatgacgcagtcctccagcccaccgtgtctgtcgtctaccggaaggggaacacgtccaccctctccnggcgacgggccagccgagtagttgttacgctacggtacctaacgttttcgggacccgttaggtaacccacgtacgaaccgtaacccgtcggacccgacggccctacccgacggtccctctctacgttctacgtcggtcgacctaccgcccgaccgtaccggcctacgttacggtaccctacccgacgtacccgtaggttccgaacgggttcggacggtagggttcgggtaaccgttagggggtaacctacggttaccgttacgtaccttacccgtacctaaccgtaccgtacccgaacccggtaaggtacccggtacgggtaactacccgggtaaggttaaactttcggttttaccgacggttaacgttagttaaccttacgtacgtataacggtgttaccgtctacgacgttacgacgggttcggtaccgtacggaaccgaaggtaccgtaaggtaacgtaacgtaaccgaagtcggtcgtacgctaccgactacttcgtctcgttacg

SEQ ID NO: 258225 - DNA, 799 bp, Homo sapiens
  misc_feature: GYAE6OF01BKNXA.34.88.H11.1.454.CMB.1.raw
tcagtacacgtgatcacgaccggtgctcgatttagcgacagcgagaacacacaaagggggaggaactgctcagttaggacccagacggaaccatggaagccccagcgcagcttctcttcctcctgctactctggcctcccagataccactggaagaaatagtgaatgacgcagtcctccagccaccgtgtctgtcgtctccgaaggggaaactcgtccaccctctcctggccgacggccagccgagtggtacgtagaccagtacctaacggttcggcctaccgggtaaccaggaccaaccggtaaccgtcggacccacggtccctacccgacggtcctaccgtactacttcgtagttcgggaccacgtaccgtacccgtaccgggaccggtaccctacggtacggttacccaccccgtaggtacggttacggttaccgtaaggggtccggtggaaccggggtttgggtaaccggtagggaaaccgtagtttaaaccgttccctaaaccgtttcccggaaccctaccgtacgttaacccgactaccgtaccgtcgtacggtcgtacgttacgtaagttaacgttgtttacgtagtttacgtttattaccgtacgtacgtagtaactaagttaacgttaaccgttccgggtacggttaccccggggtacccgggtacggttaaccgggaacggttaaacccggggaccgttaagggttaaaccggtaacggtaacgtaaaaccgggttccggttaggaccgttccggtactaacccgtaccggttgttcccgtttaaccgg

SEQ ID NO: 258226 - DNA, 679 bp, Homo sapiens
  misc_feature: GYAE6OF01DADZU.34.88.H11.1.454.CMB.1.raw
  modified_base (216)..(216): a, c, t, g, unknown or other
  misc_feature (216)..(216): n is a, c, g, or t
  modified_base (228)..(228): a, c, t, g, unknown or other
  misc_feature (228)..(228): n is a, c, g, or t
  modified_base (233)..(233): a, c, t, g, unknown or other
  misc_feature (233)..(233): n is a, c, g, or t
  modified_base (260)..(260): a, c, t, g, unknown or other
  misc_feature (260)..(260): n is a, c, g, or t
  modified_base (391)..(391): a, c, t, g, unknown or other
  misc_feature (391)..(391): n is a, c, g, or t
tcagtacacgtgatcacgaccggtgctcgatttagcgacagcgagaacacacgaaagggggagaactgctcagttaggacccagacggaaccagtggaacgccccagcgcagcttctcttcctcctgctactctggcctcccagactaccagtggaataaatgtgatgacgcagtcctccagccctacgtgtctgttcgtcgaccggaagggaaancgtccacccgtntccgngccgacggccagaccgagtagtgtacncgagacctagttcggcctaggaccagacaacgtaccgtcgacgacggtcccaccggacgtcctcctagtacttccgtaaggtcgaccgtacctaccgaccgaaccggtcggtacctacgtacggtaacccnccgacgtacggttacggtactacgggcggtacgtaagggttcggggtacaaggtacgtacgtaaaccttcgaacccgttcaaccgactaggcacgtcacggtccctaggactacgtagtataacgtttgtaccgtattttacggttatccggataccgtagaacttaagtaacgttacgccgggttcggtaacccggttacggacttaccgggacggtaaacccggtatacggtaacgtaactaacgaccgtagggacgtcggacctagtaccacgttgtcgttcccg

SEQ ID NO: 258227 - DNA, 731 bp, Homo sapiens
  misc_feature: GYAE6OF01AJSVU.34.88.H11.1.454.CMB.1.raw
  modified_base (185)..(185): a, c, t, g, unknown or other
  misc_feature (185)..(185): n is a, c, g, or t
  modified_base (212)..(212): a, c, t, g, unknown or other
  misc_feature (212)..(212): n is a, c, g, or t
  modified_base (455)..(455): a, c, t, g, unknown or other
  misc_feature (455)..(455): n is a, c, g, or t
  modified_base (603)..(603): a, c, t, g, unknown or other
  misc_feature (603)..(603): n is a, c, g, or t
  modified_base (711)..(711): a, c, t, g, unknown or other
  misc_feature (711)..(711): n is a, c, g, or t
  modified_base (721)..(721): a, c, t, g, unknown or other
  misc_feature (721)..(721): n is a, c, g, or t
tcagtacacgtgatcacgaccggtgctcgatttagcgacagcgagaacacacaaagggggagaactgctcagttaggaccagacggaaccatggaacgccccagcgcagcttctcttcctcctgctactctggcctcccagactaccacgtggaagaaatgtgatgacgcagtctcagccacgtntcgtgtcgtctacggaaggggtaaacncgtaccacccgttctccgtaggccgacgggtacccacgtccgaggtaggttagttacgacgtacgtactaaccggttcggtaccgtacggtaacccagtaaccgtaacgtaaaccgtcggacccgtacgggccctaccccggaggtcccttccgtactaagtcctaagtcggtcacctaaccgtacccgaaccggtacggtacctaccggtagtaccctcgacgttccgtagtacgagtcggngtagggttcgacggtacggactacggtaacttccgaccgtactacggacctaacgtacgaacgcgtacgcccgttaagtcgtaacgttacgtacgggtaaacgtttcttccggttaactttaggttaaccttaccgtgggtaacccgngtaaattaggtaaacctaaggtccgtacggtacccgggtaggtacgtaccggaacggttaggaaaccggtggttaaaccaagtacctaggtcgtagcgtaccgtaganaacccggttntacgtttacg

SEQ ID NO: 258228 - DNA, 964 bp, Homo sapiens
  misc_feature: GYAE6OF01B6WPQ.34.88.H11.1.454.CMB.1.raw
  modified_base (154)..(154): a, c, t, g, unknown or other
  misc_feature (154)..(154): n is a, c, g, or t
  modified_base (210)..(210): a, c, t, g, unknown or other
  misc_feature (210)..(210): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagactaccactgganaaatagtgatgacgcagtcctccgacgccaccgtgtctgtcgtctacgaggggaancgtccacctctcctgcgacggccagccgagtgtgtacgcagtactaacgttcggaccttaggtacccagacgtaacgaaaccgtcggaccgacggtccctacccgaggtccctaccgtcctagttacctaggtcggtactacctaaccgtaccccgaaccggtaccggggaccccttaacggtccgggttaacccctaccccgtaaccggggtaccggttacccgggtttaacgggtacggttaccggggtaccggttaccggggttacggggtttaaccggggtacggttaaaaccggggaacgttttaaaacccgtttaccgtaccccgttttaacccgttaaccccgtaaccccggttaaccgttaaccggttaacccggaccgggttacccgttaaacccgggttccggttaacgggttaccccggttaacgtttaacggtttaaacccggtttttaaggtttttaaccgttttacccggtttaaagttttttacccgttttaaccgttccgttaaaccgttaaccgggtaactttttaaaccggtaaaagttttaccccggttaaacccgggttccggggttaccccccggggttaaacgggggttacccccgggttaacgggtaaaccccggtaaacgggggtaacccggtaacgggtaacggttaaaccggttaaccggtaaaccgttacgggtcggggtttaccacccgggttccaaaccggttcctaacggtttccttacccggg

SEQ ID NO: 258229 - DNA, 811 bp, Homo sapiens
  misc_feature: GYAE6OF01A3J8Q.34.88.H11.1.454.CMB.1.raw
  modified_base (179)..(179): a, c, t, g, unknown or other
  misc_feature (179)..(179): n is a, c, g, or t
  modified_base (209)..(209): a, c, t, g, unknown or other
  misc_feature (209)..(209): n is a, c, g, or t
tcagtacacgtgatcacgaccggtgctcgatttagcgacagcgagaacacacgaaagggggaggaactgctcagttaggacccagacggaaccatggaagccccagcgcagcttctcttcctcctgctactctggcctcccagataccacgtggagaaatagtgatgacgcagtctccngcccaccgtgtctgtcgtctcgaggggaancgtccacctctccgtgcgacggccagccaggtagttcgtagcagacctacgttcggccgtcgtaccgagacaacgtaaccgtcggaccgacggcctacccgaggtccctccctactacttcgtagtcggtcgactacgtcccgaccggaccggtcctacgtacggtaccgtcccgacggtaccgtacggttacgagggtcggtacggtacgggtcgggtacgtacgggtacgtaacggtaaccgttaccgaccttaccgtaaccctaacgtaccggtaccgtaccggactaccgttcccgtacgtacgttacgggttacttaagggttaacgttttaggttttaccgtacgttttaaccggtttttacgttaccggttaccgttacgtaaagttaaccgtaaacgttaacgttaaaacggttaccggttcccgggggttaccccggttaacccgggggtaccggttaacccggggtaaaccgggaaacgggggttaaccgttaaacggggtacggttaaaacccgttaaccggaaacggtttacccgggagggttccgttaacccggttacggaacccttacggttccggtttacgttaccg

SEQ ID NO: 258230 - DNA, 779 bp, Homo sapiens
  misc_feature: GYAE6OF01EP716.34.88.H11.1.454.CMB.1.raw
tcagtacacgtgatcacgaccggtgctcgatttagcgacagcgagaacacacgaaagggggaggactgctcagttaggacccagacggaaccatggaagccccagcgcagcttctcttcctcctgctactctggcctcccagactaccacgtggagaaatagtgatggacgcagttctccagcctaccgtgtctggtgtcgtaccggaaggggaaagcgtccacccttctcctggaccgacgggcccagccgtaagtcgtgttacgcgagcctaacgttggcccgtaggtaaccgagacgaaacgtaaccgtcggacccgacggccccgtacccgtacggtcctacccgtcaacttccgttagtcggtcgaccacctacccgaaccggtaccgggacccgtacggttaccgggtacctacccggaggtaccgtacgggttacgacgggtacggccggtaggggtccgggtagttacggggaacctaggttaccgttaccgaccttccgtaccaaccgtagtaccgacgtaccgtacgtcgtacgacgtacggttacgtagtaagtttacgtttacgtactttagttttacgttacgtttcgtaacgtaccgtaccgttaacgttaacgttaaagttaaccggttcggtacccgttaccgttaaccgtaccgtaccggttaccggaacccggtaaacgggaacccgtaaggtaacggtagggtaaaccgtaacggtaaaacgtacggttaacgggtaccgtacgtccgtaaccgtaaccg

SEQ ID NO: 258231 - DNA, 748 bp, Homo sapiens
  misc_feature: GYAE6OF01ESBJQ.34.88.H11.1.454.CMB.1.raw
  modified_base (267)..(267): a, c, t, g, unknown or other
  misc_feature (267)..(267): n is a, c, g, or t
  modified_base (733)..(733): a, c, t, g, unknown or other
  misc_feature (733)..(733): n is a, c, g, or t
tcagtacacgtgatcacgaccggtgctcgatttagcgacagcgagaacacacaaagggggagaactgctcagttaggacccagacggaaccatggaacgccccagcgcagcttctcttcctcctgctactctggctcccagataccactggaagaaatagtgatgacgcagttcctccacgccctacccttgttcttttcgtccgtaccgaggggacaggacgcccaccctctccgtcggccggggccagtcaggtagttagttaanacgctactccttacgttacgccgtacggtaaccagacaacgaaccgtcggaccacgtcccctaccacgtaccttcctactaatttaacggcgggtacacctaacgttaacccgtaacggaccggggtcccccgttggaccctaaccgttaccccggaaacgtaccggttacgggttcgtaacgggtcgggtacgttaggggttcggggtaccgttacggggaactaacggttacctttccgaacgttcctacctaacaccgttaccaaccgacgtacgtacgggaccgtactaaggtaacgtttacgtttacgacgttagtttacgttaatttccgtagttaccgtaagttcggttcgtacctacacgttacgtacgggttacgtaccgggtacgacgggtaaacggtacgaacgggtaacgtaactaaccggtaaacgtacgttggcgtactacggacctacgtntccttagtccctacg

SEQ ID NO: 258232 - DNA, 708 bp, Homo sapiens
  misc_feature: GYAE6OF01C0KZ3.34.88.H11.1.454.CMB.1.raw
  modified_base (208)..(208): a, c, t, g, unknown or other
  misc_feature (208)..(208): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggcctcccagacaccactggagaaatagtgatgacgcagtcctccagccaccctgtctgtgtcctccgaggggaanacgcccacctctcctgctagggccagtcagtagtgttggcagactaactagcctggtaccagaccaagaaacctggacccaggcctccccgaggtacgtccctactatctagtcgacctaacgactcccaaccgacgggtccacctcgacctacttccacggtccacggtttcgacggttggcgtagggtgggtccgtaggggaactacggtacgttactaaccgttcctaaccgtaaccgtataccgaacgaccgtacggtcgtacggacctaggtaccgtaaggtaacgtaacttccgtagaacccttttagttttaacgtaccttaggtctaacggttacgtaacgttaaccgttaaaggtacggtcggttaccggttaacgggacccggttaacgggaacccggaacggggttaaaccgtaaggggtaaacgtaaaccggtaaccgtaaaacgggtccgttagggtaccgggtataacccgggtctaccggtaacg

SEQ ID NO: 258233 - DNA, 749 bp, Homo sapiens
  misc_feature: GYAE6OF01BDIPX.34.88.H11.1.454.CMB.1.raw
  modified_base (205)..(205): a, c, t, g, unknown or other
  misc_feature (205)..(205): n is a, c, g, or t
tcagtacacgtgatcacgaccggtgctcgatttagcgacagcgagaacacacaaaggggggaggaactgctcagttaggacccagacggaaccatggaagccccagcgcagcttctcttcctcctgctactctggctcccagataccactggagaaatgtgatgacgcagtctccagccaccgtgtctgtgtctccgaggggaanagtccaccctctcctgcacggggccagccagacgttgttagctagcctaacgttggccgtaggtaccagtcaacggaaaccctgggcctagggcctcccggaggtcctacctcattccgtaagtcgggtcgacctactacccgaccgacgggaccctacggtcggttactaccccggagacccgttacggttacgacggttcggacgtacgggtttacggggtccgttagggggaacctaggttaactttccggtaaacccttccggtaaccctaacccgtacgttaccgaacggtccaacggtacccgtgaccgtaagttacgtacgtaaggtttacgttttcgtacgttacggttttactttacgtacgtacgagtaacgtaataacgttaaggtaccgttccgggacccggttacgggggtaccgtaccgggtaccggaaaggggtaacccggtaacgggttacggtaaacgttaaccggtaaacgttaacggtgggttaaaccgtcgtaccggaacccgtacttaaccgttcgttaacgg

SEQ ID NO: 258234 - DNA, 669 bp, Homo sapiens
  misc_feature: GYAE6OF01ALA4U.34.88.H11.1.454.CMB.1.raw
  modified_base (311)..(311): a, c, t, g, unknown or other
  misc_feature (311)..(311): n is a, c, g, or t
  modified_base (362)..(362): a, c, t, g, unknown or other
  misc_feature (362)..(362): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggaagaaatagtgatgacgcagtctccagcccaccgtgtctgtgtctccgagggggaaatacgtccaccctctcctgccgagggccacgccagagttgttagcagctaacttggcctggtaccagcaagaaaccgtggaccgaggcctccgaggtcctcctnactcgtagtcggtcgacactcccgaccgacgggtccctacgttcggtaccncccgacggtaccgtagggttcgtagggtcggacgtcgggttcgggtcgtacggggactaaggtacttcaccgttcctacaccagtacagaccacgtccctgaccgtgtaccgtagtaacgttacgtttgtacgttagtttacgttatcggtacgtaactacgttaacgttaagtaacgttaccggtccggtacccgggtccggggtaaccgttccgggaaccggtaacgggaaccggtaacgggtacgtaacggtaaacgtaaccgtacgtacgggtcgtaccgtcgtaccgacttcgtccgttacg

SEQ ID NO: 258235 - DNA, 989 bp, Homo sapiens
  misc_feature: GYAE6OF01AKU5I.34.88.H11.1.454.CMB.1.raw
  modified_base (163)..(163): a, c, t, g, unknown or other
  misc_feature (163)..(163): n is a, c, g, or t
tcagtacacgtgatcacgaccggtgctcgatttagcgacagcgagaacacacaaagggggaggaactgctcagttaggacccagacggaaccatggaacgccccagcgcagcttctcttcctcctgctactctggcctcccagactaccactggagaaatgtnatgacgctagtcctaccgacgtcccaccgtgttcctggtcgtaccgtaccggaagggggtaaacgtacgtacccaccccttccgtcccgtacggccgaccggggacccaacggcccgtaaggtacgggttcggttaaccgacgtaacgaccgttaaaccggttcgggtacccgttacggtaaccctaaccggaaccgtaaaccggtaaaaccccggtgggacccccgtacgggtacccctacccggtacggtccccttacccgttaccgtacttcgttacgtcgggtacgtaccgtacccgtaccccggaaccggtaccgggtacccgttaacccggttcgggttacccgtaccccggtaccggtaaccggttgggtttaccggaccgggtcgggggtccgtaagggggtttcggggttaccggtaggggtaacccgttaaggtttaaccgttcctaaccgttctaaccctaacctactaccggtacgaccgtccggttaccgtcggtaaccgtacggtttacgaacggttttaaagtttttcggttttaagtttaacggttttaacgtttacggttacgtaacgggtactttaacgttaacgttaaccgttaaaccgggttccgggttaccggttaacccccgggggtttaccgggttaacccggggttacccgggaaaccgggttaaccggggtaaaacccgggttaaccgggttaaaccggttaaaccggttaacccggaaacgggttttacccgacgggggttaccggttaaccgtcccggtaaccctaacggtttccttacccggttcgtttaacccccgg

SEQ ID NO: 258236 - DNA, 791 bp, Homo sapiens
  misc_feature: GYAE6OF01BBD6A.34.88.H11.1.454.CMB.1.raw
  modified_base (100)..(100): a, c, t, g, unknown or other
  misc_feature (100)..(100): n is a, c, g, or t
  modified_base (188)..(188): a, c, t, g, unknown or other
  misc_feature (188)..(188): n is a, c, g, or t
  modified_base (501)..(501): a, c, t, g, unknown or other
  misc_feature (501)..(501): n is a, c, g, or t
  modified_base (771)..(771): a, c, t, g, unknown or other
  misc_feature (771)..(771): n is a, c, g, or t
tcagtacacgtgatcacgaccggtgctcgatttagcgacagcgagaacacacaaagggggaggaactgctcagttaggacccagacggaaccatggaacnccccagcgcagtcttctcttcctcctgctactctggcctacccgagtatacccacgtgggaataaaatggtgactggacgcacgttcncccgaaggccctaccctggtctggtacgttccgaccggaaagggggtaaacacgcccctaccctttcgtccgtaggacccgaggggaccctaggtaccaagggttagttcgggttcgggacacggtacctaaaccggtttcggcccgttacggtaaccgaacggacgtaaacggtaaacccgtcgggaccctaacgggcccttaccccggaaggtacccgttcctactacttacgtacgtcgacctaacctcgtaacccggaccgaacgggtcctacgtcgtacctaccgttccgaggtacccgtagggtacncggtaggccggtagggttcggtaccgagggacctaaggtctacctacgtcctaccgactactcgacgtcgtacgcgtacacggtcgtacgagggtaacttcgttacgacgttcttaactttaccgtacggtcgacgtagtccgttaacgtaacgttaggtaccggggtcggtaccgggttaccggtaccgggtaccggaaccggtaaaccggggtaaccgttaaggaaaccggttaacaaccggtaacggtaccgttagggacccggtanaccggtaaccctcggttacc

SEQ ID NO: 258237 - DNA, 769 bp, Homo sapiens
  misc_feature: GYAE6OF01EUGKD.34.88.H11.1.454.CMB.1.raw
  modified_base (157)..(157): a, c, t, g, unknown or other
  misc_feature (157)..(157): n is a, c, g, or t
  modified_base (221)..(221): a, c, t, g, unknown or other
  misc_feature (221)..(221): n is a, c, g, or t
  modified_base (513)..(513): a, c, t, g, unknown or other
  misc_feature (513)..(513): n is a, c, g, or t
  modified_base (580)..(580): a, c, t, g, unknown or other
  misc_feature (580)..(580): n is a, c, g, or t
  modified_base (758)..(758): a, c, t, g, unknown or other
  misc_feature (758)..(758): n is a, c, g, or t
tcagtacacgtgatcacgaccggtgctcgatttagcgacagcgagaacacaacgaaaggggggagaactgctcagttaggacccagacggaaccatggaacgccccagcgcagcttctcttcctcctgctactctggctcccagataccatgggaanaaattgtcgagtgacgctagtctaccaggcctacgtgttctgtgtacctccggaaggggtaaancgtcccaccctctccgtaggccgacgggacctagccgaggtaggttagtacacggactactaaccggttcgccgtaggtaacctacgacgtaacgtaaccgtggccctaacggtcctacccggacggtccctcctacagttctacgtcgtacgtacctccgtacccaacggccggtcctaccggtccgttacccgccgtaccggcgtacggttgacggttcggaacgtggtcgggtcacggggacaacgttcgtcctaaccttcaccgttacgactcgtaccgaccggttcncccgtacgtcgtaacgtacgagttaagttcgtttcgtacctttagttttacctacgttaggtaaccnggttaaacttgaacttaaccggttaccgtaacggggttcccgggttaccgggttaccgttaaacgggggtacccgttaaaccgggaacggtttaaaccgggttaaacggtaacttaaacccgggtaaacggttaccggtagggttaaccgttacggttacctaaccgtaaccggtttnccgttttaccg

SEQ ID NO: 258238 - DNA, 737 bp, Homo sapiens
  misc_feature: GYAE6OF01EY291.34.88.H11.1.454.CMB.1.raw
  modified_base (180)..(180): a, c, t, g, unknown or other
  misc_feature (180)..(180): n is a, c, g, or t
  modified_base (208)..(208): a, c, t, g, unknown or other
  misc_feature (208)..(208): n is a, c, g, or t
tcagtacacgtgatcacgaccggtgctcgatttagcgacagcgagaacacacgaaagggggaggaactgctcagttaggacccagacggaaccatggaacgccccagcgcagcttctcttcctcctgctactctggctcccagactaccagtggagaaatagtgatgacgcagtctccancccacgtgtctgtgtctcgaagggaaancgacccacctcgtcctagcaacgggccagtcgagtagttgttggacagactaacgtttgcctaggtaccagacaaggtaaaccgtggaccaagggtcctacccaggtacgtcctactatcgtaatgaccttaacacgtaccacgacggcctactgacttaacgtcaacgtctaggtttcagggtggaccgtagggtgggtacgtacgggaaactacgggtatttacccacttaccgttaccaccttaaccgtcgaagtccgaaccgtcgttaacggacctaaggttacgttaacggtaaacggttattccgttaacacgtttttaaaccgttttagttaacgttacgttaacacggtacttaacgttaacgttaaagttaccggtacggtaccggttaacgggttaccggttacccggaaccggtaaaacggggtaaccgtaaagggggttaacgtaaaaacgttaacccggtaaaaggtaccgttacgggttacggtaacgtttacggaaacccgtaccggtttaaac

SEQ ID NO: 258239 - DNA, 658 bp, Homo sapiens
  misc_feature: GYAE6OF01B4I0A.34.88.H11.1.454.CMB.1.raw
  modified_base (208)..(208): a, c, t, g, unknown or other
  misc_feature (208)..(208): n is a, c, g, or t
  modified_base (221)..(221): a, c, t, g, unknown or other
  misc_feature (221)..(221): n is a, c, g, or t
  modified_base (306)..(306): a, c, t, g, unknown or other
  misc_feature (306)..(306): n is a, c, g, or t
  modified_base (369)..(369): a, c, t, g, unknown or other
  misc_feature (369)..(369): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggcctcccagataccactggagaaatagtgatgacgcagtcctccagccaccgtgtctgtgtctccgaggggaaancgtccacctctcngcgaggccagccagagttgtagcagcaacttggcctgtaccagacaagaacctggccaggcctccgaggctcctcattcagtggnctatcccacgacggcctaacgtggacctcccagccaggttcaggtcggactagggtcggtcgngggaactagtaattccgacttcgtacaacccgtataccgtaagcgtacgtccctgtacagttcagtagttatttacgacttaggttttacacgttggacttagaacgttacgtaacttaacgttaacccggttcgggtaaccccgggtacccggggtaaccggttcccgggtaaaccggtaaaggggtaacccgtaaaagggggttccggttaaaacttaaacccgggaaaccgtaaggtttggtacccggacgtttaccgaacccggtaccttactttgggttaaccg

SEQ ID NO: 258240 - DNA, 783 bp, Homo sapiens
  misc_feature: GYAE6OF01C0OVO.34.88.H11.1.454.CMB.1.raw
  modified_base (209)..(209): a, c, t, g, unknown or other
  misc_feature (209)..(209): n is a, c, g, or t
tcagtacacgtgatcacgaccggtgctcgatttagcgacagcgagaacacacgaaagggggaggaactgctcagttaggacccagacggaaccatggaagccccagcgcagcttctcttcctcctgctactctggcctcccagataccactggaagaaatagtgatgacgcagtctccagccaccgtgtctgtgtctaccgaggggaanacgtccacccgtctccgtgcgacggccagccagtagttcgtagcagctaacgttggcctggtaccagccaacgtaaccgtcggccgacggccttaccccgagtcccttcctacgacgttcgtacgtcggtacgaccctaacgtacccgaaccggtccgggtacccctaacggttcggtaaccctcccggagtaccgtaaggttccaagggtcggacgtagggttcgggtacgtacgggaccttaaggtaccctttccgaccttccacctaacctacgtaccacgtaccacgcctagacgtacgttcgtaagtagtttactttacggtacgtttacgtttttaactacgtacgttacgaacggttaacgtaagtttaacgtaacgttaccggttaccggggttaccccgggttaccggggttaacccggttacccggggtaaaccggtaaacggggttaaccggtaaacggggttaacggttaaacgttaaacccggtaaaaaccgggttccggttaacgggttccgggttaacgtaacccggtaaccttaacccggtacggtttcgttacccgg

SEQ ID NO: 258241 - DNA, 863 bp, Homo sapiens
  misc_feature: GYAE6OF01EMC3F.34.88.H11.1.454.CMB.1.raw
  modified_base (207)..(207): a, c, t, g, unknown or other
  misc_feature (207)..(207): n is a, c, g, or t
  modified_base (319)..(319): a, c, t, g, unknown or other
  misc_feature (319)..(319): n is a, c, g, or t
tcagtacacgtgatcacgaccggtgctcgatttagcgacagcgagaacacacaaagggggagaactgctcagttaggacccagacggaaccatggaagccccagcgcagcttctcttcctcctgctactctggctcccagataccagtggagaaatgtgatgacgcatctccagccaccgttgtctgtgtctaccgaaggggaaaanactccacccgttctcctagcgtaggcccagccagagtgttacgcagctaacgttggcctaggtacccagacgacgaaaccgtcggaccagggcccttacccgaacggtcccncccttacgacttaccgtaagtcggggtttacacctaccttacccaccgtacgggtccccgtaaacgttccgggttaactaccccgacggtaccctaacgggtttacgaacggggttacggtaaccggtggttaccgggggttaccggtagggggtaacccgtaaacgggttaaacttcccgtaaccgtttacctacccgtaaccctaacgttcctaacggaccggtacccggtaaccccttacgggtcgtaacgggttacccgttaaggttaaaccgggttttaattttccggttaactttaaacggtttttaccgttttaacggtcgtttaacgacgggttaacctaagtttaaacgtttaaacgtaacccgttccgggttaaccccggggttccgggggtaacccggtttaccgggtaaccccggtaaacggggtaacccgggttaacgggtaacggttaaacccgttaaaccggtaaaaccggtacgttaaggtacccgggtacgtacccgggtacccaccttccgttaaccgtttaccgg

SEQ ID NO: 258242 - DNA, 878 bp, Homo sapiens
  misc_feature: GYAE6OF01AI7Y7.34.88.H11.1.454.CMB.1.raw
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaagagtcaccctctcctgcgagggccagccagagtgttagcagcaacttggcctggtaccagcaagaaccgtggaccaggcctcccaggcctcctcactcgtagtcggtgaccactccccgaccgacggggaccctacgttacgggtacctcccccggtaggacccgtaggggtttaccgaacgggttcggggtaccgtaagggggttcgggttaccggttacggggggtaaacctaaacggggttaaacctttcccgaacccgtttcccttaaccccgaacccgttaacgttcccgaacgggtacccctaaccgggtccccgtttaacgggccggttaacgggtttacccgtaaggggtttaaaccggtttacggttttttaccggaaccgttttaagggtttttttaacccttaacccggtttcggttaacccggtaacgttaacccgtaaacgttttaaacgttaaaccggtttaaccggtccggggttacccccgggttaaccggggggttacccggtttacccggggaaaccggttaaaaccgggggaaacccggttaaacgggggtttaacggtaaaccgggtttaaccgtaaaacccgggttaacgttcgggtaaacccgggtccgttacgggtaccccttaaacccgttcgtttaccggtttacccg

SEQ ID NO: 258243 - DNA, 728 bp, Homo sapiens
  misc_feature: GYAE6OF01CGWJG.34.88.H11.1.454.CMB.1.raw
  modified_base (220)..(220): a, c, t, g, unknown or other
  misc_feature (220)..(220): n is a, c, g, or t
  modified_base (275)..(275): a, c, t, g, unknown or other
  misc_feature (275)..(275): n is a, c, g, or t
  modified_base (707)..(707): a, c, t, g, unknown or other
  misc_feature (707)..(707): n is a, c, g, or t
  modified_base (718)..(718): a, c, t, g, unknown or other
  misc_feature (718)..(718): n is a, c, g, or t
  modified_base (722)..(722): a, c, t, g, unknown or other
  misc_feature (722)..(722): n is a, c, g, or t
tcagtacacgtgatcacgaccggtgctcgatttagcgacagcgagaacacacaaagggggagaactgctcagttaggacccagacggaaccatggaagccccagcgcagcttctcttcctcctgctactctggcctccagaccaccacgtggaagaaatagtgatgacgcgagtcctccagcccacccgttgtcgtgtcgtcctaccggaaggggaaacncgcccacccttctccgtggaccgacgggccagtacgacggtagttcggtcggacncgactaacgttcgccgtaggtaaccaggaccgtaacgtaaccgcggaccgacggcctacccgagtaccgtccgtacaatttccgtaacgtctaccgtaaccactacccgaaccggacggtaccctacggttcaccgttaccgttaccgaccgttaccgtaacggttcgaacggtcggtaccggtacgggtccgggtacggtacgggtaaacgtaacggttacgtttacccaaccgtttccgaccctaaccggtacgtaccggaacgtaccggacccgttccgtacggccgttacggtaccgtaaggtacgtttaccgttcgtaccgttaactttacgtttaacgtccgtgtaaccgtagtaccgtagtacgttaaggtacggttcgtacggtcgtaccggtcgaacgacggacgtagtacgactaccgtaanccgtgtaccgnacgntacgtg

SEQ ID NO: 258244 - DNA, 842 bp, Homo sapiens
  misc_feature: GYAE6OF01A2CWG.34.88.H11.1.454.CMB.1.raw
  modified_base (205)..(205): a, c, t, g, unknown or other
  misc_feature (205)..(205): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggcctcccagatacccatggagaaatagtgatgacgcagtctaccagccacgtgtctgtgtctacgagggaancgccacctctcctgacgacggccacgtacaggtacgtgttggcagactaacttacgcctcgggtaaccagtaccaacgtaacccgtacggacccgacgggtcccctacccgaacgtacccgttcccctaacgaccgtttacctaagttccggtacccttaacccgttaccctaccccggtaaacccggaccggggacccctaccgtccggttaacccttttacccgttaccccaacgggtaccccgttacggggtttacccgagggtttacgggggtaaccgttacggggggtttaccggggggtacccggttaacgggggtaaacccgttaacggggtttaaccggtttaccccctaaaccggggttttcccccaaccccgtaaacccgttaaccgtacccgaacggtaaccccggtacgtacccgtaccgtaacccggttacgtccggttaaacgaaacggtttcttaaccgtcgttaacctttacgttttacttaacgtccgtagaccgttagtacgttaacttaacggtaagtccgggttacgccggttacggtccgacggtaaacgggtacgtagggaacggtaaacctacggaaacgttacgggtgtacgggacctacgaccgcgttacgg

SEQ ID NO: 258245 - DNA, 662 bp, Homo sapiens
  misc_feature: GYAE6OF01B3LVD.34.88.H11.1.454.CMB.1.raw
  modified_base (163)..(163): a, c, t, g, unknown or other
  misc_feature (163)..(163): n is a, c, g, or t
  modified_base (175)..(175): a, c, t, g, unknown or other
  misc_feature (175)..(175): n is a, c, g, or t
  modified_base (227)..(227): a, c, t, g, unknown or other
  misc_feature (227)..(227): n is a, c, g, or t
  modified_base (329)..(329): a, c, t, g, unknown or other
  misc_feature (329)..(329): n is a, c, g, or t
  modified_base (633)..(633): a, c, t, g, unknown or other
  misc_feature (633)..(633): n is a, c, g, or t
  modified_base (641)..(641): a, c, t, g, unknown or other
  misc_feature (641)..(641): n is a, c, g, or t
  modified_base (652)..(652): a, c, t, g, unknown or other
  misc_feature (652)..(652): n is a, c, g, or t
tcagtacacgtgatcacgaccggtgctcgatttagcgacagcgagaacacacaaagggggaggaactgctcagttaggacccagacggaacatggaacgccccagcgcagcttctcttcctcctgctactctggctccagactaccacgtggaagaaatagtnatgacgcagtcnccagccacgtgtctgtgtcctacggaaggggaaagcgtaccaccctctccgngaccgacggccagccagagttagtagcaggactaacgttcggccgtaggtaccagactaacgaacccgtgacccgacggtcctacccgcggtcctccgttanacttccaggtctacgctacacccgaacgccggtacgactcggtacctcccgacgtccgtaggtacgtaggtgacggtggttcgggcgttagggaacctagttactcctactcacgtaccataccgagaccgcgtacgtacggactacgtgtagtaagttactttggttacttagtttaacctttagccttaacgtacgtaagtaacgttaacgtaagttaacccgggttcgttacccgggttacgggtaaccggttccggaacggaccggtaaacgtggtaacggtaataacggacgttaacgnggtaccgngtacacgtccnttacccgtcg

SEQ ID NO: 258246 - DNA, 721 bp, Homo sapiens
  misc_feature: GYAE6OF01DSW4F.34.88.H11.1.454.CMB.1.raw
  modified_base (202)..(202): a, c, t, g, unknown or other
  misc_feature (202)..(202): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctccagacaccactggagaaatagtgatgacgcagtctccagccacctgtctgtgtctccaggggaancgccacctctcctgcagggccagtcagagtgttggactagcctaacttaggcccttaggtaccaagcaacgaaaccgtggaccaggcctcccgagacgtcctccgatctaatcgcctacactccaaccgtacgggcctaactgtccttacttaccgacgtccgtaaggttccgagtcggacctagggtcgggtctcggggtacacgggttagttcccgaacttccgtaccgtaaccctaagttaccgacgtaccgtaacgccctttacgggactaacggttcgttacggtaaacggttactttcgtacggttacctttaaacttttacgtttaaccgtggttacccaggttacgtacgttaacttaaggtaacggttccgggaccggtttaccggggtaacccggtttccgggacccggttaaaacgggggaccgtaaaggggttaacggtaaaaccgtaacgaaaaccgtaacccgggttgtaaccgggtacggttacgaacccgtaccgttaaaccg

SEQ ID NO: 258247 - DNA, 775 bp, Homo sapiens
  misc_feature: GYAE6OF01B9Y4Q.34.88.H11.1.454.CMB.1.raw
  modified_base (752)..(752): a, c, t, g, unknown or other
  misc_feature (752)..(752): n is a, c, g, or t
tcagtacacgtgatcacgaccggtgctcgatttagcgacagcgagaacacaacaaagggggaggaactgctcagttaggacccagacggaaccacggaagccccagcgcagcttctcttcctcctgctactctggctcccagactaccactggaagaaattagtgatgacgtcagtctccagccacgtgtctgtcgtctcgaggggaagacgtccacctctctgcgacggccagccgagagtcgtagcagctaacgttcggacctcggtaccagactaacgaaaccgtcgaccgagccctaccggacgtcctccgtactacgttcgtaggttcggtcgacctaccgtaccccgaacggaccgggtccctaacggtttccggtaccgtacccgtacggtcccgttaggttacgaggttcgggtacggttacgggtcggggtaaccgtagggtaactaacgttacgttacccgaccttccgtacctaaccgtgtaccgtacggcgttaccgcgttacgaccgttagtacgttaaggttaacttttcgttttacgtaactttacggttttaatcgtacgtaagtaacgtaacttaagttaacttaaccgggtacgttacccgggttacccggggttacgggtaacgttacccggggaaacggttaacggggaaacccgttaaggggtaacgttaaacgtaacccggaaacgggtttaccggaggttaaccggccgtaaccgtacgttaaaccgtntttacccgttcgtttaaccccgg

SEQ ID NO: 258248 - DNA, 499 bp, Homo sapiens
  misc_feature: GYAE6OF02FMFUZ.34.88.H11.1.454.CMB.1.raw
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaagagtcaccctctcctgcagggccagccagagtgttagcagcaacttggcctggtaccagcagaaacctggccaggctcccaggctcctcatctatggtgcatccaccagggccactggtatcccagccaggttcagtggcagtgggtctgggacagaattcactctcaccatcagcagcctgcagtctgaagtattttgctagtttattactgtcagcagtataataactgcctcgggacgttcggccagggaccaaggtggaattacaaacgtactagtggctgcaccatctcg

SEQ ID NO: 258249 - DNA, 518 bp, Homo sapiens
  misc_feature: GYAE6OF02IBR7J.34.88.H11.1.454.CMB.1.raw
  modified_base (304)..(304): a, c, t, g, unknown or other
  misc_feature (304)..(304): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaagagtcaccctctcctgcagggccagccagagtgttagcagcaacttggcctggtaccagcagaaacctggccaggctcccaggctccctcatctatggtncatccaccagggccactggtatcccagccaggttcagtggcagtggctgggacagatcactctcacatcagcagcctgcagtctagaagtattttgctagtttattactgtcagcagtataataactggccgtccgggacgttcggccgtaagggaccgaagggtggtaacttacgaaacgtaacgtaggtcggacgtgacaccgtactctacg

SEQ ID NO: 258250 - DNA, 523 bp, Homo sapiens
  misc_feature: GYAE6OF02I6VCY.34.88.H11.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagacaccactggagaaatagtgatgacgcagtctccagccaccctgtctgtgtctccaggggaaangccaccctntcctgcagggccagtcagagtgttggcagcaacttagcctggtaccagcagaaacctggccaggctcccagagtcctcatctatgctacatccaccagggccactgctattccagccagttcagtggcagtggtctgggacagagttcactctcaccatcagcagctgcagtctgaagattctgctactttattactgtacagtctagtctaaagttagtcggtaccgtggtaccgttcggaccgtaacggggaccaagggttacggaaacgttacgaaacggactaggtacggacgtagaccactacg

SEQ ID NO: 258251 - DNA, 513 bp, Homo sapiens
  misc_feature: GYAE6OF02HL7NJ.34.88.H11.1.454.CMB.1.raw
  modified_base (206)..(206): a, c, t, g, unknown or other
  misc_feature (206)..(206): n is a, c, g, or t
  modified_base (359)..(359): a, c, t, g, unknown or other
  misc_feature (359)..(359): n is a, c, g, or t
  modified_base (400)..(400): a, c, t, g, unknown or other
  misc_feature (400)..(400): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagacaccactggagaaattagtgatgacgcagtctccagccaccctgtctgtgtctccaggggaaanaggccaccctctcctgcagggccagtcagagtgttggcagcaacttagcctggtaccagcagaaacctggccaggctcccagagtcctcatctatgctacgatccacagggccactgctatccagccaggttcagtgcagtgggtctgggacngagttcactctcaccatcagcagcctagcagtctagaagtnttctgctactttattactgttacagcagtctaataaggtgccgtggacgttcggaccgaaggggaccaagggtaggaaatcgaaacgtacttggtaggacttggccacctacg

SEQ ID NO: 258252 - DNA, 495 bp, Homo sapiens
  misc_feature: GYAE6OF02FNRJQ.34.88.H11.1.454.CMB.1.raw
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaagagtcaccctctcctgcagggccagccagagtgttagcagcaacttggcctggtaccagcagaaacctggccaggctcccaggctcctcatctatggtgcatccaccagggccactggtatcccagccaggttcagtggcagtgggtctgggacagaattcactctcaccatcagcagcctgcagtctgaagtattttgctagtttattactgtcagcagtataataactggcctcgggacttcggccgaggaccaaggtggaattacgaaacgatgtgctgcacatctcg

SEQ ID NO: 258253 - DNA, 550 bp, Homo sapiens
  misc_feature: GYAE6OF02IZ5RV.34.88.H11.1.454.CMB.1.raw
  modified_base (415)..(415): a, c, t, g, unknown or other
  misc_feature (415)..(415): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttggcagcaacttagcctggtaccagcagaaacctggccaggctcccagacgtccctcatctatgcctacactcccaccgagggcccacgtgctattccagccaggttcagtggcaggtgggtctggggacaggtacgttcactctacacctatcagcacgcctgcagtctagaagtnttctgactactttattactgtacagtctagttactaataggtcggtccgtgggtacgttcggaccgtaaggggaccctaagggtacggaaattaccggaaacgtacgttaggtacggtactcggacgtacctacg

SEQ ID NO: 258254 - DNA, 696 bp, Homo sapiens
  misc_feature: GYAE6OF02J3RER.34.88.H11.1.454.CMB.1.raw
  modified_base (211)..(211): a, c, t, g, unknown or other
  misc_feature (211)..(211): n is a, c, g, or t
  modified_base (223)..(223): a, c, t, g, unknown or other
  misc_feature (223)..(223): n is a, c, g, or t
  modified_base (388)..(388): a, c, t, g, unknown or other
  misc_feature (388)..(388): n is a, c, g, or t
  modified_base (464)..(464): a, c, t, g, unknown or other
  misc_feature (464)..(464): n is a, c, g, or t
tcagtacacgtgatcacgaccggtgctcgatttagcgacagcgagaacacacaaaggggaggaactgctcagttaggacccagacggaaccatggaagccccagcgcagcttctcttcctcctgctactctggcctcccagataccactggagaaatagtgatgacgcagtctccagcccaccgtgtctgtcgtactccgaaggggaaacngttccacccctntccgtgccgagggcccaggcccagagttgttagccagcctaacgttcggccttggacccaggccaaggaaaccctgggacccagggccctccccgaggtccctcctcaacgtcttagtcggtacacctacgtccccgaccggtagggccctacgtacggttaccncccgtacgcccgtagggttccaggtcggaccgtagggttcgggtactagggactacgtacttcgactcgtacactntcgagcctacgcctgcgtacgtcgtagtagttctttgactttacgtttactactcggtaccgagtaccgtaagtttaacgtaacgtaccggttccggggtaccgttacccggggtacgttaccggaaccgggttaacgggaccggttaagggtaacgggttaacctaaccggtaaaccggtccggttaggtcggtaccgtaccggtactaaccggttacgtcgtttacccgg

SEQ ID NO: 258255 - DNA, 520 bp, Homo sapiens
  misc_feature: GYAE6OF02GVVLP.34.88.H11.1.454.CMB.1.raw
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaagagtcaccctctcctgcagggccagccagagtgttagcagcaacttggcctggtaccagcagaaacctggccaggctcccaggcctcctcatctatggtgcatccaccagggccactggtactcccagccaggttcaggtggcagtgggtctggggacagacttcactctcaccactccaccagactggacgcctagaagtatttgctagttgttattactgtacaactagttggtctcacactacgtggacgttcggaccgaacgggaccgaaggtaggaaacgtacaaacgaactgtagcgtgcacactctgtc

SEQ ID NO: 258256 - DNA, 596 bp, Homo sapiens
  misc_feature: GYAE6OF02IZTFO.34.88.H11.1.454.CMB.1.raw
  modified_base (205)..(205): a, c, t, g, unknown or other
  misc_feature (205)..(205): n is a, c, g, or t
  modified_base (306)..(306): a, c, t, g, unknown or other
  misc_feature (306)..(306): n is a, c, g, or t
  modified_base (425)..(425): a, c, t, g, unknown or other
  misc_feature (425)..(425): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaangtcaccctctcctgcagggccagccagagtgttagcagcaacttggcctggtaccagcaagaacctggccaggcctcccgaggcctcctcatctagtggtnctatcccaccgagggcccagtgtactcccagcccgtaggttcaggtcggctaggtcgggtcgtagggacaggtacttcactctacacctatcagcacgcctgctacgtctagtaagttnttttcgacttagtttacttactgttctagtactaagttaattaaactacgtcggtacccggttaccggggtacgttccgggaccggaacgggtaaccgtaacgggtacggtaacttaacggaaaccgtacgtacggtacggtacgttaggacctaaccgtacttcgttacg

SEQ ID NO: 258257 - DNA, 525 bp, Homo sapiens
  misc_feature: GYAE6OF02I6U1P.34.88.H11.1.454.CMB.1.raw
  modified_base (205)..(205): a, c, t, g, unknown or other
  misc_feature (205)..(205): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaangtcaccctctcctgcagggccagccagagtgttagcagcaacttggcctggtaccagcagaacctggccaggctcccaggcctcctcatctatggtgcatcccaccagggcccacgtggtatcccagccaggttccagtggcaggtgggtctgggacagaattcactctcacatcagcagcctgcagtctgaagtatttgcttagtttattactgtctagctagtataatacttcggccgtccggggtacgttcggaccacgggacctaagggtggtaagttacgaaacgacgttggtacggtctgaccacgtactctcg

SEQ ID NO: 258258 - DNA, 550 bp, Homo sapiens
  misc_feature: GYAE6OF02IAAYM.34.88.H11.1.454.CMB.1.raw
  modified_base (204)..(204): a, c, t, g, unknown or other
  misc_feature (204)..(204): n is a, c, g, or t
  modified_base (299)..(299): a, c, t, g, unknown or other
  misc_feature (299)..(299): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaangtcaccctctcctgcagggccagccagagtgttagcagcaacttggcctggtaccagcagaacctggccaggctccagctcctcatctagtggtncactccaccgagggccacgtggtactcccagccctagggttcaggtggctaggtgggtctggggacagtacttcacttctcaccatcagcacgcctgctagtctagaagttattttgacttagttttattactgtcagtactagtataatacgtcggtccgtcgggtacgttccggaccgaacgggtaccgtaagggtcggtaacgttacgaaacgtacgtggtacggcgtacgaccacctacgtcttacg

SEQ ID NO: 258259 - DNA, 557 bp, Homo sapiens
  misc_feature: GYAE6OF02H4GKM.34.88.H11.1.454.CMB.1.raw
  modified_base (156)..(156): a, c, t, g, unknown or other
  misc_feature (156)..(156): n is a, c, g, or t
  modified_base (222)..(222): a, c, t, g, unknown or other
  misc_feature (222)..(222): n is a, c, g, or t
  modified_base (226)..(226): a, c, t, g, unknown or other
  misc_feature (226)..(226): n is a, c, g, or t
  modified_base (299)..(299): a, c, t, g, unknown or other
  misc_feature (299)..(299): n is a, c, g, or t
  modified_base (308)..(308): a, c, t, g, unknown or other
  misc_feature (308)..(308): n is a, c, g, or t
  modified_base (315)..(315): a, c, t, g, unknown or other
  misc_feature (315)..(315): n is a, c, g, or t
  modified_base (351)..(351): a, c, t, g, unknown or other
  misc_feature (351)..(351): n is a, c, g, or t
  modified_base (377)..(377): a, c, t, g, unknown or other
  misc_feature (377)..(377): n is a, c, g, or t
  modified_base (396)..(396): a, c, t, g, unknown or other
  misc_feature (396)..(396): n is a, c, g, or t
  modified_base (403)..(403): a, c, t, g, unknown or other
  misc_feature (403)..(403): n is a, c, g, or t
  modified_base (410)..(410): a, c, t, g, unknown or other
  misc_feature (410)..(410): n is a, c, g, or t
  modified_base (429)..(429): a, c, t, g, unknown or other
  misc_feature (429)..(429): n is a, c, g, or t
  modified_base (470)..(470): a, c, t, g, unknown or other
  misc_feature (470)..(470): n is a, c, g, or t
  modified_base (530)..(530): a, c, t, g, unknown or other
  misc_feature (530)..(530): n is a, c, g, or t
  modified_base (536)..(536): a, c, t, g, unknown or other
  misc_feature (536)..(536): n is a, c, g, or t
  modified_base (552)..(552): a, c, t, g, unknown or other
  misc_feature (552)..(552): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggcctcccagatacccacgtgganaaatagtgatcgacgctagtcctccagcccaccgtgtctgtgtcctacgaggggaagtccaccctntccngacgaggcagccagtgtgtagcagctaacgttgcctggaccagcagaacctggcaggcctccgagcctacctnactcgtacnggtcacnctccacgaggccatcggtacccctagcctacggttnaggtgacaggtcgggtctcggggaanacgtattcccatcctcacntcacgtnacgcgtncgactgagtaactgttttncgtaattttacgtatcgtcagtactggtaaatcgttaacgngtacccggtagggaaccgttccgacgaacggttacgacggtggtaactccgaaactcggngtacgnggtactcgaactcgtntaccg

SEQ ID NO: 258260 - DNA, 566 bp, Homo sapiens
  misc_feature: GYAE6OF02H5D8A.34.88.H11.1.454.CMB.1.raw
  modified_base (207)..(207): a, c, t, g, unknown or other
  misc_feature (207)..(207): n is a, c, g, or t
  modified_base (298)..(298): a, c, t, g, unknown or other
  misc_feature (298)..(298): n is a, c, g, or t
  modified_base (309)..(309): a, c, t, g, unknown or other
  misc_feature (309)..(309): n is a, c, g, or t
tcagtacacgtgatcacgaccggtgctcgatttagcgacagcgagaacacacaaaggggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaagngtcaccctctcctgcagggccagccagagtgttagcagcaacttggcctggtaccagcaagaacctggccaggcctcccgaggcctccctnatctagtggtncactcccaccgagggcctacgtggtactcccagcctaggttcaggtggcaggtgggtctgggacagtattccactctacacactcagcacgcctgctagtctagtaagttatttgacttagtttattactcgtcagtactagtaattaagtacgttcggtcccggtaccggggtacgttaccgggaccgtaacgggaccgtaagggtcggtaacttacgaaacgtacgtggtacggtcgtcgaccacgtactgtacg

SEQ ID NO: 258261 - DNA, 530 bp, Homo sapiens
  misc_feature: GYAE6OF02GIGO9.34.88.H11.1.454.CMB.1.raw
  modified_base (378)..(378): a, c, t, g, unknown or other
  misc_feature (378)..(378): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaagagtccaccctctcctgcagggccagccagagtgttaatagcatctacttagcctggtaccagcagaacctggccagcctcccagacctcctcattaagtggtgcatactacgacgggcccctggccatcccagacaggttcagtggcaggtggtctgggacagacttcactcncaccatcaccagactggacgtcctagaagtatttgctagttgtattactgtacaacgtagttggtctcacacgtacgtaggacgttcgaccgaagggaccgaggtacggaaactacgaaacgtaacgtgtaggcgtcgacaccatctgttcc

SEQ ID NO: 258262 - DNA, 539 bp, Homo sapiens
  misc_feature: GYAE6OF02IKG2Y.34.88.H11.1.454.CMB.1.raw
  modified_base (205)..(205): a, c, t, g, unknown or other
  misc_feature (205)..(205): n is a, c, g, or t
  modified_base (534)..(534): a, c, t, g, unknown or other
  misc_feature (534)..(534): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaanagtcaccctctcctgcagggccagccagagtgttagcagcaacttggcctggtaccagcagaaacctggccaggctcccagactcctcattaatggtgcatactacgacgggcccctggcactcccagcaggttcagtgcagtgggtctgggacagtacttcgacttctcaccatccaaccagactaggacgacctagaagtattttgactagtgtattactgtacagtagttgtctacactacgtacgtaggtacgttcggaccgaaggaccgaaggtagaacgtacgaaacgacgtagtagtacgtacgctaaccacttcgtcgttntaccg

SEQ ID NO: 258263 - DNA, 510 bp, Homo sapiens
  misc_feature: GYAE6OF02GZ0DE.34.88.H11.1.454.CMB.1.raw
  modified_base (507)..(507): a, c, t, g, unknown or other
  misc_feature (507)..(507): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaagagtcaccctctcctgcagggccagccagagtgttagcagcaacttggcctggtaccagcagaacctggccaggctcccaggctcctcatctatggtgcatcccacagggccactggtactcccagccaggttcagtggcaggtgggtctgggacagattcactctcacatcagcagcctgcagtctgaagtattttgctagtttattactgtcagctagtataatacgtgtccgtcggacgtccgtcgacggacgtacggtaggtactacgtaacgaacgtagtcggtcgtagcgtacactntcg

SEQ ID NO: 258264 - DNA, 539 bp, Homo sapiens
  misc_feature: GYAE6OF02HZFB7.34.88.H11.1.454.CMB.1.raw
  modified_base (205)..(205): a, c, t, g, unknown or other
  misc_feature (205)..(205): n is a, c, g, or t
  modified_base (301)..(301): a, c, t, g, unknown or other
  misc_feature (301)..(301): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaanagtcaccctctcctgcagggccagccagagtgttagcagcaacttggcctggtaccagcagaacctggccaggctccaggctcctcatctatggtncactcccaccaggggccactggtactcccagccaggttcagtggcagtgggtctgggacagaattcactctcacatcagcagcctgcagtctagaagttagttttgacttagtttattactgtcagtctagtataatacgtcggtccgtccgggacgttccggaccgtaacgggaccgtaagggtcggtaacttacgaaacgtaacgtggtacgtcgtacggacctacgtactgttcg

SEQ ID NO: 258265 - DNA, 697 bp, Homo sapiens
  misc_feature: GYAE6OF02HW5ON.34.88.H11.1.454.CMB.1.raw
  modified_base (207)..(207): a, c, t, g, unknown or other
  misc_feature (207)..(207): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagcccaccgtgtctgtgtctccgaggggaaangtccaccctctcctgcagggcagccagagtgttagcagcaacttggcctggtaccagcaagaacctggccaggcctcccgaggcctccctacatctagtggtgcacttcccgaccgacgggccctacgtcggtactcccgagacccaggttcaggttggccgtaggtcggggtcgtacggggaactaggtaacttccgaacttcctaccacctactccgaacgacgtacgacccgttgacctaggtaccgttaaggtaaacgttagtttttagaccgtttagtttttaactaccgttagttaccgtaagtcgttaaaggtacttaaaagttaaccggttcgggtacccgggttaccgggggtaaccggtttccgggaaccgtaacgggggtaccgttaaacggggtaagggtaaccgtttaaacccggaaaccggtaaacggtttcggtaacggccgttacggaacccgtaaccttaccgttcgttacgg

SEQ ID NO: 258266 - DNA, 508 bp, Homo sapiens
  misc_feature: GYAE6OF02GQW7B.34.88.H11.1.454.CMB.1.raw
  modified_base (205)..(205): a, c, t, g, unknown or other
  misc_feature (205)..(205): n is a, c, g, or t
  modified_base (504)..(504): a, c, t, g, unknown or other
  misc_feature (504)..(504): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaanagtcaccctctcctgcagggccagccagagtgttagcagcaacttggcctggtaccagcagaaacctggccaggctcccaggctcctcatctatggtgcatcccaccgagggcccactggtatcccagccaggttcagtgcagtggtctgggacagaattcactctcaccatcagcagcctgctagtctagaagtatttgactagtttattactgtcagtcagtataatactggcctcgggacttcggccagggaccaaggtggaattcgaaacgtacgtgtacggctagccactagtntacg

SEQ ID NO: 258267 - DNA, 624 bp, Homo sapiens
  misc_feature: GYAE6OF02JCDN4.34.88.H11.1.454.CMB.1.raw
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
  modified_base (305)..(305): a, c, t, g, unknown or other
  misc_feature (305)..(305): n is a, c, g, or t
  modified_base (392)..(392): a, c, t, g, unknown or other
  misc_feature (392)..(392): n is a, c, g, or t
  modified_base (423)..(423): a, c, t, g, unknown or other
  misc_feature (423)..(423): n is a, c, g, or t
  modified_base (612)..(612): a, c, t, g, unknown or other
  misc_feature (612)..(612): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaangtcaccctctcctgcagggccagccagngtgttagcagcaacttggcctggtaccagcagaaacctggccaggcctcccgaggcctcctcatctatggtncactcccaccgagggccctacgtcggtactccccgagccctagggttcaggtcggactaggtgggtctgggacaggaacttcactcncaccatcagcacgcctgcagtctaggaattnttttgacttagttttacttacgtgtacgagtactaagtttaataacgtttaaccgcgggttaccccggttaccggggtaccgtttaccgggacccggtaaggggtaaccccgtaaggggttacggtaaaccgtttaaccggaaaacggttaccgttaggttacgggaccgttacggaccctaaccgttnttacccgttacg

SEQ ID NO: 258268 - DNA, 513 bp, Homo sapiens
  misc_feature: GYAE6OF02FM5CR.34.88.H11.1.454.CMB.1.raw
  modified_base (205)..(205): a, c, t, g, unknown or other
  misc_feature (205)..(205): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaanagtcaccctctcctgcagggccagccagagtgttagcagcaacttggcctggtaccagcagaaacctggccaggctcccaggctcctcatctatggtgcatccaccagggccactggtatcccagccaggttcagtggcagtggtctgggacagaattcactctcaccatcagcagcctgcagtctagaagtattttgctagtttattactgtcagctagtataataacgtgccgtccgggtacgttcggccgagggaccaagggtcggaattacgaaacgtactggtacggctagcaccgtatctcg

SEQ ID NO: 258269 - DNA, 596 bp, Homo sapiens
  misc_feature: GYAE6OF02FPZMI.34.88.H11.1.454.CMB.1.raw
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaagagtcaccctctcctgcagggccagccagagtgttagcagcaacttggcctggtaccagcagaaacctggccaggctccaggctcctcatctatggtgcatccaccagggccactggtactcccagcctaggttcagtggcaggtgggtctggggacaggtaattcactctcaccatcagcagcctgctgtctagtaagtattttgactagttttattaccgtgttcagtctagttataacgttaactcgggtaccgttacccggggtacgtttaccgggaccgtaaggggaccccgtaaggggttcgggtaaacgtttaccggaaaaccggttaacgttacggtacgggttaccgttaccgggacccgtaacccgtagttaccgtttacgg

SEQ ID NO: 258270 - DNA, 522 bp, Homo sapiens
  misc_feature: GYAE6OF02JIF90.34.88.H11.1.454.CMB.1.raw
  modified_base (205)..(205): a, c, t, g, unknown or other
  misc_feature (205)..(205): n is a, c, g, or t
  modified_base (392)..(392): a, c, t, g, unknown or other
  misc_feature (392)..(392): n is a, c, g, or t
  modified_base (401)..(401): a, c, t, g, unknown or other
  misc_feature (401)..(401): n is a, c, g, or t
  modified_base (428)..(428): a, c, t, g, unknown or other
  misc_feature (428)..(428): n is a, c, g, or t
  modified_base (498)..(498): a, c, t, g, unknown or other
  misc_feature (498)..(498): n is a, c, g, or t
  modified_base (505)..(505): a, c, t, g, unknown or other
  misc_feature (505)..(505): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagatatcaccggagaaattgtgttgacacagtctccaggcaccctgtctttgtctccaggggaaangccaccctctcctgcagggccagtcagagtgttaatagcatctacttagcctggtaccagcagaaacctggccagcctccagactcctcattaatggtgcatactacagggcccctggcatcccagacaggttcagtgcagtgggtctgggacagacttcactctccaccatccaccagactggacnctagaagtntttgctagttgtaattctgtactaacngttggtctcacactacggtgacgttcggaccgaagggaccaaggtgaaactcgaaacggtactggtcgtntgacacncttctcgttcttactac

SEQ ID NO: 258271 - DNA, 552 bp, Homo sapiens
  misc_feature: GYAE6OF02GQZC2.34.88.H11.1.454.CMB.1.raw
  modified_base (205)..(205): a, c, t, g, unknown or other
  misc_feature (205)..(205): n is a, c, g, or t
  modified_base (410)..(410): a, c, t, g, unknown or other
  misc_feature (410)..(410): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaanagtcaccctctcctgcagggccagccagagtgttagcagcaacttggcctggtaccagcagaaacctggccaggctcccaggcctcctcatctatggtgcatccaccgagggcccacgtggtactcccgagcccaggttcaggtggcaggtgggtctgggacagtaattcactctcaccatcagcagcctgcagtctagaagttnttttgcttagtttattactgtcagactagtaataagtacgtcggtccggttccgggtaccgttccgggaccgtaagggaccgtaagggtacggtaacttaccgaaacgtacgtggtcggtacgtcgacctacgtactcttcg

SEQ ID NO: 258272 - DNA, 494 bp, Homo sapiens
  misc_feature: GYAE6OF02IGL69.34.88.H11.1.454.CMB.1.raw
  modified_base (205)..(205): a, c, t, g, unknown or other
  misc_feature (205)..(205): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaangtcaccctctcctgcagggccagccagagtgttagcagcaacttggcctggtaccagcagaaacctggccaggctcccaggctcctcatctatggtgcatccaccagggccactggtatccagccaggttcagtggcagtggtctgggacagattcactctcacatcagcagctgcagtctgaagtattttgctagttttattactgtcagcagtataataactggcctcgggacgttcggccgaggaccgaaggtggtaatcgaaacgacgtgtgctgacacatctcg

SEQ ID NO: 258273 - DNA, 521 bp, Homo sapiens
  misc_feature: GYAE6OF02GX27T.34.88.H11.1.454.CMB.1.raw
  modified_base (205)..(205): a, c, t, g, unknown or other
  misc_feature (205)..(205): n is a, c, g, or t
  modified_base (305)..(305): a, c, t, g, unknown or other
  misc_feature (305)..(305): n is a, c, g, or t
  modified_base (398)..(398): a, c, t, g, unknown or other
  misc_feature (398)..(398): n is a, c, g, or t
  modified_base (408)..(408): a, c, t, g, unknown or other
  misc_feature (408)..(408): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaanagtcaccctctcctgcagggccagccagagtgttagcagcaacttggcctggtaccagcagaaacctggccaggcctcccaggcctcctcatctatggtncatccaccgagggcccacgtggactcccagccaggttcaggtgcaggtgggtctggggacagtaacttcgactctcaccatcagcagcctgcngtctgaagtntttgcttagtttattactgtcagctagtataatacgtgccgtccgggacgttcggaccgtagggactaagggtgaacttacgaacgtacgtgtacggctgaccactatcgtcg

SEQ ID NO: 258274 - DNA, 625 bp, Homo sapiens
  misc_feature: GYAE6OF02GT3S1.34.88.H11.1.454.CMB.1.raw
  modified_base (205)..(205): a, c, t, g, unknown or other
  misc_feature (205)..(205): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaanagtcaccctctcctgcagggccagccagagtgttagcagcaacttggcctggtaccagcaagaaacctggccaggctccaggcctcctcatctatggtgcatactacacgggcccctggccatcccgagacaggttcaggtgctaggtggtctgggacaggacttcgactcgtaccaccactaccaccgagacgtggacgcctagaagtattttagactagttagttacttacgtaggtacctaaacgttacggttacggttacctacgaacctaacgtaccgggttacggtaaccggttaccgggtaaccggtaacgggtacccgtaaggggtacggtaaaacgttaaccggaaaaccgtaacggtacggttacggtacgttacggacccgtaaccgtacgttaccgtacgtttacccg

SEQ ID NO: 258275 - DNA, 620 bp, Homo sapiens
  misc_feature: GYAE6OF02JNH7E.34.88.H11.1.454.CMB.1.raw
  modified_base (303)..(303): a, c, t, g, unknown or other
  misc_feature (303)..(303): n is a, c, g, or t
  modified_base (328)..(328): a, c, t, g, unknown or other
  misc_feature (328)..(328): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaagagtcaccctctcctgcagggccagccagagtgttagcagcaacttggcctggtaccagcagaaacctggccaggctccaggctcctcatctagtggtncactccacacgggccacgtggtacncccgagcctaggttcagtcggcaggttcgggtctggggacacggtacttcgacttcgtaccaccgtatccaaccgagtacgtggacgtcctagaacgtgttttacgacgtagttagttacttacgtacgtactaacgttacggttacgttactaccgaccgtaacgtaccgttacgggtacggttaccgggaccgtaacgggtaccgtaagggttacggtaaaacgtaaccgtaaacgggtaaccgtacgggtacggtacgtacggacctaccgacgttcgttacgttaccg

SEQ ID NO: 258276 - DNA, 565 bp, Homo sapiens
  misc_feature: GYAE6OF02G5Y6V.34.88.H11.1.454.CMB.1.raw
  modified_base (216)..(216): a, c, t, g, unknown or other
  misc_feature (216)..(216): n is a, c, g, or t
  modified_base (299)..(299): a, c, t, g, unknown or other
  misc_feature (299)..(299): n is a, c, g, or t
  modified_base (312)..(312): a, c, t, g, unknown or other
  misc_feature (312)..(312): n is a, c, g, or t
  modified_base (387)..(387): a, c, t, g, unknown or other
  misc_feature (387)..(387): n is a, c, g, or t
  modified_base (426)..(426): a, c, t, g, unknown or other
  misc_feature (426)..(426): n is a, c, g, or t
tcagtacacgtgatcacgaccggtgctcgatttagcgacagcgagaacgacacaaagggggacggaactgctcagttaggacccagacggaaccatggaagccccagcgcagcttctcttcctcctgctactctgggctcccagataccacgttggagaaatagtgaatggacgcagtctccagccaccgtgtctgtgtctccggagggggaaagngtcaccctgtcctgcagggccagccagagtgtagcagcaacttggcctggtaccagcagaacctgccaggctcccaggctccncatcgtactggtncgatccgaccgagggtccactggtactccaggcctaggttcaggtgacaggtggtctgggacagaacttcactcncaccatacagccagtcctgacctagtctgaagttgtttnactagtttatactgtacagactagtaataagtagtgtcgttaggaccgttcgggaccgaaggggaccgtaaggtcggtaaagtccgtaaaacggacgtaggttacggacgttaccgacgtaccgtaagtccgttaccgg

SEQ ID NO: 258277 - DNA, 548 bp, Homo sapiens
  misc_feature: GYAE6OF02GDTHK.34.88.H11.1.454.CMB.1.raw
  modified_base (205)..(205): a, c, t, g, unknown or other
  misc_feature (205)..(205): n is a, c, g, or t
  modified_base (431)..(431): a, c, t, g, unknown or other
  misc_feature (431)..(431): n is a, c, g, or t
  modified_base (450)..(450): a, c, t, g, unknown or other
  misc_feature (450)..(450): n is a, c, g, or t
  modified_base (530)..(530): a, c, t, g, unknown or other
  misc_feature (530)..(530): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaanagtcaccctctcctgcagggccagccagagtgtagcagcaattggcctggtaccagcagaaacctggcccaggcctcccaggcctcctcatcctatggtgctatcccacgacggggcctacgtcggtactccccgagtcccgtaggttcaggttggcctaggtgggtctggggacaggtaattcgaccttcgaccactatcagcacgcctgactagtctagaattntttgcttagtttatacgtntcagtacataatatacgtcgtccgtcgggtacgtcggacgaggacgtaaggtcggaacttacgaaacgtacgtagtcggntccgactactacttgtcg

SEQ ID NO: 258278 - DNA, 529 bp, Homo sapiens
  misc_feature: GYAE6OF02GLRO6.34.88.H11.1.454.CMB.1.raw
  modified_base (206)..(206): a, c, t, g, unknown or other
  misc_feature (206)..(206): n is a, c, g, or t
  modified_base (405)..(405): a, c, t, g, unknown or other
  misc_feature (405)..(405): n is a, c, g, or t
  modified_base (409)..(409): a, c, t, g, unknown or other
  misc_feature (409)..(409): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagacaccactggagaaatagtgatgacgcagtctccagccaccctgtctgtgtctccagggggaaanagccaccctctcctgcagggccagtcagagtgttggcagcaacttagcctggtaccagcaagaaacctggaccaggcctcccagacgtcctcatctatgctacactccaccagggccatgctacttccagcctaggttcagtggcaggtgggtctgggacaggagttcactctcaccatcagcagcctgcagtcagatnttcngctatttatctgtacagtctagtactaagtagtcggtaccgtggtacgttcggaccgtaagggaccgtaagggtaggaaactcgaaacggtacgttggtacggctacggaccaaccgtcg

SEQ ID NO: 258279 - DNA, 553 bp, Homo sapiens
  misc_feature: GYAE6OF02FIT4P.34.88.H11.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (395)..(395): a, c, t, g, unknown or other
  misc_feature (395)..(395): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaangtcaccctntcctgcagggccagccagagtgttagcagcaacttggcctggtaccagcagaaacctggccaggctccccgaggcctcctcatctatggtgcatccaccagggccactggtatcccagccaggttcagtggcagtgggtctggggacagaattcactctcaccatcagcagcctgcagtcngaagtnttcngctacttttatacttgtcagcaagttactaattaagtcggtaccgtgggtaccgttcgggaccgaaacggggtaccctaaagggtcggaaaacgttacgaaaaccggtaacgttggtacgggtaccgtacggacccacctagttcccg

SEQ ID NO: 258280 - DNA, 616 bp, Homo sapiens
  misc_feature: GYAE6OF02HFSI3.34.88.H11.1.454.CMB.1.raw
  modified_base (207)..(207): a, c, t, g, unknown or other
  misc_feature (207)..(207): n is a, c, g, or t
  modified_base (308)..(308): a, c, t, g, unknown or other
  misc_feature (308)..(308): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaagngtccaccctctcctgcagggccagccagagtgtagcagcaacttggcctggtaccagcaagaacctggccaggcctcccgaggcctcctcatctagtggtncactccaccgagggccacgtggtactcccgagcccaggttcaggtggctaggtgggtctagggacagtaattccactctacaccatcagcagcctgcagtctagtaagttattttgacttagtttatacgtgtacagtactaagtaattaaacgtaacgtcgggtacccggttaccggggtaaccgttccgggaaccggtaacggggtaacccgtaaggggttaacggtaaacgtttaaccggaaaaccggttaaccgttagggtacggtaccgttacggacccgtaacccgtacgttaccttaccgg

SEQ ID NO: 258281 - DNA, 712 bp, Homo sapiens
  misc_feature: GYAE6OF02F7N6G.34.88.H11.1.454.CMB.1.raw
  modified_base (205)..(205): a, c, t, g, unknown or other
  misc_feature (205)..(205): n is a, c, g, or t
  modified_base (305)..(305): a, c, t, g, unknown or other
  misc_feature (305)..(305): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaanagtcaccctctcctgcagggccagccagagtgttagcagcaacttggcctggtaccagcaagaacctggccaggcctcccaggcctcctcatctagtggngcatcccaccgagggccacgtggtactccccgagccgaggttcaggttcggctaggttcggggttctagggggaacaaggtaaacgtttccaaccgttcctaccgaacccgtaacttccgaaggccgaacggtcccttggccgtaaggttcctaggtaaaggttatttttacggacctttaggtttttacttacgttggtacgtaagtaccgtaagtttaacttaaacgttaaccggttccgggtaccccggtttacccgggggtaccgtttacccggggaacccggtaaacggggtaacccgtaaacgggggttaacgggtaaaccgttttaaccggaaaaccggttaaccgttagggttacgggtaccgttaccggacctaaccccggtagttacccgtttacgg

SEQ ID NO: 258282 - DNA, 666 bp, Homo sapiens
  misc_feature: GYAE6OF02F973T.34.88.H11.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (305)..(305): a, c, t, g, unknown or other
  misc_feature (305)..(305): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaangtcaccctntcctgcagggccagccagagtgttagcagcaacttggcctggtaccagcagaaacctggcccaggcctcccaggcctcctcatcatggtncatcccgaccgagggcccacgtggtactccccgagcccgtaggttcaaggtcggactaggtcggggtctaggggaacctaggtaactttccgaacttcctacgaaccctattaccgagcctacggtcccgttaggcctaacggtccgtaggaaggttacttttcgacgttaagttttaacttacgttggttaccaaggtacctaagtttaactaaacgttaacgtacgggtcccgttaccgggggtaacgtttccgggaccggtaacggggtacccgtaaggggttacggtaaactttaccggaaaacggtaccgttagggttacggtaccgttacggaaccctaccgttacgtccttacg

SEQ ID NO: 258283 - DNA, 502 bp, Homo sapiens
  misc_feature: GYAE6OF02FFDBR.34.88.H11.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (304)..(304): a, c, t, g, unknown or other
  misc_feature (304)..(304): n is a, c, g, or t
  modified_base (498)..(498): a, c, t, g, unknown or other
  misc_feature (498)..(498): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaangtcaccctntcctgcagggcccagccagagtgttagcagcaacttggcctggtaccagcagaaacctggccaggctcccaggcctcctcatctatggtncatccacagggcccactggtatccagccaggttcagtggcagtggtctgggacagaattcactctcacatcagcagcctgcagtctagaagtatttgctagtttatactgtcagctagtataatacgtgcctcgggcgttcggacctagggaccagggtcgaattacaacgtactgacggtctacgctaccatntacg

SEQ ID NO: 258284 - DNA, 559 bp, Homo sapiens
  misc_feature: GYAE6OF02HGVQ6.34.88.H11.1.454.CMB.1.raw
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaagagtcaccctctcctgcagggccagccagagtgttagcagcaacttggcctggtaccagcagaaacctggccaggctcccaggctcctcatctatggtgcatccaccagggccacgtggtactcccagccaggttcagtgcagtgggtctgggacagaattcactctcaccatcagcagcctgcagtctagaagtattttgcttagtttatactgtacagtactagtaataattaacgtggtcccgtaccggggtacgttccgggaccgaacggggtaccgtaagggtcggtaactttacgaaaccggtacgttaggttacggccgtacggacctaacccgtagttccgttacgg

SEQ ID NO: 258285 - DNA, 568 bp, Homo sapiens
  misc_feature: GYAE6OF02H6I5T.34.88.H11.1.454.CMB.1.raw
  modified_base (206)..(206): a, c, t, g, unknown or other
  misc_feature (206)..(206): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaagngtcaccctctcctgcagggccagccagagtgttagcagcaacttggcctggtaccagcagaacctggccaggcctccgaggcctcctcatctatggtgcactccacgaggggcccactcggtactccccagtcccaggttcagtggcgaggtgggtctggggacagtattcgactcctacaccatccagcacgcctgctagtctagtaagtagttttgacttagtttattacgtgtctagtactaagtaataatacgtcggtcccggtaccgggtacgttccgggaccgtacgggaccgtaagggtcggtaacttacgaaacggtaactggtacggcgtacgtaccaccgtacgtacgttcg

SEQ ID NO: 258286 - DNA, 582 bp, Homo sapiens
  misc_feature: GYAE6OF02GM089.34.88.H11.1.454.CMB.1.raw
  modified_base (206)..(206): a, c, t, g, unknown or other
  misc_feature (206)..(206): n is a, c, g, or t
  modified_base (454)..(454): a, c, t, g, unknown or other
  misc_feature (454)..(454): n is a, c, g, or t
  modified_base (576)..(576): a, c, t, g, unknown or other
  misc_feature (576)..(576): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaangtcaccctctcctgcagggccagccagagtgttagcagcaacttggcctggtaccagcagaacctggccaggcctcccgaggcctcctcatctagtggtcacactccgaaccgacggggtcccacgttcggtacctccccgagtcccgtaagggttccaggttggacgtagggtcgggtcgtaggggaactaggtaacttccacgttcctacgacctagtcagccacgcctgactagtcgtagagttntttcgattagtttatactgtcagtactagttaataacgtacgttcggtaccgtacgggtacgttcggacgtacgggacgtaggtaggtaactacgaacgtacgtggtacgctgacctacgtntcgtcg

SEQ ID NO: 258287 - DNA, 520 bp, Homo sapiens
  misc_feature: GYAE6OF02FTGF3.34.88.H11.1.454.CMB.1.raw
  modified_base (206)..(206): a, c, t, g, unknown or other
  misc_feature (206)..(206): n is a, c, g, or t
  modified_base (408)..(408): a, c, t, g, unknown or other
  misc_feature (408)..(408): n is a, c, g, or t
tcagtacacgtgatcacgaccggtgctcgatttagcgacagcgagaacacacaaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaanagtcaccctctcctgcagggccagccagagtgttagcagcaacttggcctggtaccagcagaaacctggccaggctcccagacgtcctcatctatgctacatccacagggccactgctatccagtccaggttcagtggctaggtgggtctgggacaggtagttcactctcaccatcagcagcctgcagtctagaactattcngctacttttatactgtacagtctagtctaagtagtcggacgtggacgttcggacgtaagggacctaagggtagaaactacgaaacgtacgtggtacggctgacctacctacg

SEQ ID NO: 258288 - DNA, 544 bp, Homo sapiens
  misc_feature: GYAE6OF02FSN6Q.34.88.H11.1.454.CMB.1.raw
  modified_base (205)..(205): a, c, t, g, unknown or other
  misc_feature (205)..(205): n is a, c, g, or t
  modified_base (303)..(303): a, c, t, g, unknown or other
  misc_feature (303)..(303): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaanagtcaccctctcctgcagggccagccagagtgttagcagcaacttggcctggtaccagcagaaacctggccaggctcccaggctcctcatctatggtncatcccaccgagggcccacgtggtactcccagccaggttcaggtggcaggtgggtctgggacagattcactctcacatcagcagcctgcagtctagaagtatttgcttagtttattactgtcagtactagtataataacgtcggtccgtaccggggtacgttcggacccccgagggaccgtaagggtaggtaacgttaccgaaacgtaacgtagtacggtcgtacgacctactactcgtcg

SEQ ID NO: 258289 - DNA, 525 bp, Homo sapiens
  misc_feature: GYAE6OF02JBCVN.34.88.H11.1.454.CMB.1.raw
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaagagtcaccctctcctgcagggccagccagagtgttagcagcaacttggcctggtaccagcagaaacctggccaggctcccaggctcctcatctatggtgcatcccaccagggccactggtactcccagccaggttcagtggcaggtggtctggggacagtaattccactcctcaccatccagcagcctgcagtctagagtattttgcttagtttacttactgttcagctagtataagtacgtgtccgtccgggtacgttcggaccgagggaccgaaggtaggtaaactacgaaacgtagtagtggctacgacacatagtcg

SEQ ID NO: 258290 - DNA, 684 bp, Homo sapiens
  misc_feature: GYAE6OF02ISX7D.34.88.H11.1.454.CMB.1.raw
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaagagtcaccctctcctgcgagggccagccagagtgttagcagcaacttggcctggtaccagcagaactggccaggctcccgaggtctcctcatctatggtgacatcccacgagggcctacgtggtactccccgagcccgtagggtttcaggttcggactacgggttgggtacgtcggggaactaggtaactttccgacgttcctacaaccgtacttacgaacgccgtaacgtccccgttggaccctagggttaccttaggtaaacgttacggtttttacggcctttaaagggtttttacttacgttacggttactacggtacttaaacggttaattaaaccgttaaccgttccgggtcccgttaccggggttaccgtaccggtaacccggacgggtaaaccgtagggttaacgtaaccgttaacggaaaaccggttacgtacggtacgtcggtagacccgtaaccgtcgttacgttaccg

SEQ ID NO: 258291 - DNA, 588 bp, Homo sapiens
  misc_feature: GYAE6OF02HL6C9.34.88.H11.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (305)..(305): a, c, t, g, unknown or other
  misc_feature (305)..(305): n is a, c, g, or t
  modified_base (392)..(392): a, c, t, g, unknown or other
  misc_feature (392)..(392): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaangtcaccctntcctgcagggccagccagagtgttagcagcaacttggcctggtaccagcagaaacctggccaggcctcccgaggctcctcatctatggtncactcccaccgagggcccacgtcggtactcccagcccaggttcaggtggctaggtcgggtctgggacagtaacttcactctcacacncttagcacgcctgctagtctagaagttagttttgacttaagtttattacgtcgttcagtactagttaactaagtaacgttcgggtaccggttaccggggtaccgttaccgggacccgaacggggtaccgtaagggtacggtaacgttaccgaaaacggtacgtaggtacggctacgacctaaccgtagtccttacg

SEQ ID NO: 258292 - DNA, 607 bp, Homo sapiens
  misc_feature: GYAE6OF02IO97T.34.88.H11.1.454.CMB.1.raw
  modified_base (207)..(207): a, c, t, g, unknown or other
  misc_feature (207)..(207): n is a, c, g, or t
  modified_base (429)..(429): a, c, t, g, unknown or other
  misc_feature (429)..(429): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaagngtcaccctctcctgcagggccagccagagtgttagcagcaacttggcctggtaccagcaagaacctggccaggcctcccgaggcctcctcatctagtggtgcactccaccgagggcctacgtcggtactcccgagccgtaggttcaggtcggactaggtgggtctaggggacagtaacttcactcgtacacatacagcacgcctgctagtcgtagtaagttntttgacttagtttactacgtgttacagtactaaggttaactaaacgttacgtcgggtcccggttaccggggtaccgttacgggaaccggtaacgggtaaccggtacgggtaacgtaacgttaccgaaacggttacgtacggtacggaccttacggacccgtaactacgttccgttacg

SEQ ID NO: 258293 - DNA, 514 bp, Homo sapiens
  misc_feature: GYAE6OF02IX2AG.34.88.H11.1.454.CMB.1.raw
  modified_base (206)..(206): a, c, t, g, unknown or other
  misc_feature (206)..(206): n is a, c, g, or t
  modified_base (304)..(304): a, c, t, g, unknown or other
  misc_feature (304)..(304): n is a, c, g, or t
  modified_base (413)..(413): a, c, t, g, unknown or other
  misc_feature (413)..(413): n is a, c, g, or t
  modified_base (510)..(510): a, c, t, g, unknown or other
  misc_feature (510)..(510): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccagggggaaangtcaccctctcctgcagggccagccagagtgttagcagcaacttggcctggtaccagcagaaacctgaccaggcctccaggcctcctcatctatggtncatcccaccgagggcccacgtggtactccccgagccctaggttcaggtggcaggtgggtctggggacagtacttcactctcacatcagcagcctgctgtctagtaattntttgcttagtttatctgtcagactatataatacgtcgccgtcggacgttcgaccgaggacgaggtagacttacgaacgtacgtgtacgctgacactntgtc

SEQ ID NO: 258294 - DNA, 674 bp, Homo sapiens
  misc_feature: GYAE6OF02GMTFZ.34.88.H11.1.454.CMB.1.raw
  modified_base (206)..(206): a, c, t, g, unknown or other
  misc_feature (206)..(206): n is a, c, g, or t
  modified_base (307)..(307): a, c, t, g, unknown or other
  misc_feature (307)..(307): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaangtcaccctctcctgcagggccagccagagtgttagcagcaacttggcctggtaccagcaagaacctggccaggcctcccgaggcctcctcatctagtggtnctactcccaccgaggcccacgtggtactccccgagccctaggttccaggtcggactaggttcgggtctaggggaactaggaacttccgaccttctaccgaccctatccgagccacggtccctggacctagttactaggtaagttcgtttttacggactttaaggtttttacttaacgtcggttactaggtactagttaaacttaaacgttaaccgttcgggtaccccggttaccggggttaaccgttaccgggaccggtaacggggtaccgtaacggggttacggtaaaccgtttaccgaaaaccggttacgttacggttacgggtaccttaacggtaccctaacccggttagttacccgtttacgg

SEQ ID NO: 258295 - DNA, 532 bp, Homo sapiens
  misc_feature: GYAE6OF02IB5I0.34.88.H11.1.454.CMB.1.raw
  modified_base (205)..(205): a, c, t, g, unknown or other
  misc_feature (205)..(205): n is a, c, g, or t
  modified_base (302)..(302): a, c, t, g, unknown or other
  misc_feature (302)..(302): n is a, c, g, or t
  modified_base (375)..(375): a, c, t, g, unknown or other
  misc_feature (375)..(375): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaangtcaccctctcctgcagggccagccagagtgttagcagcaacttggcctggtaccagcagaaacctggccaggctcccaggctcctcatctatggtncatcccacgacgggccacgtggtactcccgagccagggttccaggtggcaggtggctgggacagattcactcncacatcagcacgctgcagtctagtaagttatttgctagtttatactgtcagactagtaataatacgtcgtaccgtcgggtacgttccggaccgtagggaccgtaaggtcggtaacgttacgaaacgtagtggtacggactcgactaccgtatcgtcg

SEQ ID NO: 258296 - DNA, 570 bp, Homo sapiens
  misc_feature: GYAE6OF02IM4RY.34.88.H11.1.454.CMB.1.raw
  modified_base (364)..(364): a, c, t, g, unknown or other
  misc_feature (364)..(364): n is a, c, g, or t
  modified_base (388)..(388): a, c, t, g, unknown or other
  misc_feature (388)..(388): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaagagtccaccctctcctgcagggccagccagagtgttagcagcaacgttggcctggtaccagcagaacctggccaggctcccaggctcctcatctatggtgcactcccaccaggggcccacgtggccatcccgagacaggttcaggtggacaggtcgggtngggacagacttcactcacacctancagcagacttgacgcctggaagttagttttgctagtacttattacgtgtacgtacgtataatacgtacgaacgacgtactaacgttgggttacgggtccggttccggaccggaacgggaccggtaaagggtacgggaactaaccgaaacgtaacggttaggtacggactacggactaacccg

SEQ ID NO: 258297 - DNA, 605 bp, Homo sapiens
  misc_feature: GYAE6OF02GLNUG.34.88.H11.1.454.CMB.1.raw
  modified_base (206)..(206): a, c, t, g, unknown or other
  misc_feature (206)..(206): n is a, c, g, or t
  modified_base (216)..(216): a, c, t, g, unknown or other
  misc_feature (216)..(216): n is a, c, g, or t
  modified_base (311)..(311): a, c, t, g, unknown or other
  misc_feature (311)..(311): n is a, c, g, or t
tcagtacacgtgatcacgaccggtgctcgatttagcgacagcgagaacacacaaagggggaggaactgctcagttaggacccaggacggaaccatggaagccccaggcgcagcttctcttcctcctgctactctggctccagataccactggagaaatagtgatgacgcagtctccagccaccgtgtctgtgtctccaggggaaanagtcaccctntcctgcagggccagccagagtgttagcagcaacttggcctggtaccagtcaagaaacctggaccaggacctacccaggctccgtcatctatggtncactccaccagggcccagtggtactcccgagcctaggttcaggtcgctaggtggtctaggggacagaacttcactctacgactatcagtctacgtcctgctaggtctaggaagttatttgacttagtttaacttctgtactacgactaaggttaaactaactaacgttcgggtacccgttccggggtacgttaccgggaccaacgggacccaaaggggttacggtaaacctttaaccggaaaacggtacgttggtacgggaccttaccggacctaaccgtcgttaccgttccgg

SEQ ID NO: 258298 - DNA, 646 bp, Homo sapiens
  misc_feature: GYAE6OF02ICLVS.34.88.H11.1.454.CMB.1.raw
  modified_base (205)..(205): a, c, t, g, unknown or other
  misc_feature (205)..(205): n is a, c, g, or t
  modified_base (626)..(626): a, c, t, g, unknown or other
  misc_feature (626)..(626): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaanagtccaccctctcctgcagggccagccagacgtgttagcagccaagttcggcctggtaccagccaagaaaccgtggacccaggcctcccgaggcctccgtcattctagtggtcgcactcccgaaccgtacggggccctaacgttcggtactccccgacgtcccgtaaggttcaaggtcggtccgagggttcggggtccgtagggggtaaccaagggtaaactttccgaactttcctacgaacccatcgaacgccacgtcccgtagctacgtcctaggtaacgttattttcgactttagttttacttacgtgttacgagtactagtaattaaacgtacgtacggtcccgttaccgggtaccgttaccgggaccgtaacggaccgtaacgggtgtaaccgttacgaaacgtacgtgtacggtntacgccaaccgtgtcttcgg

SEQ ID NO: 258299 - DNA, 601 bp, Homo sapiens
  misc_feature: GYAE6OF02GHKT3.34.88.H11.1.454.CMB.1.raw
  modified_base (206)..(206): a, c, t, g, unknown or other
  misc_feature (206)..(206): n is a, c, g, or t
tcagtacacgtgatcacgaccggtgctcgatttagcgacagcgagaacacacaaaggggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaanaatcaccctctcctgcagggccaggccagagtgttagcagcaacgttggcctggtaccagcaacgaacctggcctggccgcccaggcctcctcatctataatcgacctatagcgacggccacgtggccgtccgagacgtaggttcaggtcggacgtaggtcgggtcgtagggggcacggtaccttacaccttcctacaccactcgagcgagacgtggacgtccgtagtaagttagtttgactagttagttagtttagtttgtcgagtctagctacttctacgtcggtaccctaccgttaccgttacgttttcggaccggtaacgggtaaccgaacggccggtaaggacgtaacgtaaccgtaaacggtaaccgttaggtacggtacgtacgaccg

SEQ ID NO: 258300 - DNA, 565 bp, Homo sapiens
  misc_feature: GYAE6OF02GD8FL.34.88.H11.1.454.CMB.1.raw
  modified_base (206)..(206): a, c, t, g, unknown or other
  misc_feature (206)..(206): n is a, c, g, or t
tcagtacacgtgatcacgaccggtgctcgatttagcgacagcgagaacacgacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaanagtcaccctctcctgcagggccagccagagtgttagcagcaacttggcctggtaccagcagaaacctggccaggcctcccaggcctcctcatctagtggtgctatcccacgtacgggcctacgtcggtactccccgagccgtaggttcagtcggctaggtgggtctgggacagtattcactctcacatcagcacgcctgctagtctagaattatttgacttagtttacttactgttacacgtatagttaataacgtacgttggtcccggtacggggtacgttccggacgtacgggaccgtaagggtacgtaacttaccgaaacgtacgtggtacggtctacgacctactacgtacttcg

SEQ ID NO: 258301 - DNA, 555 bp, Homo sapiens
  misc_feature: GYAE6OF02I90R2.34.88.H11.1.454.CMB.1.raw
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
  modified_base (383)..(383): a, c, t, g, unknown or other
  misc_feature (383)..(383): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaangtcaccctctcctgcagggccagccagngtgttagcagcaacttggcctggtaccagcagaacctggccaggctcccaggcctcctcatctagtggtgcactcccaccgaggggcctacgtggtactccccgagtccgtaggttcaggtgcgaggtggtctgggacagtattcactcncaccatcagcagtcctgcagtctagaagtatttgacttagtttattactgttacagtacgagttaataacttacgtcgtccgtacgggtacgttccgggaccgtaacgggacgtaacgggtggaacgttacgtaaaccgtacgtgtacggtctacgacctactacgtcttcg

SEQ ID NO: 258302 - DNA, 546 bp, Homo sapiens
  misc_feature: GYAE6OF02FRINQ.34.88.H11.1.454.CMB.1.raw
  modified_base (206)..(206): a, c, t, g, unknown or other
  misc_feature (206)..(206): n is a, c, g, or t
  modified_base (381)..(381): a, c, t, g, unknown or other
  misc_feature (381)..(381): n is a, c, g, or t
  modified_base (408)..(408): a, c, t, g, unknown or other
  misc_feature (408)..(408): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgatgcagtctccagccaccgtgtctgtgtctccaggggaaagngtcaccctctcctgcagggccagccagagtgttagcagcaacttggcctggtaccagcagaaacctggccaggcctccaggctcctcatctatggtgcactccaccgagggccagtcggtactcccgagcccaggtttcagttggacgaggtgggtctgggacagtattcactcncacatcagcagcctgcagtctagaatntttgactagtttatactgtacagtcgtagttaataacgttacgtcggtccgtaccgggtacgttcggacgaacgggtaccgtaagggtacggtaacttacggaacgtacgtggtacggacgtacgactaccgtattcg

SEQ ID NO: 258303 - DNA, 636 bp, Homo sapiens
  misc_feature: GYAE6OF02H6G1A.34.88.H11.1.454.CMB.1.raw
  modified_base (205)..(205): a, c, t, g, unknown or other
  misc_feature (205)..(205): n is a, c, g, or t
  modified_base (302)..(302): a, c, t, g, unknown or other
  misc_feature (302)..(302): n is a, c, g, or t
  modified_base (306)..(306): a, c, t, g, unknown or other
  misc_feature (306)..(306): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaanagtcaccctctcctgcagggccagcagagtgtagcagctaacgttggcctggtaccagctaagaaacctggccaggcctccgaggctcctcatctanggtncatcccgacgcgggccacgtggtaactccgacgccgtaggttccaggtggtaccgaggttcggggtactacggggaactacggtaattccacctcgtaccacatcgacgctacgtcgtcgacgtagtcgtagaagtttagtttcgcttaaggttgttaacttacgttagtaccgttaagtacggtttcgtactacgtacacggtacggttacggtaccggttccggacccggtaaagggtacccgaaggggttaaccgaaacgttaaccggaaaccggtacgtttagggtaccggtaccgtacgtaaccccggttaccgtatttacccgg

SEQ ID NO: 258304 - DNA, 510 bp, Homo sapiens
  misc_feature: GYAE6OF02GJ2Y0.34.88.H11.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (395)..(395): a, c, t, g, unknown or other
  misc_feature (395)..(395): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaangtcaccctntcctgcagggacagccagagtgttagcagcaacttggcctggtaccagcagaaacctggccaggctcccaggctcctcatctatggtgcatccacagggccactggtatccagccaggttcagtggcagtggtctgggacagaattcgactctcaccatcagcagcctgcagtctgaagtnttttgctagtttatactgtcagctagtataatacgtggccgtcgggacgttcggaccgagggaccgaaggtaggaacttacgaaacgtaactgtcggcgtagcaccgtatctacg

SEQ ID NO: 258305 - DNA, 552 bp, Homo sapiens
  misc_feature: GYAE6OF02GUW2O.34.88.H11.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (393)..(393): a, c, t, g, unknown or other
  misc_feature (393)..(393): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaanagtcaccctntcctgcagggccagccagagtgttagcagcaacttggcctggtaccagcaagaacctggccaggcctcccaggctccctcactctagtggtcgcatcccaccgacggggccacgtcggtactccccgagcctaggttcagtggctaggtcgggtctggggacaggtaattcgacttcncaccatcagcagcctgctagtctagtaagtctttgacttagtttattctgtctagtactagtaattaacaacgtcggacccgttcgggtacgtcggaccgtaacgggaccaagggtggaacttacgaaacgtacgtggtggctagaccacgtatctacg

SEQ ID NO: 258306 - DNA, 704 bp, Homo sapiens
  misc_feature: GYAE6OF02JHL4E.34.88.H11.1.454.CMB.1.raw
  modified_base (161)..(161): a, c, t, g, unknown or other
  misc_feature (161)..(161): n is a, c, g, or t
  modified_base (174)..(174): a, c, t, g, unknown or other
  misc_feature (174)..(174): n is a, c, g, or t
  modified_base (209)..(209): a, c, t, g, unknown or other
  misc_feature (209)..(209): n is a, c, g, or t
  modified_base (225)..(225): a, c, t, g, unknown or other
  misc_feature (225)..(225): n is a, c, g, or t
  modified_base (386)..(386): a, c, t, g, unknown or other
  misc_feature (386)..(386): n is a, c, g, or t
  modified_base (704)..(704): a, c, t, g, unknown or other
  misc_feature (704)..(704): n is a, c, g, or t
tcagtacacgtgatcacgaccggtgctcgatttagcgacagcgagaacgacacaaagggggaggaactgctcagttaggacccagacggaaccatggaagccccagcgcagcttctcttcctcctgctactctggctcccagataccactggataaatgtnatgacgcagtccnccagccaccgtgtctgtgtcctccggaaggggaancgtccaccgttctccngcgacgggtccagccagtgtcgtagacagacctaacgttcggccgttacggtacccaggtacaaacggaaaccgtggacccaggtccaccgacggtcctcccgtacacttcctaagtcgggtcactaaccttcccgaacgcgggcctaacgttcggtaccncccggacgtaccgttacgggtaccagggttacggccgttaagggtccgggttcgaacggaacgacggttaactttccgaacgtttccaccgtaacctacgtaccgaacgccgtaacgtccgttagacgtaacgtccgtaagtaacggttacttttcggaactttacggttaactttcgacttacggactacgttaaagttactaaacgtacggttcgtacccgggtaccgggttacgttagaaccggtagaaccgtaagggtactaacgtacgaaaaccgttagttagacggttcgtagacctaacgtcgtaccgttn

SEQ ID NO: 258307 - DNA, 716 bp, Homo sapiens
  misc_feature: GYAE6OF02GG2DT.34.88.H11.1.454.CMB.1.raw
  modified_base (224)..(224): a, c, t, g, unknown or other
  misc_feature (224)..(224): n is a, c, g, or t
tcagtacacgtgatcacgaccggtgctcgatttagcgacagcgagaacgtacgacaaagggggaggaactgctcagttaggacccagacggaaccgatggaagccccagcgcagcttctcttcctcctgctactctggctcccagactaccactggagtaaatagtgaatgacgcagtctccagccaccgtgtctgtggtctccaggggaaacaactcaccctntcccgtgccgagggcctaggcccagtacgtgttagcagccaacgttggcctacggtaccagtcacgaaacctcggaccagcctacccaggacctcctaccattacctacgtaggtcgacgtactacccgacccgaaggtcccgacgttcggttaccgtaccccgacgtccgtacggttaccgaggtcggtacggtagtcgggttaccgtgggaacataaccgtttctaccgtctacgtacctaacgtaccacggtacaacgtcccgttaggactacggttagtagtaaggttacgttttacggaccttagtttaactttacgtacgttcgtaacgaccgttagtaacgtttaacgtaccgttaccgggtaccgttaccggggtacgttacccgggaccgtaacgggaccgtaacgggtacggtaaacgtttacccgtaaacgttaacggttagtaccgggtacttacggaccctaccgttacgtaccgtacg

SEQ ID NO: 258308 - DNA, 582 bp, Homo sapiens
  misc_feature: GYAE6OF02JDV8R.34.88.H11.1.454.CMB.1.raw
  modified_base (206)..(206): a, c, t, g, unknown or other
  misc_feature (206)..(206): n is a, c, g, or t
  modified_base (234)..(234): a, c, t, g, unknown or other
  misc_feature (234)..(234): n is a, c, g, or t
  modified_base (362)..(362): a, c, t, g, unknown or other
  misc_feature (362)..(362): n is a, c, g, or t
  modified_base (401)..(401): a, c, t, g, unknown or other
  misc_feature (401)..(401): n is a, c, g, or t
  modified_base (433)..(433): a, c, t, g, unknown or other
  misc_feature (433)..(433): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaangtcaccctctcctgcagggccagccagngtgttagcagcaactggcctggtaccagcagaacctggccaggcctcccgagctcctcatctatcggtgcactccgaccgacggcctactggtactcccgagccgagttcgaggtgctaggtcgggtnagggacagtactcgactcgtcaccatcagcacgctgctntacgagtattagtttgcttaagtttcttacgngtccagtactaagtataacgttaacgtcgggtaccgtcgggtaccgttacgggaccgtaacgggtaccgtaagggtacggtaaacgtaacggtaaaccggtacgttacggtacggtaccggtacggtaccaccgttacgttcgttacgg

SEQ ID NO: 258309 - DNA, 571 bp, Homo sapiens
  misc_feature: GYAE6OF02HNTM9.34.88.H11.1.454.CMB.1.raw
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaagagtcaccctctcctgcagggccagccagagtgttagcagcaacttggcctggtaccagcagaaacctggccaggctcccaggcctcctcatctatggtgcatcccaccgacgggccacgtggtactcccgagcccgtaggttcaggtcggcgaggttggggtctggggaacctagtaacttccgaacttccgtacacccactccacgcacgtcctagctacgtctagtaacgttagttttgacttagttttaacttacttcggtacagtactaagttataaattacgtcggtcccgtccgggacgttcggacgtacgggacgtaagggtgaacttacgaacgtagtgacgtctcgcactgtctcg

SEQ ID NO: 258310 - DNA, 725 bp, Homo sapiens
  misc_feature: GYAE6OF02I8X09.34.88.H11.1.454.CMB.1.raw
  modified_base (255)..(255): a, c, t, g, unknown or other
  misc_feature (255)..(255): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtcctacggagggaaagacgtccaccctctccgtgcgacgggaccacgccgaggtagttggttancgacgtactaacgttcggccgttacggtaccgacgacaacggtaaaccgtcggacccgacggccctaccgaggtcctcctacatctagtggtcgactactacccaaccgacgggaccctacgtacggtacctccccgtagacccgtacggttacacggtcggacgtgggttaggggtcgtaacggggactaaggtaaccttacgtacctttccgtaccacctacgtaccgacggtaccacggtacccgtcgactacgttaaccgtagtaacgtttatttacggtactttagttttaactttaccgtacgtacgtaacgacgttaaagtaacgttaaaacgtacgttccgggtacccggttaccggggtaaccgttacgggaaccgaacgggtaaccgtaaggggtacgttaaacgttaccggaaaacgtacggttaggtcgacgttcgacccgtaacgtcgtccgttacg

SEQ ID NO: 258311 - DNA, 536 bp, Homo sapiens
  misc_feature: GYAE6OF02GD71A.34.88.H11.1.454.CMB.1.raw
  modified_base (205)..(205): a, c, t, g, unknown or other
  misc_feature (205)..(205): n is a, c, g, or t
  modified_base (292)..(292): a, c, t, g, unknown or other
  misc_feature (292)..(292): n is a, c, g, or t
  modified_base (298)..(298): a, c, t, g, unknown or other
  misc_feature (298)..(298): n is a, c, g, or t
  modified_base (302)..(302): a, c, t, g, unknown or other
  misc_feature (302)..(302): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaattgtgttgacacagtctccaggcaccctgtctttgtctccaggggaaangccaccctctcctgcagggccagtcagagtgttaatgcatctactagcctggtaccagcagaaacctggccagcctccagactcctnattaanggtncatactacgacgggcccctggcactcccagacgaggttcagtcggctaggtcgggtctgggacagtaccttcactctccacatccaccgagtacgtggactccgtagaagtgtttcgatagttatagttactgtacaacgtagttcgtctcacacgtacggtggtacgtcgacgaaggaccaggtacgaatacgaagtacgtgtacgcgtacgacactatctcgtactctaccg

SEQ ID NO: 258312 - DNA, 545 bp, Homo sapiens
  misc_feature: GYAE6OF02F967G.34.88.H11.1.454.CMB.1.raw
  modified_base (358)..(358): a, c, t, g, unknown or other
  misc_feature (358)..(358): n is a, c, g, or t
  modified_base (397)..(397): a, c, t, g, unknown or other
  misc_feature (397)..(397): n is a, c, g, or t
  modified_base (403)..(403): a, c, t, g, unknown or other
  misc_feature (403)..(403): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaagagtcaccctctcctgcagggccagccagagtgttagcagcaacttggcctggtaccagcagaaacctggccaggctccccaggcctcctcatctatggtgcatccaccagggccactgctatccagccaggttcagtgcagtggtctgggacngagttcacttctcaccatcagcagcctgcagtctagaanatttcngctacttttattactgtacacgtactacgttactaaagttaacggtcggaccggttcgggacgtttacggacccgtaaggggaaccgtaaggtacggtaaacttaccgaaacgtacgtggtacggtcgtacgactacctacg

SEQ ID NO: 258313 - DNA, 599 bp, Homo sapiens
  misc_feature: GYAE6OF02JAIE3.34.88.H11.1.454.CMB.1.raw
  modified_base (203)..(203): a, c, t, g, unknown or other
  misc_feature (203)..(203): n is a, c, g, or t
  modified_base (289)..(289): a, c, t, g, unknown or other
  misc_feature (289)..(289): n is a, c, g, or t
  modified_base (300)..(300): a, c, t, g, unknown or other
  misc_feature (300)..(300): n is a, c, g, or t
tcagtacacgtgatcacgaccggtgctcgatttagcgacagcgagaacacacaaagggggaggaactgctcagttaggacccaggacggaaccatggaagcccagcgcagcttctcttcctcctgctactctggctcccagactaccactggagaaatgtgatgacgcagtctccagccacgtgtctgtgtctcaggggaaanatcacctctctgcagggccagcctagagtgttagcagcaacgttggcctggtaccagcagaaacctggccagtctccaggtctccngatctatggtncactccaccgagggccaccgttggtacctccgacgtcctagggttccaagtcggactggtcggtctagggaactagactttcgactccgtacacctatcgagacctacggtcctaggctacgttcgacgtaaagtcgttttcgacgttaacgtttacttacctgtaccgtagaccgtaagttattaaacgttgggcgttacggtaggtaccgttacggtaccgagggtaaccgtaggtaacggtaaactacgtaaacgtacgtaggtacggtactcggtaaccaccgtagttcgtacgg

SEQ ID NO: 258314 - DNA, 580 bp, Homo sapiens
  misc_feature: GYAE6OF02ISG9E.34.88.H11.1.454.CMB.1.raw
  modified_base (205)..(205): a, c, t, g, unknown or other
  misc_feature (205)..(205): n is a, c, g, or t
  modified_base (396)..(396): a, c, t, g, unknown or other
  misc_feature (396)..(396): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaangtccaccctctcctgcagggccagccagagtgtagcagcaacttggcctggtaccagcagaaacctggccaggctcccaggcctccgtcatctagtggtgctactccaccgacgggcctacgtcggtactcccagcctaggttcaggtcggcgtaggtcgggtcgtagggactaggattcactctacactntacagcacgtcctgcgtagtctaggtaagttatttgacgttagtttacttcgtagtcagtactagtaacttaacgtacgtacggtccggtaccgggtacgttaccgggacgacggggtacgtaacgggtgtaaacttacgaaacgtagtacggtacgggcttacggacctaccgtatcgttacg

SEQ ID NO: 258315 - DNA, 637 bp, Homo sapiens
  misc_feature: GYAE6OF02F735J.34.88.H11.1.454.CMB.1.raw
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaagagtcaccctctcctgcagggccagccagagtgttagcagccaacgttggcctggtaccagcaagaacctggccaggcctcccaggcctcctcactctagtggtgcactcccaccgagggccacgtggtactcccgagcctaggttcaggtgcaggtcggtcgtgggacagaattcactctcaccatcagcagtcctgcagtctagtaaggtattttcgacttagttttacttacgtgttacagttactaggttaattaacgttaaaccgttcggtaacccggttcccgggggtaaccgtttccgggaacccggtaagggggtaacccgtaacgggggtttaacgggtaaaccgttttaacccggaaaaccggttacgttacgggtacgggtacttacggtaacccgtacccgttacgttacccgtttaccgg

SEQ ID NO: 258316 - DNA, 700 bp, Homo sapiens
  misc_feature: GYAE6OF02I9QP2.34.88.H11.1.454.CMB.1.raw
  modified_base (314)..(314): a, c, t, g, unknown or other
  misc_feature (314)..(314): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaagagtcaccctctcctgcagggccagccagagtgttagcagcaacgttcggcctggtaccagcaagaaacctggcccgaggcctcccgaggcctcctcatctagtggtcncactcccacgacgggccacgttggtacctcccgaagtcccgtaagggttccaaggtcgggcgtagggttcggggtacgtaggggaactaggtaactttccgtaaccttcgtacctaacccgacgttaccgaacgtcccgaacggtcccttaggccgtaacggttccgtaaggttaaacggtttatttttacggacgtttaacgtttttaacttaccgttagttacgtacgtactaaagtttaacgttaaacgttaccggtccgggtacccggttaccggggtaaccgttccggaaccggtacgggaaccgtaaggggtacgtaacggttaaccgtaaacggtacgttcgggtacggcgtaccgccctaaccgtgttaccgttacgg

SEQ ID NO: 258317 - DNA, 613 bp, Homo sapiens
  misc_feature: GYAE6OF02HODF0.34.88.H11.1.454.CMB.1.raw
  modified_base (206)..(206): a, c, t, g, unknown or other
  misc_feature (206)..(206): n is a, c, g, or t
  modified_base (296)..(296): a, c, t, g, unknown or other
  misc_feature (296)..(296): n is a, c, g, or t
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
  modified_base (333)..(333): a, c, t, g, unknown or other
  misc_feature (333)..(333): n is a, c, g, or t
  modified_base (396)..(396): a, c, t, g, unknown or other
  misc_feature (396)..(396): n is a, c, g, or t
  modified_base (403)..(403): a, c, t, g, unknown or other
  misc_feature (403)..(403): n is a, c, g, or t
  modified_base (603)..(603): a, c, t, g, unknown or other
  misc_feature (603)..(603): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaangtccaccctctcctgcgagggccaggccagagttgttagcagcaacttggcctggaccagcaagaacctggccaggcctcccgagcctcncatcgtanggtncactccaccgcggccagtcggtacncccgagcctaggttcaggtgcgtaggtgggtctaggggacagtacttccaacttccacacctncgacgcngccctgacctagtacgtacgtaagttcttttcgactttaagtttactacttggtactacggtactaagttaataaacggttaccgttcgggtacccggttaccggggaccgttaccgggaccggtaacgggtacgtaacgggtacggtaaccgttaacgaaaccggtaaggtggttacggactaccgtacctaaccgttnttaccgttcg

SEQ ID NO: 258318 - DNA, 538 bp, Homo sapiens
  misc_feature: GYAE6OF02FVC2E.34.88.H11.1.454.CMB.1.raw
  modified_base (206)..(206): a, c, t, g, unknown or other
  misc_feature (206)..(206): n is a, c, g, or t
  modified_base (416)..(416): a, c, t, g, unknown or other
  misc_feature (416)..(416): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaagngtcaccctctcctgcagggccagccagagtgttagcagcaacttggcctggtaccagcagaaacctggccaggctcccaggctcctcatctatggtgctatcccaccgaggggcccacgtggtactcccagcctaggttcaggtcggcaggtcgggtctggggacaggtaattcactctcaccatcagcagtcctgcagtctgtaagttnttttgcttagtttattactgtcagctagtaataagtacgtcggccgtccgggtacgttcgaccgacggtaccgaagggtgtaacttaccgaaacgtactggtcggctagccactactcgtcg

SEQ ID NO: 258319 - DNA, 567 bp, Homo sapiens
  misc_feature: GYAE6OF02HI67T.34.88.H11.1.454.CMB.1.raw
  modified_base (206)..(206): a, c, t, g, unknown or other
  misc_feature (206)..(206): n is a, c, g, or t
  modified_base (296)..(296): a, c, t, g, unknown or other
  misc_feature (296)..(296): n is a, c, g, or t
  modified_base (308)..(308): a, c, t, g, unknown or other
  misc_feature (308)..(308): n is a, c, g, or t
  modified_base (396)..(396): a, c, t, g, unknown or other
  misc_feature (396)..(396): n is a, c, g, or t
  modified_base (415)..(415): a, c, t, g, unknown or other
  misc_feature (415)..(415): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccagggggaaanagtcaccctctcctgcagggccagccagagtgttagcagcaacgttggcctggtaccagcagaacctggcccaggcctcccaggcctccncatctagtggtncactccaccgaggggccagtggtactcccgagtccaggttcagtcggctaggtgggtctgggacagtacttcactctcacatcgagcngcgtgcagtctagtaagtnttttgattagtttattcgtgtcagtactagttattaacgtaacgttcggtacccggtccggggtaccgttccgggaccggtaacgggaccgtaagggtcggtaactttaacgaaacggtacgttggtacggtcgtcgacaccgtcgttctcg

SEQ ID NO: 258320 - DNA, 744 bp, Homo sapiens
  misc_feature: GYAE6OF02J2G0S.34.88.H11.1.454.CMB.1.raw
  modified_base (206)..(206): a, c, t, g, unknown or other
  misc_feature (206)..(206): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtcgtctccgaggggaanacgtcaccctctcctgcgagggccagccagacgtgttacgcagctaacgttcggccttgggtaccaggccaacggaacctcgggacccacgggtccctacccgaggtccctaccctcgtaatcctagtcggggtcacctacgtaaccccacccggaaggggcccctaacggttcgtaaacctccccgaaggtcccgtagggtttaccagggttccgggtacgacgggtttcggggtacgtacggggactaaaggttaaccttcgtaccgtaccttacgaacctacgtacctaggacccgtacgtccgtacgggtacctacggtacgttaacgggtaagtttaccggttttagaccggtttaaacttttcttacgtagtacgttaacggtctaaaggtttaacgtaattaccgggttccggaccggttaccggggtaccgtacggaaccgaacggggtaacgtacggggtaaggttaaccgtacggaaacggttacgtcgggtacgtaccggtactaccggaacttacgttcttaccgg

SEQ ID NO: 258321 - DNA, 591 bp, Homo sapiens
  misc_feature: GYAE6OF02FWRNK.34.88.H11.1.454.CMB.1.raw
  modified_base (207)..(207): a, c, t, g, unknown or other
  misc_feature (207)..(207): n is a, c, g, or t
  modified_base (333)..(333): a, c, t, g, unknown or other
  misc_feature (333)..(333): n is a, c, g, or t
tcagtacacgtgatcacgaccggtgctcgatttagcgacagcgagaacacacaaaagggggaggaactgctcagttaggacccagacggaaccatggaagccccagcgcagcttctcttcctcctgctactctggctcccagataccactggagaaatagtgatgacacagtctccagccaccgtgtctgtgtctccgaggggaaanagtcaccctctcctgcagggccagccagagtgttagcagcaacttggcctggtaccagcaagaaacctggccaggcctcccgaggcctcctcactctatggtgcatccacgaggccacgtggtacnccacgcctagtcaggtgcaggtcgggtctaggggactaagtacttcaccgtctcaaccatcagcctagccgttgactaggtctagaacgtttatttgacttaagttttactacctagttacgagtactagttaatacgtaacgtcggtacccgttacggggtaccgttaccggaccgtaacggggaccgtaaggggtcggtaaacgttaaccggaaacggtaccgtagggtacgcgtacgccaacgttactcgttacg

SEQ ID NO: 258322 - DNA, 627 bp, Homo sapiens
  misc_feature: GYAE6OF02H9EYZ.34.88.H11.1.454.CMB.1.raw
  modified_base (205)..(205): a, c, t, g, unknown or other
  misc_feature (205)..(205): n is a, c, g, or t
  modified_base (314)..(314): a, c, t, g, unknown or other
  misc_feature (314)..(314): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaanatccaccctctcctgcacgggccagccagagtgttagcagcaacttggcctgggtaccagcaacgaaacctggccaggcctcccgaggtcctcctcgatctagtggtcncactcccaccgacggggcccacgttggtacctcccgagaccgtacgggttcagggtggcgtacgggttcgggtcgtggggacaggtaaccttcacctcgtacaccatccgagacacggcctgcctagtccgtagtaacgttgttttacgacttagtttacttcgtctacgtagtacgtagttaactaagttaccgtcgggtacccggtacgggtaaccgttccgggaccgaacggggtaccgtaaagggtcggttaaacgtacgtaaacggttactcggtcggtaccgtcgacctacgtacgttcgttacccg

SEQ ID NO: 258323 - DNA, 657 bp, Homo sapiens
  misc_feature: GYAE6OF02F9QHV.34.88.H11.1.454.CMB.1.raw
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaagagtcaccctctcctgcagggccagccagagtgttagcagcaacttggcctggtaccagcaagaaccgtggccaggcctccccgaggcctccctcactctagtcggtcgccactcccaaccgagggccctacgtggtacctccccgagtccgtaggttcaggttcggacgtagggttcggggtacgtacgggggaactaacggtaactttccgacctttctacccgaccctaacgtccgagtcccgacggtccctaggactacgttcgtaggtaagtttattttcggtacgtttaagttttacttacgttgtacgtagtacttaagttaaactaacgttaacgtcggtacccggtcggggtacgttccgggaaccggtacgggtacgtaagggtaacgtaacgtaccgaaacgttacgtggtacggtactacgacctacgtacgtcgttacg

SEQ ID NO: 258324 - DNA, 561 bp, Homo sapiens
  misc_feature: GYAE6OF02HQ8R0.34.88.H11.1.454.CMB.1.raw
  modified_base (204)..(204): a, c, t, g, unknown or other
  misc_feature (204)..(204): n is a, c, g, or t
  modified_base (212)..(212): a, c, t, g, unknown or other
  misc_feature (212)..(212): n is a, c, g, or t
  modified_base (303)..(303): a, c, t, g, unknown or other
  misc_feature (303)..(303): n is a, c, g, or t
  modified_base (312)..(312): a, c, t, g, unknown or other
  misc_feature (312)..(312): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctcaggggaaanatcacctntcctgcagggccagtcagcgttctaacaccgacttctcgccgtggtacccagcagacgacctggccaggctcccaggctcctcatcttggngctccaccngggccactggcactcccgagacaggttccagtggcaggtggtctgggacagtacttcactctcacatcagcagcttgaccgtctgaagtatttagactagttattattacgtgtacagactaattacgtacgacgacgactacgtggtcgggtccgttacggaccggtaacgggtaaccgtaacggggtaacggtaaacgtaacgtaaacgacgttacggtacggaccttacggactaccgtattaccg

SEQ ID NO: 258325 - DNA, 818 bp, Homo sapiens
  misc_feature: GYAE6OF02GUU8J.34.88.H11.1.454.CMB.1.raw
  modified_base (206)..(206): a, c, t, g, unknown or other
  misc_feature (206)..(206): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaangtcaccctctcctgcagggccagccagagtgtagcagcaacgttggcctggtaccagcaacgaaaccgtggcccacgccctacccgaacgacctaccctactaactttaagtcgggtacgctaacttaaccgtaacgacggggtccccctagggacctaacgtaccccgaaggaaccgtagggttacaacggttcgggaccgtagggttcggggtccgtacggggtaacctaaggtaacctttaccgtaccgttcctaccctaacccaacgttacccaacccgtaacggtaacccgttaggggaaccgttacccgtacggtaaaacggttacgtttttacggacgttaacggtttacgttttaacgtttaaccgttacgttaaccgttaaacggttacgggttttacggtacccgttaaccgtaaccgtaaccggttaaccgggttaccgggttaaccggtttacccgggaaccggtaaaccggggtaaccgtaacggggttaacggtaaaacgttaaaccggtaaaaccggtaacggttacgggtacggttaccgttacggtaaccgttaacccgttaacgtttaccgttaccgggtttacctttaacccg

SEQ ID NO: 258326 - DNA, 732 bp, Homo sapiens
  misc_feature: GYAE6OF02HIDJN.34.88.H11.1.454.CMB.1.raw
  modified_base (208)..(208): a, c, t, g, unknown or other
  misc_feature (208)..(208): n is a, c, g, or t
  modified_base (380)..(380): a, c, t, g, unknown or other
  misc_feature (380)..(380): n is a, c, g, or t
tcagtacacgtgatcacgaccggtgctcgatttagcgacagcgagaacacacaaaggggggaggaactgctcagttaggacccagacggaaccatggaagccccagcgcagcttctcttcctcctgctactctggcctcccagataccactggagaaatagtgatgacgcagtcctccagccaccgtgtctgtgtctccgaggggaangtccaccctctctgcagggccagccagagttgttagcagctaacgttggccgtggtaccaggaccaacggtaaacccgtggacccagggtcctaccccgaggtcctcccgtacacttccgttagtcggtagcctaaccgtcccgaaccggcgggccctacggtcggttaccncccgaggcccgtagggttcaaggtcggacgtagggtcggtacggtacgggataacggtacttccacgtttacccaccaccgtacgtaccgacgtacaccggtccgtcgacgttacgttcgtaaacggttaaggtttacgttttacgtaccgtttagtttttaccgttacgttacggtactaaggttaccgttaaagtttacgtaaacgtttaccgggtccggttaccggggtacccgggttacgggttaccggaaccgggtaacgggtaacgtacggggttaactaaccggttaaccggtaaaacgtacgggttacgtacgggactccggaccctacgttacgtcgttaccg

SEQ ID NO: 258327 - DNA, 642 bp, Homo sapiens
  misc_feature: GYAE6OF02H4IX4.34.88.H11.1.454.CMB.1.raw
  modified_base (241)..(241): a, c, t, g, unknown or other
  misc_feature (241)..(241): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagatacccactggagaaatagtgatgacgcagtctccagccaccgtgtctgtgtctccgaggggaagagtcaccctctctgcacggcagccagagtgttacnagctaacttggcctggtaccagcaacgaacgtcggccaggctacccgaggtcctaccgtcattctagtggtcgaccacttcccaaccggacggggccctagtacggtaccgtccccgaggtccgtacgggttccaagggtcggacgtaggttcggggtactacggggaactaggtaacgttccaccgttactacccacctaacgtcgaacgtccaacgtccgtacggataccggttacgtagttaacggttcgttttacggctttaaagttttacgttattaggtcacgtatagtaataacgtaacgtccgttacggccgggttacgtcgaccgaagggtaccgtaaggtaccgtaattaacgaacggtgtcgtgtcgacgtacaacggttactcggttac

SEQ ID NO: 258328 - DNA, 670 bp, Homo sapiens
  misc_feature: GYAE6OF02JQK0M.34.88.H11.1.454.CMB.1.raw
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
  modified_base (268)..(268): a, c, t, g, unknown or other
  misc_feature (268)..(268): n is a, c, g, or t
  modified_base (374)..(374): a, c, t, g, unknown or other
  misc_feature (374)..(374): n is a, c, g, or t
  modified_base (521)..(521): a, c, t, g, unknown or other
  misc_feature (521)..(521): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaattcgtgatgacgtcagtctccagccaccgtgtctgtgtctcgagggaaangtccacctntcctgcgagggccagccagacgttgtacgcagctaacgttcggcctggtaccngacgaagaaaccgttggacccgtaggtccctcccgaggtcctcccgtacgtaacttccgtaacggtcggtccactaccgtccccacggtacgccctagtcggtacncccgtacgccgtagttcaggtcgtcgtaggtcgggtactacggataacgtacgttccgactacctccgtactaagtccgagacgaccgtccgtacgacgtacgtcgtaacgtagttcgtttgaacctttagttacgtacgtcgtacncgttagtaagttaactaacgtccggttacgtcccggtacggtacgttaccggaccggtaaacgggttccgtaaggggtaaccgttaacggttaacggaaaccgttagttcgggttaacgcggtagttacccgacttacgtactttacgg

SEQ ID NO: 258329 - DNA, 680 bp, Homo sapiens
  misc_feature: GYAE6OF02GL1ID.34.88.H11.1.454.CMB.1.raw
  modified_base (168)..(168): a, c, t, g, unknown or other
  misc_feature (168)..(168): n is a, c, g, or t
  modified_base (296)..(296): a, c, t, g, unknown or other
  misc_feature (296)..(296): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgnagtctccagccaccgtgtctgtgtctccgaggggaagagtcaccctctcctgcagggccagccagtagtgtagcagcaacttggcctggtaccagcagaaccgtggccaggctcccgaggcctccctnactctagttggcgcactcccgacgacgggcctacgtgggtaactccccgaaggcccgtacggttctagggtcggacctaggttcggggttactacggggtaacaagttaaacgttccgtaacctttccgtacaacccgtacgtaccaacggtcaaccggtccgtacgaccgtacggttaccttaggtaaacgttagtttttacgacgtttagtttacgtttactcggtcgtagacgtaagtttaattaacgttaacggcggtaacccggttaccggggtaacgttccggggaaccgtacgggtacgtaacgggtaacggaacgtttaaccgaaacggtaacggttacggtacggtcctacggtaccctactacggttacttacg

SEQ ID NO: 258330 - DNA, 676 bp, Homo sapiens
  misc_feature: GYAE6OF02HV4GQ.34.88.H11.1.454.CMB.1.raw
  modified_base (174)..(174): a, c, t, g, unknown or other
  misc_feature (174)..(174): n is a, c, g, or t
  modified_base (210)..(210): a, c, t, g, unknown or other
  misc_feature (210)..(210): n is a, c, g, or t
  modified_base (223)..(223): a, c, t, g, unknown or other
  misc_feature (223)..(223): n is a, c, g, or t
  modified_base (226)..(226): a, c, t, g, unknown or other
  misc_feature (226)..(226): n is a, c, g, or t
  modified_base (243)..(244): a, c, t, g, unknown or other
  misc_feature (243)..(244): n is a, c, g, or t
  modified_base (262)..(262): a, c, t, g, unknown or other
  misc_feature (262)..(262): n is a, c, g, or t
tcagtacacgtgatcacgaccggtgctcgatttagcgacagcgagaacgacacgaaagggggaggaactgctcagttaggacccagacggaaccatggaagccccagcgcagcttctcttcctcctgcctactctggtctcccagactacctactggagaaatgtgagtgacgnagtcctccagccacgtgtctgtgtctcgaggggaancgtcaccctctcngcncggcagccagagtgtannagctagttgctggtaccngacacgaacctggccaggtcctaccgaggcctccgtcacgttctagtcggtctacgactacccgaccgtacggggccctacgttacggtaccgtcccgagcccggtaggttacgaggttcggacgtaggttccgggttagcggtaacgtaggtaacgttccgacgtctaccgacctacgtacacggtaccgacgtccgtgtacgacgttcgtaaagttacgtttagtttcgacgttttaacgtttacgtttactcgtaacacggttaactaagggttaagttaaaccgtacgggtaccgggtcccggtaccggggtaaccgttccggaaccgtagggacgttaagggaacgtaacgtaaacggtaccgtaaggtcggtaccggtacgagtacccgtactaccggttgttaaccg

SEQ ID NO: 258331 - DNA, 616 bp, Homo sapiens
  misc_feature: GYAE6OF02HATY1.34.88.H11.1.454.CMB.1.raw
  modified_base (206)..(206): a, c, t, g, unknown or other
  misc_feature (206)..(206): n is a, c, g, or t
  modified_base (309)..(309): a, c, t, g, unknown or other
  misc_feature (309)..(309): n is a, c, g, or t
  modified_base (397)..(397): a, c, t, g, unknown or other
  misc_feature (397)..(397): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaagngtcaccctctcctgccagggccagccagagtgttagcagcaacttggcctggtaccagcagaacctggcccaggctcccgaggtcctcctcattctatgggtnccatccaccgagggcctacgtcggtactccaggtcctaggttcaggtcggctaggttcgggtactaggggacaggtaacttcaccgtntaccacagtaccagcgtaacgtccgtagtcgtaacgttcgtaaggtaacgttactttacgacttaagttttacttaccgttgtacctaggtactaagttaattaacgtaacgttccgggtaccgttaccggggtcttaccgggaccgtacgggacgtaagggtacgtaacgtaccgaaacggtacttggtacggtactccgtacctacctagtcttacg

SEQ ID NO: 258332 - DNA, 639 bp, Homo sapiens
  misc_feature: GYAE6OF02F9EWZ.34.88.H11.1.454.CMB.1.raw
  modified_base (205)..(205): a, c, t, g, unknown or other
  misc_feature (205)..(205): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaaangtcaccctctcctgcagggccagccagagtgtagcagcaacttggcctggtaccagcaagaaacctggccaggcctcccaggcctcctcattctatgcctacactcccaccgacgggccactgccttacttcccagtcctagggtttcaggttggcgtagggttggggtcctagggggaactaggtacgtttccacttcctacctacctatccgagccagccctgctagtcgtagaagtacttctgtacttacttttattactcggttaccagtactaagttacttaaagttaacggtcgggtaccggttagggtaccggtttccggaaccggtaaacggggtaacccgtaaaggggttaaccgggtaaaacgttaaccggaaaaccggttacgttacgggtacggtaccgttacggtacccaacccgttacgg

SEQ ID NO: 258333 - DNA, 906 bp, Homo sapiens
  misc_feature: GYAE6OF02FGM5I.34.88.H11.1.454.CMB.1.raw
tcagtacacgtgatcacgaccggtgctcgatttagcgacagcgagaacgacacaaagggggaggaactgctccagttacggacccagtaccggaaccattcggaacgccccagcgcagccttctcttctcctgctactctagcctccgagtacgtaccagtggaacgtaaacttggtgattacggaaccgtactaacggtcctcccgaagcccgtaaccggttgttacctggttcgttcccgtaccggaagggggtaaacctacgtaccgacccccttctccccgttgggccgacgggccctacggccctaaggtacggttttaggttacggccgtaacggtcctaaccgtttccggtaccgtacgggttaacccaacggtaccgaaaccgttaaaaccggttcgggaccccggtaacgggtccccttaccccggtacgtaccccgttaccgtaccgttaacgttacggtttaacggttcgggtaccgtacctaacggttacccccgaaccggttaccggggaccccttaacgggtttaccgggttaaccctacccggtaaaccggcccggttttaaccgggttaaccggtacgggttaccggtacggtaaccgggtcggggttttaaccgacgggggttaacctaacgggtacctttacccgtacctacctaccgtaaccttacggaccgtacgaccgtacccgtctacggtactcgtacgtcgttaacgttagttctacgttatttcctgtacgtactacgaccgttaagtaaccttaacgtaccggttcgggtaccgttaccgggtacgtaccgggaaccgtacgggaacgtacggtttaacaccgtaaccggtaaccgtcgggttacgtacccgcgttaaccgctacgtacgttccttaccg

SEQ ID NO: 258334 - DNA, 762 bp, Homo sapiens
  misc_feature: GYAE6OF02IT5MV.34.88.H11.1.454.CMB.1.raw
  modified_base (130)..(130): a, c, t, g, unknown or other
  misc_feature (130)..(130): n is a, c, g, or t
  modified_base (221)..(221): a, c, t, g, unknown or other
  misc_feature (221)..(221): n is a, c, g, or t
  modified_base (458)..(458): a, c, t, g, unknown or other
  misc_feature (458)..(458): n is a, c, g, or t
  modified_base (464)..(464): a, c, t, g, unknown or other
  misc_feature (464)..(464): n is a, c, g, or t
tcagtacacgtgatcacgaccggtgctcgatttagcgacagcgagaacacacaaagggggaggactgctcagttaggacccagacggaaccatggaagccccagcgcagcttctcttcctcctgctactntggcctccagataccacgtggagaaatagtgatgacgcagtctccagccacgtgtctgtagtctccgagggaagagtccaccctctcctgnacggggaccctgtccgaaggagttcgttgacgagtacacgttcggtcgtacggtaccgagacgaacgaaaccgtacggaccgacggtcccgtacccgaggtccttaccctccgagttaccttagtcggtcgactaccgtccctaaccggacggccgtacgtacggtactccgacgtccgtagttcgaggtccgacggtaggtcggttacgaggggactagtacgtactactccgtanacctanaccgacacgacgtcgtagaccgttagtaccgtaggtaacgttacgtttacgacgtttacgtttaacgttttacaacggtttcgaacgttaacgtaacgttttaaacgggttaaccgttaaccgggttccgggtttaacccggggttaccccgggttaaccgggggttaacccggttaaccgggtaaccgggtttaaccgggttaaggtaaaccggggttaaacttaaaccgggtaaccggaagtttaccgggagttaccggtaccgaacccgttacccgggttattacccttaacggg

SEQ ID NO: 258335 - DNA, 677 bp, Homo sapiens
  misc_feature: GYAE6OF02GKCK7.34.88.H11.1.454.CMB.1.raw
  modified_base (151)..(151): a, c, t, g, unknown or other
  misc_feature (151)..(151): n is a, c, g, or t
  modified_base (256)..(256): a, c, t, g, unknown or other
  misc_feature (256)..(256): n is a, c, g, or t
tcagtacacgtgatcacgaccggtgctcgatttagcgacagcgagaacacacaaaggggaggaactgctcagttaggaccagacggaaccatggaagccccagcgcagcttctcttcctcctgctactctggcctccagataccactgganaaatgtgatgacgctagtctcagccaccgtgtctagtcgtactccgaaggggaaatcgtcaccctcttccaggcacgggcccaggccaggcgtttgtaagccaancctaacgttcggtctacggtaccaggacctaacgggaaacctgggaccgtacgggcctcccgacggtcctacctcgtactcctacgttcggttcaccttagacccctacgacgggacccctagggtacggtatccccgacgaccgtacgggttcacggtgccgaggttcggggtctacggacgtataacgtttccacttccacacctagtccagccgacgccgtagcgtcgtacgtacgtagttcgtttagtccttagtttaacttctcgtacgttaacgcgtaacgtaattaacggtacgtacgggtcccgtacgggtaacccgtcgggttacccgaacgggttaccggtaaacggtacgtaaggttaaccgtaaacgtaacgtacgttagggactcggtacgtaccgtagtccttacgg

SEQ ID NO: 258336 - DNA, 627 bp, Homo sapiens
  misc_feature: GYAE6OF02FYCV5.34.88.H11.1.454.CMB.1.raw
  modified_base (206)..(206): a, c, t, g, unknown or other
  misc_feature (206)..(206): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaaggggaangtccaccctctcctgcagggccagccagagtgtagcagccaacgttggcctggtaccagcaacgaaaccgtggcccgaggcctcccgaggcctccctcatcctagtcggtgccacgtcccgaccgacgggtccctacgttggtacctccccgagtcccgtacggttcaggtcggcgagggttcgggtctaggggacgtaggtacgttccacgtctaccgacctatccgagtcacgtccgtgacgtagtacctaggtaacgttattcgtagacctttaacgtttacttacgttacgtacaagtcgtaacgttaactaagttaacggtcgggtaccggtaggtacccgttaccggaccggtaaggacccgaagggtaacgaacgtaaccgaacgtgtggtacgtacgtcggacctactgttac

SEQ ID NO: 258337 - DNA, 754 bp, Homo sapiens
  misc_feature: GYAE6OF02GMSES.34.88.H11.1.454.CMB.1.raw
  modified_base (207)..(207): a, c, t, g, unknown or other
  misc_feature (207)..(207): n is a, c, g, or t
tcagtacacgtgatcacgaccggtgctcgatttagcgacagcgagaacacacaaagggggagaactgctcagttaggacccagacggaaccatggaagccccagcgcagcttctcttcctcctgctactctggctcccagataccactggagaaatagtgatgacgcagtctccagccaccgtgtctgtcgtctccgagggggaaangtccaccctctcctgcagggccagccagagtgtagcagcaacttggccttggtaccagcaagaaaccctggacccgaggccctacccgaggtcctcccgtcattctagtggtcgccaactccgaccacggggcctaacgtggtacctcccgagtcccgtaggttaccaggtggactagggttcggggttacgtacggggaactaacggtaatttcccaacgtttcccgttaccacccgtattacgaacgccaggtccctgaaccgtacgtttacgaggttaacgtttacgttttacgtacgttaacgttttttaacgttacttcggttaccgaaggttccgtttaagttaaccgttttaaaagttaacgggtttacccgggtaaccggtttaaccgggtaaccgggtttacccgggaacccgggttaaacggggtaacccggttaaaggggttaaaccgttaaaacggttacccgaaaaaccggttaccggttaggttaacgggccgttaacccggaccctaaccggttacgttccggtttaaccgg

SEQ ID NO: 258338 - DNA, 568 bp, Homo sapiens
  misc_feature: GYAE6OF02FR7QC.34.88.H11.1.454.CMB.1.raw
  modified_base (206)..(206): a, c, t, g, unknown or other
  misc_feature (206)..(206): n is a, c, g, or t
  modified_base (302)..(302): a, c, t, g, unknown or other
  misc_feature (302)..(302): n is a, c, g, or t
  modified_base (328)..(328): a, c, t, g, unknown or other
  misc_feature (328)..(328): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggcctcccagactaccactggagaaatagtgatgacgcagtctccagccaccgtgtctgtgtctcaggggaaanagtcacctctcctgcgaggccagccagagttgtagcagcacttgctgtaccagcagaacctggaccaggcctccaggcctcctcgatctagtgtcncatcccaccgagggccacgttgtacnccgagcctaggttcagtgctaggtggtctagggactagaacttcacctctacacctatcagaccagcctggactacggtctaaggaattagtttgacgttaagttttacgttactcgttacgacgtactagttaattaaacgtacgtaccggtccgtaccgggttacgtcccgggaaccgagggtaccgaaggtggaacttaccgaaagtacgtgtacgacgtgacccacttatcgttcg

SEQ ID NO: 258339 - DNA, 734 bp, Homo sapiens
  misc_feature: GYAE6OF02FZ3P1.34.88.H11.1.454.CMB.1.raw
  modified_base (206)..(206): a, c, t, g, unknown or other
  misc_feature (206)..(206): n is a, c, g, or t
  modified_base (236)..(236): a, c, t, g, unknown or other
  misc_feature (236)..(236): n is a, c, g, or t
  modified_base (246)..(246): a, c, t, g, unknown or other
  misc_feature (246)..(246): n is a, c, g, or t
  modified_base (264)..(264): a, c, t, g, unknown or other
  misc_feature (264)..(264): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaanagtccaccctctcctgcagggccagccagngtgttagcancaattcggcctggtaccngcagaaacctggccacggcctcccgaggccctccctacattcctagtggtgccagtacccacgtacggggcctaccgtggtaacctccccgaggcccgtaggttacacggttggctacgggttggggtcgtacggggtaccgtaggtaccctttacgacctttccgtaccgaaccctacgtaccctaacccgtaggtaccgtacgggtaacgacccgttaagggaacgtttactttttacggacgtaagtttcgtttaatttaccggttacgttacctaaacggtttggttttaccgggttaccttaccgtaaccggtaaccttaccggggttacggttaaaccccggtttccgggaaccggtaaacggggtacccgtaaaggggttaacgaaacgtaaccgtaaaacggtaaccgttagggttcggtaccgtacgaacccggtaacctacggttacgtcgttttaaccc

SEQ ID NO: 258340 - DNA, 748 bp, Homo sapiens
  misc_feature: GYAE6OF02HU9WJ.34.88.H11.1.454.CMB.1.raw
  modified_base (312)..(312): a, c, t, g, unknown or other
  misc_feature (312)..(312): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaaggggaagagtcaccctctcctgcgagggccagccagagtgttagcagactaacgttggcctggtaccagcaacgaacctggccaggcctccgaggctcctacatctagtggtnactactcccgaaccgacggggcctaacgttcgggtaactccccgaaggtacccgtagggttccagggttcggacgtagggttacgggtcgtagggaacctaaggttaactctacgtctaccaacctactacgacgaccgtacgtccgtagtacgacgttaccggtagtaaacggttacgtttttacgacgtttaacggttttaacgttacgtttacggttacgtaaggtacgttaacgttaacttaaacggttaaccgttaccgggttacccgggttaccggggtaaccggtttaccggggaacccggttaacggggtaaccggttaaacggggttaacggttaaaaccgtttaaccggtaaaaccgggttaaccggtttagggtaccggttaaccgttaccggaccttaaccccggtacgttaccgttaacccgg

SEQ ID NO: 258341 - DNA, 653 bp, Homo sapiens
  misc_feature: GYAE6OF02F4OA4.34.88.H11.1.454.CMB.1.raw
  modified_base (207)..(207): a, c, t, g, unknown or other
  misc_feature (207)..(207): n is a, c, g, or t
  modified_base (217)..(217): a, c, t, g, unknown or other
  misc_feature (217)..(217): n is a, c, g, or t
  modified_base (464)..(464): a, c, t, g, unknown or other
  misc_feature (464)..(464): n is a, c, g, or t
  modified_base (519)..(519): a, c, t, g, unknown or other
  misc_feature (519)..(519): n is a, c, g, or t
  modified_base (525)..(525): a, c, t, g, unknown or other
  misc_feature (525)..(525): n is a, c, g, or t
  modified_base (644)..(644): a, c, t, g, unknown or other
  misc_feature (644)..(644): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggcctcccagataccgactggaagaaatgtgatgacgcagtctccagccacgtgtctgtctctccgaagggaaangtccaccctntcctgcacgggccagccagtgttgtacgctagctaacgttggccctaggtaccagacaacgtaaccgtggacccgtaggcctaccccgaggtccctaccctagtacgttacgttacgtcggtacgaccgttaaccgtcccgaacggtcggaccctacggttaggtaccctaccgagtacccgtaggttaccgaggttcgacgtaggtcggtacgtagggactagtaccgttcaccgtctacaccgtnaccgagcacgtcctgacctacgtgtagtaacgttagtttcgactttagtttaacncgttanacgacgtacttaacgttaactaacgtacgtcccgggttccgtaccgggtactaccggaccgtaggaccgtaggttacgaacctacgaaccgttagtggtaccacggttaccacttacgnttaccgtcg

SEQ ID NO: 258342 - DNA, 736 bp, Homo sapiens
  misc_feature: GYAE6OF02JA38G.34.88.H11.1.454.CMB.1.raw
  modified_base (148)..(148): a, c, t, g, unknown or other
  misc_feature (148)..(148): n is a, c, g, or t
  modified_base (175)..(175): a, c, t, g, unknown or other
  misc_feature (175)..(175): n is a, c, g, or t
tcagtacacgtgatcacgaccggtgctcgatttagcgacagcgagaacgacacaaaggggaggaactgctcagttaggacccagacggaaccataggaagccccagcgcagcttctcttcctcctgactctctggcctccagataccntggagaatagtgatgacgcagtctccngccaccgtgtctgtcgtacctaccgaggggaaactgtccaccctctccgtgcgacggccagccgaggagttcggtagctaggcctaacgttggcctaggtaccagccgtaagaaaccgtggaccgaagtcccaccgtacggtaccttcccggtacacgttaccgtattcgggtctaccgtaacttcccgaaccgcgggttaccctacggttaccgttaccgaccccgtaacgtaccggtacggttaccgtagggcgtaaccggtagggttccggtaggtaccggacttacgtaacgttccgtaaccgttcaccgtacgtacgtcgacttacgcgtacgtcgacgtacgtacgcgtaacgttcgttacgactttactttaacgctttacggacctagtacggtaacgttaactacgttaacgggtccgtttacccggacggttaccgggtccgtaaacccggtagtaaccccggtaaggttacccgtaacgttaaccggaaacgttaccggttaaggtccggttaccgtacggttaaccctacggtaaccgtcgttaaccgg

SEQ ID NO: 258343 - DNA, 895 bp, Homo sapiens
  misc_feature: GYAE6OF02FNBE4.34.88.H11.1.454.CMB.1.raw
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccatggagtaaatagtgaatgacgtcagtcctccagcctaccggtgttcgtggttgtcctccgaagggggaaagagtcctaccctctccgtagcgacgggccagcccagtagtgttagctaggcctaacgttcggccgtaggtaccaggaccaacgtaaaccgtgggcccaaggtcctacccgaggtcccgttccctacgtacttccgttaaggtcgggttacgaccgtaccttaccccgaaccggtaacgggtacccgtaaccgtttacgggggtaacctaccccccgggaaggttacccggttaacggggtttaccgtacggggtttcgggaaccgtttaacggggttcgggggtttaccggtacggggggtaaaaccctttaacgggtaaacgtttacccgtaaccgtttccctaaccgtaaccccgtaacgttaccggaaaccgtccgtaaacccgggttacccgtacggtaccctacgggtttaccgtaggttaaaccgtttagtttttacggacgttttaacgttttacgtttaacgtcgttacgtaacgtacgttaaacggtttaacgtttaaaacggttaccggtttaccgggtaccccggggtttaaccgggtaccggtttacccggggaaccggtaaacccggggtaacggtaaccgggtttaacggtaaccgtttaaccgtaaacccggttagttcgggtaccgtacgtccggttacccaaccgttacgtaccgttccgg

SEQ ID NO: 258344 - DNA, 667 bp, Homo sapiens
  misc_feature: GYAE6OF02JFKPL.34.88.H11.1.454.CMB.1.raw
  modified_base (208)..(208): a, c, t, g, unknown or other
  misc_feature (208)..(208): n is a, c, g, or t
  modified_base (322)..(322): a, c, t, g, unknown or other
  misc_feature (322)..(322): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggcctcccagataccactggagaaatagtgatgacgcgagtctccagccaccgtgtctgtcgtctacgaagggaancgtccaccctctccgtgcgacggccagccagtagttgtagcagctaacgtggctcgtaccagacaacgaaccgtcgccgagcctccgagtcctcctcacttacgtagtggtacncctaccgtccgaccggcggtaccctagtcggttacccaccgacgccgtaggttccgtaggtcggtatacgggtcggtacgacggtacgtaagtaaccttccgacttaccgtaccgaacctaagttcccgaacgaccgtaccgtccgtagaccgtaacgttcggaagttacgttcgtttcgtacgttagtttactacggttgtaacaccggtataacgttaacgtaacgttaccgtcggtaacccggtcggtacggtaccgaacgtaccgggagtaacggttaacggtaacttacgaaaccgtggtttacgaccgggttctaccgaccgtactaggtcccttaacg

SEQ ID NO: 258345 - DNA, 699 bp, Homo sapiens
  misc_feature: GYAE6OF02JG0ZC.34.88.H11.1.454.CMB.1.raw
  modified_base (167)..(167): a, c, t, g, unknown or other
  misc_feature (167)..(167): n is a, c, g, or t
  modified_base (207)..(207): a, c, t, g, unknown or other
  misc_feature (207)..(207): n is a, c, g, or t
  modified_base (541)..(541): a, c, t, g, unknown or other
  misc_feature (541)..(541): n is a, c, g, or t
  modified_base (587)..(587): a, c, t, g, unknown or other
  misc_feature (587)..(587): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggcctccagataccactggagaaatagtgatgacncagtctccagccaccgtgtctgtgtcctacgaggggaaanacgtacaccctctcctgcgtagggccagtcagagttgttacgcagactacgttggccttaggtaccagaccgtaacgaaaccgtcggacccgaaggtccctacccgaggtaccctcccggtcacttacctagttcgggcgtacctacgtccccaaccggaaccggggtccctaacggtttccgggtaactcccccgggtacacccggttaacgggtttccaggggttacgtcgtaaccggggttgggttaccgtaggggacgtaaaggtaaccttccctacgtactaccctaaccgataccgacggtaccacggtccctcgagtaccgttacgnggtaaactttgtttacggtacttacgttttacgttacttgtaccgngtactaagttaactaagtaccgtagtccgggtaccggtaactcgggacccgaggtacccggaggtcggtaactacgtaacgacttcggtagtctaccgatacgtactgttcg

SEQ ID NO: 258346 - DNA, 606 bp, Homo sapiens
  misc_feature: GYAE6OF02HPHES.34.88.H11.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (319)..(319): a, c, t, g, unknown or other
  misc_feature (319)..(319): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctcgaggggaaangtcaccctntcctgcagggccagccagagtgttagcagactaacttggcctggtaccagacaagaaaccgtggaccaggcctaccccgaggtcctccctcactctagttggtcncactcccacgacggccagtcggtacctcccgagccgtaggttcaggtgcgtaggtggtcgtagggacagtacttcactctacctacacgtcacgcacgtacttgacgtcgtagtaagttatttgactaagttattattacgtcgtacacgttacaagttactacgagtaccgtcgtacgtcgggtcgggtcggttacggaccggtaacggggaaccgtaacgggtaaggtaaaccgtaacgtaaaccggtacggttacggtacggtacgtacgaccgtaaccgtacg

SEQ ID NO: 258347 - DNA, 737 bp, Homo sapiens
  misc_feature: GYAE6OF02IO15O.34.88.H11.1.454.CMB.1.raw
  modified_base (191)..(191): a, c, t, g, unknown or other
  misc_feature (191)..(191): n is a, c, g, or t
  modified_base (205)..(205): a, c, t, g, unknown or other
  misc_feature (205)..(205): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtntctccgaggggaangtcacctctctgcaggccagccagagtgtagcagacaacgttcggcctagggtacccagacaacgaaaccgtggaccgaggcctcccgaggtccctccgtacattacgtagttcgggttcgaccactacccgaaccggtacgggacctacgttcgggtaacctcccgacgtaccgtagggttacgaggtcgggacgtagggtcgggttcgtaaggggactaaggtaaactttcgaaccctttctacctaaccctaacgtaccgaacggtaccgacgtaccccgtagtaccgtacggttacgttaaacggtaaggtttacgtttttacgggtaaccttttaacggtttttaaacttttcgtacggtaccgtaagtacccgttaagtttaaacgttaaacgttaaccggtcgggttacccggtaccgggggttaaccgttaccggggaaccgtaggggaacccgtaaagggtacgtaaacgttaacgaaaccgtacgttaggtacggaccgtcgaccgtacctagtccgttacg

SEQ ID NO: 258348 - DNA, 706 bp, Homo sapiens
  misc_feature: GYAE6OF02JI8J9.34.88.H11.1.454.CMB.1.raw
  modified_base (211)..(211): a, c, t, g, unknown or other
  misc_feature (211)..(211): n is a, c, g, or t
tcagtacacgtgatcacgaccggtgctcgatttagcgacagcgagaacacacaagggggaggaactgctcagttaggacccagacggaaccatggaagccccagcgcaggcttctcttcctcctgctactctggcctcccagacaccactggagaaatgtgatggacgcagtctccagcccgtaccctgtctgtcgtctccgaaggggaanacgtcccacccttctaccgtgcgaggccagtccaggtcgtgttcggcagacctaacgttgaccgttcggtaccacggtacaacggtaaacgtcggaccgacggcctaccccaggaccgttcccctatcgttactacgtcgaccttaaacgacttaccccgaaccgtacgggtaccccagttcgaccttacttccgaacgtaccgtagttacgcgtacggcgtaggtcgggtacgtcgggtacagttacgtctacgtccgtaccaccgtacacgtacgacgtacgccgtactacgtacgtaccgtagtaaggtacttacgtcgtcttaacgtttaccttacgttcgtactacgtacgttacgtaacgttacggttaagtccggttacgtccgggtaacggttccgaaccggaacggtaacggtaacggttaacggtaaacgtaacccgtaaggttaacggttacggccggttaacctcggtaccctaagttaccgg

SEQ ID NO: 258349 - DNA, 685 bp, Homo sapiens
  misc_feature: GYAE6OF02HXRM0.34.88.H11.1.454.CMB.1.raw
  modified_base (198)..(198): a, c, t, g, unknown or other
  misc_feature (198)..(198): n is a, c, g, or t
  modified_base (298)..(298): a, c, t, g, unknown or other
  misc_feature (298)..(298): n is a, c, g, or t
tcagtacacgtgatcacgaccggtgctcgatttagcgacagcgagaacacacaaaggggggaggaactgctcagttaggacccagacggaaccatggaagccccagcgcagcttctcttcctcctgctactctgctcccagataccactggaagaaatagtgatgacgcagtcctcacgcccaccgtgtctgtgtccncgaaggggaaacgcgtcacccttacctcgtgcgcgggacagcaggagtgttagcagctaacgtggcctggaccagacgaacgaaccgtcggaccaggccncccgaggtcctaccgtcacgtctagtcgggtcactaccgtcccaccggacggcctaacgtggtacctacccgaggtaccgtaggtcacgggtggacgtaggtgggtcgtaggacgaactacgtcaccgtctcacactacgcgaacgtgtccgtagaccaggtacccgtagttaaacgttctttacggtactttaacggttttataccgtacggtacttaacggtactaacgttaaattaaaccggttaccgtccggtaccccggggtttaacgggaccgggtccgggaaccggtacgggaccggttaagggtaacggtacttaaaccggaaaccgttacggtcggtacggaccggttaaccgactttacccgagtttacccggttag

SEQ ID NO: 258350 - DNA, 734 bp, Homo sapiens
  misc_feature: GYAE6OF02FU9ZN.34.88.H11.1.454.CMB.1.raw
  modified_base (204)..(204): a, c, t, g, unknown or other
  misc_feature (204)..(204): n is a, c, g, or t
  modified_base (392)..(392): a, c, t, g, unknown or other
  misc_feature (392)..(392): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccaggggaangtccaccctctcctgcagggccagccagacgtgttagcagccaattggacctggtaccagcaagaacccgtggcccgaggcctaccccgaggcctcccgtcacttctagtcggtgctactcccaacgacggggcccacgtggtaacctcccgagacccgtaggttcaggtcggcctaggtggggttcncggggtaacaggtaccttcgtacctctaccgacctacgtacccaaccgagaccgttacggaccgtccgtaacgtaacgtacgttttcgtacgtaggtttacgttaactttacgttacgtaacgtaaaccgttacggttacgggttaccttaccgtaccgtaaccgtttaacgggttcgggttaacccgggtttaacgggaccccgggttaaaggggtacccggtaaacggggttaaccggtaaaacggttaacccggtaaaaccgggtaaccggtttaacgggtccggttaccggtaaccgtaccggttaaccccgtagtttacccggttaggtttaacccc

SEQ ID NO: 258351 - DNA, 640 bp, Homo sapiens
  misc_feature: GYAE6OF02GNUM3.34.88.H11.1.454.CMB.1.raw
  modified_base (204)..(204): a, c, t, g, unknown or other
  misc_feature (204)..(204): n is a, c, g, or t
  modified_base (345)..(345): a, c, t, g, unknown or other
  misc_feature (345)..(345): n is a, c, g, or t
  modified_base (423)..(423): a, c, t, g, unknown or other
  misc_feature (423)..(423): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaatagtgatgacgcagtctccagccaccgtgtctgtgtctcgaaggggaangtccaccctctcctagcacgggccagccagagttgtagcagctacgtggcctggtaccagcaagaacctgacccaggcctcccgaggtccgtctcgactcgtgtggtacgctacgtccaccgacggtccacgtcggtaccnccctagcccgtaggttcacggttcggacgtagggtcggtcgtagggactaaggtacttccgtaactccgtactacccngtaccaggtcccagtccgtagcgttacgtacagttaacgtttttacgactttagttactcttgcgattagtaagttaacgtaacgttacgtccggtaccggttcggggtaaccgtaccgggacccgtaagggtaccgaaggggttaacggtaaacctttacggaaccgttacggtagggttcgacgttaacgtaacccggctttacggtccgttccg

SEQ ID NO: 258352 - DNA, 785 bp, Homo sapiens
  misc_feature: GYAE6OF02G8EOT.34.88.H11.1.454.CMB.1.raw
  modified_base (417)..(417): a, c, t, g, unknown or other
  misc_feature (417)..(417): n is a, c, g, or t
  modified_base (608)..(608): a, c, t, g, unknown or other
  misc_feature (608)..(608): n is a, c, g, or t
  modified_base (660)..(660): a, c, t, g, unknown or other
  misc_feature (660)..(660): n is a, c, g, or t
  modified_base (753)..(753): a, c, t, g, unknown or other
  misc_feature (753)..(753): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagactaccactggataaatgtcgatcgacgtcagtcctccacgccctacggtcgtctcggtcgtccgtaccgaaagggggtaaacgtacggtaccctccccgttccgtccgtacggaccacgggggaccctacggaccgaacggggtagttcgggttaacgacgtaccggtaccgtaacgggttccggccgttacggggtaaccaccggaacgtaaaccggtaaccgttcggacccgggtaccgtacccggtacccgtacgggtcccttcccggttanaacccggttaatcggtaccggttcgaaccctacctacccggaccggtacggtacccgacgtttacggaccgacccgtacgaccggtcggtacgacgggtcgacggttacgggttcgaccgggttaggacgtaacctaaccggtccctaacgtcccgtaaccgacttacggacctacgacgtaccgtcgtanacggtcgtacgtagtagttacgttaccgtagttacgtgttactctacggtanagttaaacgacttaacgtacgtcggggtaccgttacgggtcaccgggaccgttacggacggtaacgtaacggtacgttaaactcgtaacggtntacgtccggacctacgtactacgttagttcgg

SEQ ID NO: 258353 - DNA, 768 bp, Homo sapiens
  misc_feature: GYAE6OF02GGWQF.34.88.H11.1.454.CMB.1.raw
  modified_base (207)..(207): a, c, t, g, unknown or other
  misc_feature (207)..(207): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagactaccactggagaaatagtgatgacgcagtctccagccaccgtgtctgtgtctccgaaggggaanagtcaccctctcctgcacgggccacgccagagttgtagctagactaacgttggcctggtaccaggaccaacggaaacctgggaccacggcctccccgaggtcctccgtactagtcctagtggttcgacctaccttacccaaccgtacggggaccctacggttacggtacctaccccgacgtacccgtagggttccaagggtcggcgtaacggttcgggtacgtacggggtaacaagtaacgtttcccaaccgttcctaccgaaccctactacggaacaccgaaccggtacctccgtacgtaacggttacccgtaggtaaacggtttatttcgggtaacttttacggtttaaactttacggttcgttaccgtaacgaccggtaaatttaaaccgttaagttaaccggtaccgggtacccgggttacccgggggtaaccgtttcccggggaaacccggtaaggtacccgggtaaacggggttacggtaaccggttaaaaccgtaaaccggaaccggtttaggaccggtcgtaacggtacccctactacgttaccggtttaccg

SEQ ID NO: 258354 - DNA, 650 bp, Homo sapiens
  misc_feature: GYAE6OF02G1MM2.34.88.H11.1.454.CMB.1.raw
  modified_base (206)..(206): a, c, t, g, unknown or other
  misc_feature (206)..(206): n is a, c, g, or t
  modified_base (313)..(313): a, c, t, g, unknown or other
  misc_feature (313)..(313): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaanagtccaccctctcctgcagggccagccagagttgtagcagctaacgttggcctggtaccagcaagaaccgtggccaggcctcccgaggctacctcatctagtggtcnctactcccgaccgacgggccacgttacggtacctacccgacgtccctagggttcaggtcggacgtaggtcgggtacgtagggactaacgtaattcccaacttcctacaccgtactcgacgcacgtccgtagctacgtcgtacgtaagtttagtttacgtacttagtttacttacgttcgttagacgtactagttaacttaagttaccgtcggtaccggttcccgggtacgttaccgggacccggtaacgggaaccggtaagggtacggtaaaccgttaaccggtaaaacggtacgttacgggttaccggtacgttcgaacctacgtcgttacttacg

SEQ ID NO: 258355 - DNA, 828 bp, Homo sapiens
  misc_feature: GYAE6OF02GQ64T.34.88.H11.1.454.CMB.1.raw
  modified_base (673)..(673): a, c, t, g, unknown or other
  misc_feature (673)..(673): n is a, c, g, or t
tcagtacacgtgatcacgaccggtgctcgatttagcgacagcgagaacacacgaaagggggaggaactgctcagttaggacccagacggaaccatggaagccccagcgcagcttctcttcctcctgctactctggcctccagtactaccacgtaggaagtaaagtagtcgaagttcggaaccggctaacgttcctccgacggacccctaaccggttgttaccgtggtcgttcccgtaccggaaagggggaaactcgtaccctacccttcgtaccgtagccggaagggccccaggacccgaggtacggttacggttacgccgtaacgtccgttaaccgttccggtaccgttaccggtaaccgacggtaccgaaacggttaaacccgtcggaccgtaaccgggtccctaccggtaaccggttccctacccgttactaacgtaccgttaacggtcggtacctacgtaacctacccggaccgtacggacccgttacgttacgggtaccctaccggacgtaccggtaacggttcgtacggtacggtctaacgggttcgtacggtacgaagtaccgttatccgttacacgttaccacgttacgacgacgtaccacgtacgttacgacgttacgtacggtacgttaagtttacggttctacgtttaattaccgggtttanacggtaccgaagtacgttaacgtaacttaacgttaccgggtcccgaccggggttaccggtaacggtaccggtaaccggaacgcggtaaggtacggttaaacctacggaacgtaaccgtggtaccgtcgaacctacggtacctaccggttgttacg

SEQ ID NO: 258356 - DNA, 726 bp, Homo sapiens
  misc_feature: GYAE6OF02H2JYO.34.88.H11.1.454.CMB.1.raw
  modified_base (156)..(156): a, c, t, g, unknown or other
  misc_feature (156)..(156): n is a, c, g, or t
  modified_base (302)..(302): a, c, t, g, unknown or other
  misc_feature (302)..(302): n is a, c, g, or t
  modified_base (338)..(338): a, c, t, g, unknown or other
  misc_feature (338)..(338): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagactaccacgtggaanaaattggtgatgaacgcagtctccagccaccgtgtctgtcgtcctacgaggggaaagcgtccacctctctcgcgcggcagccgagagtgttacgcagctaagttcgcctggtaccgagctaacgaaccgtcggaccgtacggtccncccgacggtcctacccgtacagtttctagtcggtcncgtacctccgacgtacggacctacgtacgttaccacccgaggtacccgtacggttcaggtacggttccgaagggttcggggtacgtcgggtaacgtacgtaaccttcctacgttttacctaacctaacgtacgaaacgtacgtaacgtcgggtacgtcgttaacgggtatcttacggtacgacgtttacgtaccgttttaagtacgttacgtaaccttaaagttccggtttagttaccttacctttagtttaaccccgtttttccgggttcccgaacggtttaaccgtaacggttacgttacggttaaacgacgttaaaccgtaacggtacgttcggtagtacccgttagttaccgaccgttacggtttacctaggtttccttaaccg

SEQ ID NO: 258357 - DNA, 855 bp, Homo sapiens
  misc_feature: GYAE6OF02GJCYB.34.88.H11.1.454.CMB.1.raw
  modified_base (241)..(241): a, c, t, g, unknown or other
  misc_feature (241)..(241): n is a, c, g, or t
  modified_base (592)..(592): a, c, t, g, unknown or other
  misc_feature (592)..(592): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtcctaccgaaggggaaagacgtccaccctctcctgcgagggccagccagngtgttagcagctaacgttcggcctacggtaccagtacgaacgaaaccgtgacccgacgggcctacccgaggtaccctcccgtactaccgttactaacggttcgggtacgacctaacgtaccccgaaaccgggtaaccggggtaccccttaaccggttacggggttaacccttacccccggaaaccgggtcccggttaaccggggtttaaccggaaccggggttacgggggaccggtttaggggttacggggggtttcccgggtaaagggggtaacctaaacggggttaacgttttccgaaaccctttccgtaacccaaccgtacgtaccaacggtaccgacggttacccgnggtacccgaggttacccgtaagggttaacgtttacgtttcggtaacgttttaacgggttttaacttacggttaccgttacgtacgtaacgtaaacggtttaaccttaaagtttaaccggttacggtaccccgggttacggggtaacccgttacgggtaacccggacggggtaaccgtaagggtaaccggttaacgttaaccggaaacgttaacggttacggtacggtaccttaacgggaccctaacgttacgttcgttaaccg

SEQ ID NO: 258358 - DNA, 695 bp, Homo sapiens
  misc_feature: GYAE6OF02HHU8J.34.88.H11.1.454.CMB.1.raw
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaaggggaaatgtaccacctctacctgcacgggccagccgagacgtgttagcagctaacttggcctaggtaccagtcaacgaaaccgtcggacccaggcctacccgaggtcctcctcacttctatggtcaccactcccgaaccgacgggccctagttcggtactccccaggtaccctaggttcagggtcggcagggttcgggtacgtagggacgaaaggtacttccgaccttaccgtacctaacgtctaccgagtacacgtacccgtcgaccgttagtacgtaggtaacgttcttttacgacgttagttttaactacgtgtacgacgttacttaagacttaaaccgttacgaccgggttacccggtacccggggtagttacccggaaccgggtaacggtacccgggttaagggtaacggtaaccggttaaaccgaaacggttaaccggttggtaccggtccggtaaacggcccttaaccggttacgttaccggttaccg

SEQ ID NO: 258359 - DNA, 943 bp, Homo sapiens
  misc_feature: GYAE6OF02HFQ2M.34.88.H11.1.454.CMB.1.raw
  modified_base (211)..(211): a, c, t, g, unknown or other
  misc_feature (211)..(211): n is a, c, g, or t
  modified_base (387)..(387): a, c, t, g, unknown or other
  misc_feature (387)..(387): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggcctcccagataccactggagaaatagtgatgacgcagtcctccagccaccgtgtctgtgtcctaccgagggggaaancgtcacccctctcctgcgacgggccagccagagttagttacgcagtcaacgttcggtccgttagggtacccaagaccgtaacggtaaacccgttcgggacccgacggaccgttaccccggagggcccttaccccgttctaacgttacctttacggtacgggttaccgacctttacnccccggaacccggaacggggccccttaaccggttcggggttaaaccctccccgaacggcccggttacgggttaccgagggttccgggtacgtacgggttagggggttttccggaaggggttaccaaacgggttaacctttccgtaaccgtttcccttaccgaaccctactaccgtaacggaccgtacgtacccgttacgtaccgttacggttacgtaacggttaaacgggtttacgtttttaccggttagtttaaccggttttaacgtttaccgttacgggtttacgtaacggttaccggttaaaacgtttaaacgttttaaaaccgttaaccgggtttacccgggggttaacccccggggtttaacccggggggttaacccgggttttaacccggggaacccccgggtaaaccgggggggtaaacccggttaaccggggggtttaaacgggtaaacccggttttaaacccgtaaaaccggggttaaccgtttaacgggttaacggttaccgggttaaccggtacccctaacccgttacgtaccccgttttaccgg

SEQ ID NO: 258360 - DNA, 785 bp, Homo sapiens
  misc_feature: GYAE6OF02GWSSX.34.88.H11.1.454.CMB.1.raw
  modified_base (206)..(206): a, c, t, g, unknown or other
  misc_feature (206)..(206): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaangtcaccctctcctgcgagggccagccagagtgttacgcagacgtaacttggccttaggtacccaggccaagtaaacccgtggacccagggcctcccgaggtccctccgtacattctagtcggtcgacacgttacccgaaccgacgggtcccaacgttcgggtacctaccccgaggacccgttacgggttaccgagggttcggacgtagggttcggggtcgttacgggggaactaacggtaactttcccaacgtttccctaccaacccgttagtaccaacgtaccgtaccggtccgtacgtacctacggggttaccaggtttaaaggttcctttttacggaccgttttaaaggtttttaacctttacggtttacggtaaccgtacgtaacgtttaaacggtttaaataaaccgttacggttaccccggggttaccggttaacccggggtacgtttacccgggtaacggtaacggggttaacgtaacggggttaacggttaaactttaaaccggaaacccggttaccggtttgggtaccgaccgttacggtaacccgtaaccttagtttaccccgttcggg

SEQ ID NO: 258361 - DNA, 812 bp, Homo sapiens
  misc_feature: GYAE6OF02GVYD1.34.88.H11.1.454.CMB.1.raw
  modified_base (153)..(153): a, c, t, g, unknown or other
  misc_feature (153)..(153): n is a, c, g, or t
  modified_base (191)..(191): a, c, t, g, unknown or other
  misc_feature (191)..(191): n is a, c, g, or t
  modified_base (203)..(203): a, c, t, g, unknown or other
  misc_feature (203)..(203): n is a, c, g, or t
  modified_base (211)..(211): a, c, t, g, unknown or other
  misc_feature (211)..(211): n is a, c, g, or t
  modified_base (214)..(214): a, c, t, g, unknown or other
  misc_feature (214)..(214): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactgganaaatagtgatgacgcagtctccagccaccgtgtctgtntctcgagggaangtcacctntcngcgaggccagccagagtgttagcagactaacgttcggccgtaggtaccagactaacgaaaccgtcggacccgacggccctaccccgacggtcccttaccctccgtacttacgttacgttcgggtctacctaccgttacccgaaccggtaccgggaccctaaccggttaccggtacctccccggtaccgtccggtacggttaccgtaacgggtcggtaaccgtagggttacggggttacggtacggggaacgtaacgtaacgttaccgtaccgttacctacccgtaacctacgtaacgtaccgtaaccgtaccgtacccgttacggtacgtacgttacggtaacgttaacggtttacgttttacgtacgtttaacgtttttacttacgttacgttaccgaacgttaacgttaacgtaacgttaaacgttaccggtaccggggttacccgggttaccgggttaaccggggtaccggtaacccgggtaacgggtaacccgggttaacgggtaaaccggttaaacggtaacccgtaaacgggtaacgtttacgggtaccggtacgttaaccggtaccctaacggttccttacggtttaccgg

SEQ ID NO: 258362 - DNA, 847 bp, Homo sapiens
  misc_feature: GYAE6OF02I8V6X.34.88.H11.1.454.CMB.1.raw
  modified_base (157)..(157): a, c, t, g, unknown or other
  misc_feature (157)..(157): n is a, c, g, or t
  modified_base (172)..(172): a, c, t, g, unknown or other
  misc_feature (172)..(172): n is a, c, g, or t
  modified_base (210)..(210): a, c, t, g, unknown or other
  misc_feature (210)..(210): n is a, c, g, or t
  modified_base (227)..(227): a, c, t, g, unknown or other
  misc_feature (227)..(227): n is a, c, g, or t
tcagtacacgtgatcacgaccggtgctcgatttagcgacagcgagaacacacaaaggggaggaactgctcagttaggacccagacggaaccatggaagccccagcgcagcttctcttcctcctgctactcctgggcctcccagactaccactggaanaaatgtgatgaccgnagtctccgagccaccgtgtctgtcgtctccgagggaancgtaccaccgtctccgngacgacgggccaggcccgaggtacgtgttaacgctaaggcctaagtcggtaccgtcggtaaccacggcgaacgtaaaccgtcgacccgtaggtcctccgacggtcctacccgtctacttaccgttagtacgggtcgtactaacggttacccaacccggacggggtaccaacgggtttccggtaaccttaccccggaaccgtcccgggtaacgggtttacccgaaagggttcgggaccgggtacgggtttacggggtaaccgggttcggggtaaacgggtacgttaaacccggtttactacccggtttaactacccgaccgttaaacccgttcgaccgttaccgtaaccggtcggtaccgacggttaaccggttcccgtagggttaacgtttaacggttttaccgtacggttttaacctttaaaggttttacccgttacgtaacccggttaagtaccgtttaaaggtaaacgtttaacttaacccggtccggttacccggggtaaccgggtttacccggtaccgggtaaccggtacggaaccggtaagggttacggtaaacggtttaccaaaacggtcgttaggtacgtaccgtacgtacgtacccgtagttaccgttccg

SEQ ID NO: 258363 - DNA, 733 bp, Homo sapiens
  misc_feature: GYAE6OF02FSDIT.34.88.H11.1.454.CMB.1.raw
  modified_base (174)..(174): a, c, t, g, unknown or other
  misc_feature (174)..(174): n is a, c, g, or t
  modified_base (183)..(183): a, c, t, g, unknown or other
  misc_feature (183)..(183): n is a, c, g, or t
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (242)..(242): a, c, t, g, unknown or other
  misc_feature (242)..(242): n is a, c, g, or t
  modified_base (272)..(272): a, c, t, g, unknown or other
  misc_feature (272)..(272): n is a, c, g, or t
  modified_base (277)..(277): a, c, t, g, unknown or other
  misc_feature (277)..(277): n is a, c, g, or t
  modified_base (298)..(298): a, c, t, g, unknown or other
  misc_feature (298)..(298): n is a, c, g, or t
tcagtacacgtgatcacgaccggtgctcgatttagcgacagcgagaacacacaaagggggaggaactgctcagttaggacccagacggaaccatggaagccccagcgcagcttctcttcctctgctactctggcctcccagataccactggagaaatgtgatgacgcagtctcngccaccgtntctgtgtcctacgaagggaanatccacctcncctgcagggccagccagtgtgtagcganctacgttgcctggaccagaccgagaaccgngaccnggcctcccgacggtcctcccnctaactcgtagtggtacgctacgtcccaaccggtccgggaccctacgtacggttacctaccccggaggtacccgttagggttacaccggttcggacggtaggttcggttcgtaggggaacctaggtaactcgtacctctaacgacctagtacccgagaccgtacgtcccgtacgaccgtagttacccgtaaggtaacgttcgttttacgacgttttaagtttaacttacggttcgtaaccgtaggtaccttaacggttaagttaaccgttaaccgttccgggtaacccgggttcgggttaaccccgggttacggtaacccgggttacggggtaaccgtaagggggtaaccgttaaccggttaaaccgttaaccgggtacgtttacggggtacgttacccgtacggtaacccgttacgacggtttcccgtttacgg

SEQ ID NO: 258364 - DNA, 902 bp, Homo sapiens
  misc_feature: GYAE6OF02INJH4.34.88.H11.1.454.CMB.1.raw
  modified_base (172)..(172): a, c, t, g, unknown or other
  misc_feature (172)..(172): n is a, c, g, or t
tcagtacacgtgatcacgaccggtgctcgatttagcgacagcgagaaacacacaaaaggggggaggaactgctcagttaggacccagacggaaccatggaagccccagcgcagcttctcttcctcctgctactctggcctacccagacgtaccacgtaggaagaaacttagngactaggacgacgacgttcgtccaggcccaccggtgtcgttgtgtcctaccggaaacgggggaaagtacgtacctaaccccttccgttaccgtacggaccggaaccggggacctaacgggaaccgtaaggtacgttacggttacgacgtaagtaaccgtaacggttaccggtacccgttagggtaaacccgagtaccggtaaacggaaaaccgttccggaccgaccggtaccctacccgtacgggtccttaaccccggtctaacgttccgttaagtcgggtacctaccgtaaccacccgtaaacccgaacgggtacccgtaaccgttaacgttacggtaaccccgaagggtacctaccggttacgtaacggtcgggtaacggttacgggttcggggttccgaaacggggtaacgtaaacggtaacttacccgtaacttacccgtaacgaacctacggtaacctacggaaccgtcggaaccgtcggtaacgtaacgttacccggttaaagtaacgttactttaacgtaaccggtttaagtttaacgtaacgttcggtaacgttaacggtataaacggtaacttaaccggtaaacgttccgggttaacccggttacgggtacccgtaaccggtaaaccgggttacgggaaaccgtaggggtaaaccttaaccgtaacggtaaacccgtggtaaccgttacgaccgtaacgttaaccgacgttaccgtcgtac

SEQ ID NO: 258365 - DNA, 755 bp, Homo sapiens
  misc_feature: GYAE6OF02GF1EW.34.88.H11.1.454.CMB.1.raw
  modified_base (213)..(213): a, c, t, g, unknown or other
  misc_feature (213)..(213): n is a, c, g, or t
  modified_base (622)..(622): a, c, t, g, unknown or other
  misc_feature (622)..(622): n is a, c, g, or t
tcagtacacgtgatcacgaccggtgctcgatttagcgacagcgagaacgacacaaagggggaggaactgctcagttaggacccagacggaaccatggaagccccagcgcagcttctcttcctcctgctactctggcctcccgagactaccgactggaagaaatgtgatgacgcagtctccagccaccgtgtctgtgtcctccgaaggggaaancgtcacccttctccgtgcgacggccagccaggacgttgttagacctagacctaacgtttcggaccgtacgggttaacccacggtaccaaaccggtaaacccgttcgggtccccaagggtacccctacccccggtaggtacccttacccgtacctaacgtttcctagttcggtacgcctaaccttccccgaaccggagggtacccctacggtacggttaaccctcccgtaacggaccgtaggttaccgacggttcggactacgggttcgggtacgtacgggacacggtatttccaactttcgaccaccgtaactacgtacgtcgaacgtaccgtacgacctaggttctacgggtaaatttcgtttacgacgttacgttagttaacgtttagtttacccgacggttaccgngtacgtacaaggtttacccaggttcccggttactaacccggttacgttaccgtttacggaacccgggtacgggtaaccgtacggtccgtacgggaactacgtaaccggtaacgacgtcggtacgtgtaacccg

SEQ ID NO: 258366 - DNA, 717 bp, Homo sapiens
  misc_feature: GYAE6OF02IIXFN.34.88.H11.1.454.CMB.1.raw
  modified_base (147)..(147): a, c, t, g, unknown or other
  misc_feature (147)..(147): n is a, c, g, or t
  modified_base (160)..(160): a, c, t, g, unknown or other
  misc_feature (160)..(160): n is a, c, g, or t
  modified_base (205)..(205): a, c, t, g, unknown or other
  misc_feature (205)..(205): n is a, c, g, or t
  modified_base (220)..(220): a, c, t, g, unknown or other
  misc_feature (220)..(220): n is a, c, g, or t
  modified_base (327)..(327): a, c, t, g, unknown or other
  misc_feature (327)..(327): n is a, c, g, or t
tcagtacacgtgatcacgaccggtgctcgatttagcgacagcgagaacacacaaagggggaggaactgctcagttaggacccagacggaaccatggaagccccagcgcagcttctcttcctctgctactctggcctcccagataccnctaggagaaatgngatcgacgcagtctcagccacgtgtctgtcgtcctcgaggggaancgtccaccttctccngcgcgggccagtccagacgttggtagcgtagcgtaacttggcctaggtaccagcgaagaacctggccaaggcccgtccgaggtcctccgtcattcgttagtcggtanctactccgaccggaaggccctacggtaggttacccaccgtacgtccgtacggtacgtacggtacgcgtacggtcgggtctaaggggtacaggtttaactccgaaccgttccggtaactaccgtacgtaccgtaacggccgtaaaccgtccggtaacacgttaccggtaacgtacggtaaagtttcgtttacgtaacgtttacgttttaacgttaaccgtgttacgggtactaacttaactaagttaaccgtacggttaccgggtaccggtccgggtttaaccgtacggggaaccgtaacgggtaacctaggggttaaccgtaacgttaacgaaaccggttacggtaggttacggttacggtaccgtaaccgtcgttaacgcctttaacgg

SEQ ID NO: 258367 - DNA, 725 bp, Homo sapiens
  misc_feature: GYAE6OF02ILPBC.34.88.H11.1.454.CMB.1.raw
tcagtacacgtgatcacgaccggtgctcgatttagcgacagcgagaacacacaaagggggaggaactgctcagttaggacccagacggaaccatggaaaccccagcgcagcttctcttcctcctgctactctggctcccagatcgccccggagaaattgtgttgacgcagtcgccagacaccctgtctctgtctcgagggaagagtcaccctctcctgcgacggccacgccagtagttagttacgcacgactaacttcggccgtcggtaccagcgaacgaaacctcggaccaggcctccccgaggtcctcctactacgttcctagtcgggtacgaccacgtccgaaccggaccgggtacctacgtacggtaactccccgacgtacccggttaggttccgacggttcggacgtacgggttcggggtacgtacgggacgtaaggtaacgtttacgacccgttacttacccaccgtacgttacgacggcctacgtccgtacgacgtacgttcgtaacggtaatttcggttttacgtacgtttagttttacgttacgtagttacgttaagagttacttaaacgttaagtaacccgttcgggtacccggtttccggggaccgttaccgggaacggtaaccggtaacggtaggttacggtaacgttaaccgaaacggtaacgttcgtgggtactacgtaccctagttacgtacgttccgtccttagttccg

SEQ ID NO: 258368 - DNA, 949 bp, Homo sapiens
  misc_feature: GYAE6OF02GSVMC.34.88.H11.1.454.CMB.1.raw
  modified_base (206)..(206): a, c, t, g, unknown or other
  misc_feature (206)..(206): n is a, c, g, or t
tcagtacacgtgatcacgaccggtgctcgatttagcgacagcgagaacacacaaagggggaggaactgctcagttaggacccagacggaaccatggaagccccagcgcagcttctcttcctcctgctactctggctcccagataccactggagaaatagtgatgacgcagtctccagccaccgtgtctgtgtctccgaggggaaanagtccacccgtctcctgcgacgggccaagccgaagtacgttcggttagcagcctaacgtttggaccgtaggtaccgacgtacgaacgtaaaccgtgggacccaggtccctccccgacggtccctaccgtacgacttccgtaagtcggttacgacctacgtacccgtaacccgtacggggtacccctaacggttcggttaacccgtaccccgaacgggtacccgtaacggggtttaccgacgggtttaccgggaccgttaacggggtttccggggttacggttacggggaaaccgtaagggttaaccgtttcccgtaaacccgttttccaacccgtaacccgtaaccgtaccgtaacgggtaccccgtaccggtaccccggttacggaacccggttacgggttttaccccggtaaagggtttaaaccgggtttaaaccgttttttacccgggtaaacgtttttacggttttttaaacgtttacccggtacggttaaccgtacgttaaccgtttaaacgtttaaaacgttaaacccgtttacccgggtaccggggttaacccccggtttaaccgggggttaacccggttttaccgggaacccggggttaaccggtaaaccgggtttaacggggttaacggttaaaacccggttaaacccggtaaaccggtttaaacgggtcggttaacccgggtaacgttcccggttaaacccggtaaaccgtttccgtaccggttttaacccgg

SEQ ID NO: 258369 - DNA, 774 bp, Homo sapiens
  misc_feature: GYAE6OF02GRXHD.34.88.H11.1.454.CMB.1.raw
  modified_base (170)..(170): a, c, t, g, unknown or other
  misc_feature (170)..(170): n is a, c, g, or t
  modified_base (211)..(211): a, c, t, g, unknown or other
  misc_feature (211)..(211): n is a, c, g, or t
tcagtacacgtgatcacgaccggtgctcgatttagcgacagcgagaacacgacaaagggggaggaactgctcagttaggacccagacggaaccatggaagccccagcgcagcttctcttcctcctgctactctggcctccagactaccactaggagaaatagtgatgacncagtctccagcccacgtgtctgtcgacctccgaggggtaanacgtccacccttctaccgtgaccgtacgggccaggaccctaaggtacgtagttacgcgaacgtaccgtaaacgttcgggccgtaacggtaccaagtaccgaaaccgttaacgtcggaccacgggtccctacccgaggtaccctaccctaccgtaagttcctaaggtcggtcgaacctacgttacccgaaccggtacgggaccctacgtacggtacctacccgaggtacccgtagggttaccagggttccggacgtacgggttcggtacggtacgggaacgtacgtaacttccgacttaccgaacctacgtacctacgaacgtccgtaacgtacgtacgacgtaccgggtcctaaagggtaactttacgttccggtaagttaacttttacgtacgttccgttacaacgggtaaccttaagttaacgttaaacgtacccggttaccgggtaccggtccgggttaaccgtccgggaacgtaacgggtaaccgtaggggttaaactacgaaaccggttacgaaacgtggttaaccgacgttacggaacctacggttctcgttaaccg

SEQ ID NO: 258370 - DNA, 772 bp, Homo sapiens
  misc_feature: GYAE6OF02G88M2.34.88.H11.1.454.CMB.1.raw
tcagtacacgtgatcacgaccggtgctcgatttagcgacagcgagaacacacaaagggggaggaactgctcagttaggacccagacggaaccatggaagccccagcgcagcttctcttcctcctgctactctggcctcccagactaccactggaagaaattagtgatgacgcagtcctcagcctacgtgtctgtcgtctcggaagggaatagtccaccctctcctgcgacgggccagcccgagtaggttgttacgctagcctaacgttcggtccgttaggtaccagaccgaacgtaaaccgtcggaccgacggtcctacccggacggtcccttccgtctacgttaccgtaggttcggtacacctacctaccgaaccgggtacggtcccgtacgttacgtaccgtacccgtacggtaccgttacggttaccgtagggtcggtacggtacgggttacggggttacgtacggggaaccgtaagtaaaccgtttcccgtaaccgtttccgtacccgtaaacctacgtacccgacggtacccgcggtaccctacggtacgtaccggttacgtaacggttaacgttttacgtttacgttaccgtttagtttaaccgttacggtacgttacgacgttaagtaacgttaaacttaacggttaccgtaccgggttacccgggtcggtaacccgttaccgggaacgtaccgggaacgttacgggtaacgtaacctaacgtaacgttacgtacgtgccggtaccacgtacgtcttgttacccg

SEQ ID NO: 258371 - DNA, 174 bp, Homo sapiens
  misc_feature: GYAE6OF01D1SNX.39.88.H11.1.454.CMB.1.raw
  modified_base (174)..(174): a, c, t, g, unknown or other
  misc_feature (174)..(174): n is a, c, g, or t
tcagtcgcactagtcacgaccggtgctcgatttagcgacagcgagaacacacaaaggggtgttcggcggagggaccaagctgaccgtcctaggtcagcccaaggctgccccctcggtcactctgttcccaccctcctcactagtgcgactgagcgggctggcaaggcgcatagn

SEQ ID NO: 258372 - DNA, 182 bp, Homo sapiens
  misc_feature: GYAE6OF01CAOZ6.39.88.H11.1.454.CMB.1.raw
  modified_base (174)..(182): a, c, t, g, unknown or other
  misc_feature (174)..(182): n is a, c, g, or t
tcagtcgcactagtcacgaccggtgctcgatttagcgacagcgagaacacacaaaggggtgttcggcggagggaccaagctgaccgtcctaggtcagcccaaggctgcccctcggtcactcctgttcccgccctcctcactagtgcgactgagcgggctggcaaggcgcatagnnnnnnnnn

SEQ ID NO: 258373 - DNA, 175 bp, Homo sapiens
  misc_feature: GYAE6OF01EWO8L.39.88.H11.1.454.CMB.1.raw
  modified_base (174)..(175): a, c, t, g, unknown or other
  misc_feature (174)..(175): n is a, c, g, or t
tcagtcgcactagtcacgaccggtgctcgatttagcgacagcgagaacacacaaaggggtgttcggcggagggaccaagctgaccgtcctaggtcagcccaaggctgccccctcggtcactctgttcccaccctcctcactagtgcgactgagcgggctggcaaggcgcatagnn

SEQ ID NO: 258374 - DNA, 191 bp, Homo sapiens
  misc_feature: GYAE6OF01CJI8O.39.88.H11.1.454.CMB.1.raw
  modified_base (175)..(191): a, c, t, g, unknown or other
  misc_feature (175)..(191): n is a, c, g, or t
tcagtcgcactagtcacgaccggtgctcgatttagcgacagcgagaacgacacaaaggggtgttcggcggagggaccaagctgaccgtcctaggtcagcccaaggcctgccccctggtcactctgttcccgccctcctcactagtgcgactgagcgggctggcaaggcgcatagnnnnnnnnnnnnnnnnn

SEQ ID NO: 258375 - DNA, 174 bp, Homo sapiens
  misc_feature: GYAE6OF01BA4J1.39.88.H11.1.454.CMB.1.raw
  modified_base (174)..(174): a, c, t, g, unknown or other
  misc_feature (174)..(174): n is a, c, g, or t
tcagtcgcactagtcacgaccggtgctcgatttagcgacagcgagaacacacaaaggggtgttcggcggagggaccaagctgaccgtcctaggtcagcccaaggctgccccctcggtcactctgttcccgccctcctcactagtgcgactgagcgggctggcaaggcgcatagn

SEQ ID NO: 258376 - DNA, 172 bp, Homo sapiens
  misc_feature: GYAE6OF01CCEAE.39.88.H11.1.454.CMB.1.raw
  modified_base (171)..(172): a, c, t, g, unknown or other
  misc_feature (171)..(172): n is a, c, g, or t
tcagtcgcactagtcacgaccggtgctcgatttagcgacagcgagaaacacaaaggggtgttcggcggagggaccaagctgaccgtcctaggtcagcccaaggctgcccctcggtcactctgttcccgcctcctcactagtgcgactgagcgggctggcaaggcgcatagnn

SEQ ID NO: 258377 - DNA, 174 bp, Homo sapiens; identical to SEQ ID NO: 258371
  misc_feature: GYAE6OF01AVIIF.39.88.H11.1.454.CMB.1.raw
  modified_base (174)..(174): a, c, t, g, unknown or other
  misc_feature (174)..(174): n is a, c, g, or t

SEQ ID NO: 258378 - DNA, 550 bp, Homo sapiens
  misc_feature: GYAE6OF01B3D7R.39.88.H11.1.454.CMB.1.raw
  modified_base (267)..(267): a, c, t, g, unknown or other
  misc_feature (267)..(267): n is a, c, g, or t
  modified_base (368)..(368): a, c, t, g, unknown or other
  misc_feature (368)..(368): n is a, c, g, or t
  modified_base (407)..(407): a, c, t, g, unknown or other
  misc_feature (407)..(407): n is a, c, g, or t
  modified_base (415)..(415): a, c, t, g, unknown or other
  misc_feature (415)..(415): n is a, c, g, or t
  modified_base (474)..(474): a, c, t, g, unknown or other
  misc_feature (474)..(474): n is a, c, g, or t
  modified_base (482)..(482): a, c, t, g, unknown or other
  misc_feature (482)..(482): n is a, c, g, or t
  modified_base (537)..(537): a, c, t, g, unknown or other
  misc_feature (537)..(537): n is a, c, g, or t
tcagtcgcactagtcacgaccggtgctcgatttagcgacagcgagaacacacaaagggggagagaggagcccagccctgggattttcaggtgttttcatttggtgatcaggactgaacagagagaactcaccatggagtttgggctgagcgtggtcgttttctagtggctattttaaaaggtgtccagtgtgaggtgcaatgttggagtcgtgggggaggcttgggtacagccgtggggggtccctgagactctcctgtgcagcctntggtttcatctttagcaactacgccatgagctgggtccgcaggctccgagggaaggggctggagtgggtctcgagggtattactggtagtggtaataccgnatactacgcaggactccggtgacgggccggttcaccgtntccagganaccaattccaagtaatacgggtctaatctaggaaatgaacagcctgagagcgaggaccncggccctnttatacgtgtacgcgaagtagatacgaggaacggagtatagctagcagcctagtnacgtagtccgggg

SEQ ID NO: 258379 - DNA, 176 bp, Homo sapiens
  misc_feature: GYAE6OF01C9XJO.39.88.H11.1.454.CMB.1.raw
  modified_base (174)..(176): a, c, t, g, unknown or other
  misc_feature (174)..(176): n is a, c, g, or t
tcagtcgcactagtcacgaccggtgctcgatttagcgacagcgagaacacacaaaggggtgttcggcggagggaccaagctgaccgtcctaggtcagcccaaggctgccccctcggtcactctgttcccgccctcctcactagtgcgactgagcgggctggcaaggcgcatagnnn

SEQ ID NO: 258380 - DNA, 174 bp, Homo sapiens; identical to SEQ ID NO: 258375
  misc_feature: GYAE6OF01DCOJQ.39.88.H11.1.454.CMB.1.raw
  modified_base (174)..(174): a, c, t, g, unknown or other
  misc_feature (174)..(174): n is a, c, g, or t

SEQ ID NO: 258381 - DNA, 179 bp, Homo sapiens
  misc_feature: GYAE6OF01BRKJD.39.88.H11.1.454.CMB.1.raw
  modified_base (174)..(179): a, c, t, g, unknown or other
  misc_feature (174)..(179): n is a, c, g, or t
tcagtcgcactagtcacgaccggtgctcgatttagcgacagcgagaacacacaaaggggtgttcggcggagggaccaagctgaccgtcctaggtcagcccaaggctgccccctcggtcactctgttcccgccctcctcactagtgcgactgagcgggctggcaaggcgcatagnnnnnn

SEQ ID NO: 258382 - DNA, 177 bp, Homo sapiens
  misc_feature: GYAE6OF01CVSK1.39.88.H11.1.454.CMB.1.raw
  modified_base (173)..(177): a, c, t, g, unknown or other
  misc_feature (173)..(177): n is a, c, g, or t
tcagtcgcactagtcacgaccggtgctcgatttagcgacagcgagaacacacaaaggggtgttcggcggaggaccaagctgaccgtcctaggtcagcccaaggctgccccctcggtcactctgttcccgccctcctcactagtgcgactgagcgggctggcaaggcgcatagnnnnn

SEQ ID NO: 258383 - DNA, 176 bp, Homo sapiens
  misc_feature: GYAE6OF01E1BLO.39.88.H11.1.454.CMB.1.raw
  modified_base (174)..(176): a, c, t, g, unknown or other
  misc_feature (174)..(176): n is a, c, g, or t
tcagtcgcactagtcacgaccggtgctcgatttagcgacagcgagaaacacaaaggggtgttcggcggagggaccaagctgaccgtcctaggtcagcccaaggctgccccctcggtcactctgttccccaccctcctcactagtgcgactgagcgggctggcaaggcgcatagnnn

SEQ ID NO: 258384 - DNA, 195 bp, Homo sapiens
  misc_feature: GYAE6OF02GBWY6.39.88.H11.1.454.CMB.1.raw
  modified_base (175)..(195): a, c, t, g, unknown or other
  misc_feature (175)..(195): n is a, c, g, or t
tcagtcgcactagtcacgaccggtgctcgatttagcgacagcgagaacacgacgaaaggggtgttcggcggagggaccaagctgaccgtcctaggtcagcccaaggctgcccctcggtcactctgttcccaccctcctcactagtgcgactgagcgggctggcaaggcgcatagnnnnnnnnnnnnnnnnnnnnn

SEQ ID NO: 258385 - DNA, 189 bp, Homo sapiens
  misc_feature: GYAE6OF02JG438.39.88.H11.1.454.CMB.1.raw
  modified_base (174)..(189): a, c, t, g, unknown or other
  misc_feature (174)..(189): n is a, c, g, or t
tcagtcgcactagtcacgaccggtgctcgatttagcgacagcgagaacacacaaagggtgttcgggcggagggaccaagctgaccgtcctaggtcagcccaaggctgccccctggtcactctgttcccaccctcctcgactagtgcgactgagcgggctggcaaggcgcatagnnnnnnnnnnnnnnnn

SEQ ID NO: 258386 - DNA, 173 bp, Homo sapiens
  misc_feature: GYAE6OF02IYH9P.39.88.H11.1.454.CMB.1.raw
  modified_base (172)..(173): a, c, t, g, unknown or other
  misc_feature (172)..(173): n is a, c, g, or t
tcagtcgcactagtcacgaccggtgctcgatttagcgacagcgagaaacacaaaggggtgttcggcggagggaccaagctgaccgtcctaggtcagcccaaggctgcccctcggtcactctgttcccgccctcctcactagtgtgactgagcgggctggcaaggcgcatagnn

SEQ ID NO: 258387 - DNA, 176 bp, Homo sapiens; identical to SEQ ID NO: 258379
  misc_feature: GYAE6OF02G62CU.39.88.H11.1.454.CMB.1.raw
  modified_base (174)..(176): a, c, t, g, unknown or other
  misc_feature (174)..(176): n is a, c, g, or t

SEQ ID NO: 258388 - DNA, 176 bp, Homo sapiens
  misc_feature: GYAE6OF02FHZ43.39.88.H11.1.454.CMB.1.raw
  modified_base (174)..(176): a, c, t, g, unknown or other
  misc_feature (174)..(176): n is a, c, g, or t
tcagtcgcactagtcacgaccggtgctcgatttagcgacagcgagaacacacaaaggggtgttcggcggagggaccaagctgaccgtcctaggtcagcccaaggctgccccctcggtcactctgttcccaccctcctcactagtgcgactgagcgggctggcaaggcgcatagnnn

SEQ ID NO: 258389 - DNA, 217 bp, Homo sapiens
  misc_feature: GYAE6OF02JUJR2.39.88.H11.1.454.CMB.1.raw
  modified_base (181)..(182): a, c, t, g, unknown or other
  misc_feature (181)..(182): n is a, c, g, or t
  modified_base (185)..(186): a, c, t, g, unknown or other
  misc_feature (185)..(186): n is a, c, g, or t
  modified_base (189)..(189): a, c, t, g, unknown or other
  misc_feature (189)..(189): n is a, c, g, or t
  modified_base (192)..(192): a, c, t, g, unknown or other
  misc_feature (192)..(192): n is a, c, g, or t
  modified_base (195)..(197): a, c, t, g, unknown or other
  misc_feature (195)..(197): n is a, c, g, or t
  modified_base (199)..(199): a, c, t, g, unknown or other
  misc_feature (199)..(199): n is a, c, g, or t
  modified_base (201)..(217): a, c, t, g, unknown or other
  misc_feature (201)..(217): n is a, c, g, or t
tcagtcgcactagtcacgaccggtgctcgatttagcgacagcgagaacacacaaagggtgttcggcggagggaccgaagcgtgaccgtcctaggtcagcccaaggctgtcccctcggtccactcctgttcccgccctccgtcacctagtcgcgacctgacgcggctggcaaggcgcatagnnagnngtnctnacnnnantnnnnnnnnnnnnnnnnn

SEQ ID NO: 258390 - DNA, 173 bp, Homo sapiens
  misc_feature: GYAE6OF02GWR8Z.39.88.H11.1.454.CMB.1.raw
tcagtcgcactagtcacgaccggtgctcgatttagcgacagcgagaacacacaaaggggtgttcggcggagggaccaagctgaccgtcctaggtcagcccaaggctgccccctcggtcactctgttcccaccctcctcactagtgcgactgagcgggctggcaaggcgcatag

SEQ ID NO: 258391 - DNA, 214 bp, Homo sapiens
  misc_feature: GYAE6OF02IJ0J0.39.88.H11.1.454.CMB.1.raw
  modified_base (179)..(181): a, c, t, g, unknown or other
  misc_feature (179)..(181): n is a, c, g, or t
  modified_base (183)..(214): a, c, t, g, unknown or other
  misc_feature (183)..(214): n is a, c, g, or t
tcagtcgcactagtcacgaccggtgctcgatttagcgacagcgagaacgaccacaaaggggtgttcggcggagggaccaagctcgaccgtcctaggtcagccccaaggctgccccctggtcactctgttccccgcccttcctcactagtgcgactgagcgggctggcaaggcgcatagnnngnnnnnnnnnnnnnnnnnnnnnnnnnnnnnnnn

SEQ ID NO: 258392 - DNA, 239 bp, Homo sapiens
  misc_feature: GYAE6OF01BMN9Z.19.78.H01.1.454.CMB.1.raw
  modified_base (237)..(239): a, c, t, g, unknown or other
  misc_feature (237)..(239): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccactgtcactctgttcccaccctctccacgagagtactgagcgggctggcaaggcgcatagnnn

SEQ ID NO: 258393 - DNA, 224 bp, Homo sapiens
  misc_feature: GYAE6OF01BFSCC.19.78.H01.1.454.CMB.1.raw
  modified_base (224)..(224): a, c, t, g, unknown or other
  misc_feature (224)..(224): n is a, c, g, or t
tcagtactctcgtgcacgaccggtgctcgatttagtgtgagtagtttgggtttgggctgaggacgaggctgattactactgctgctcatatgcaggtcgtatctcttatgtcttcggaactgggaccaaggtcaccgtcctaggtcagcccaaggccaacccactgtcactctgttcccgccctcctccacgagagtactgagcgggctggcaaggcgcatagn

SEQ ID NO: 258394 - DNA, 251 bp, Homo sapiens
  misc_feature: GYAE6OF01C1RQZ.19.78.H01.1.454.CMB.1.raw
  modified_base (235)..(251): a, c, t, g, unknown or other
  misc_feature (235)..(251): n is a, c, g, or t
tcagtactctcgtgcacgaccggtgctcgatttagtgtgagtagtttgggtttggtggtctccgactcccgccttgacgaggctgattactactgctgctcatatgcaggtcgtatctcttatgtcttcggaactgggaccaaggtcaccgtcctaggtcagcccaaggccaacccactgtcactctgttcccacctcctcacgagagtactgagcggctggcaaggcgcatagnnnnnnnnnnnnnnnnn

SEQ ID NO: 258395 - DNA, 239 bp, Homo sapiens
  misc_feature: GYAE6OF01CS5WC.19.78.H01.1.454.CMB.1.raw
  modified_base (237)..(239): a, c, t, g, unknown or other
  misc_feature (237)..(239): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaacccactgtcactctgttcccgccctcctccacgagagtactgagcgggctggcaaggcgcatagnnn

SEQ ID NO: 258396 - DNA, 257 bp, Homo sapiens
  misc_feature: GYAE6OF01DXIKU.19.78.H01.1.454.CMB.1.raw
  modified_base (229)..(229): a, c, t, g, unknown or other
  misc_feature (229)..(229): n is a, c, g, or t
  modified_base (235)..(257): a, c, t, g, unknown or other
  misc_feature (235)..(257): n is a, c, g, or t
tcagtactctcgtgcacgaccggtgctcgatttagtgtgagtagtttgggtttggtgggtctccactcccgccttgacgaggctgattactactgctgctcatatgcaggtcgtatctcttatgtcttcggaactgggaccaaggtcaccgtcctaggtcagcccaaggccaacccactgtcactctgttcccacctctcacgagagtactgagcgggctggcaaggcncatagnnnnnnnnnnnnnnnnnnnnnnn

SEQ ID NO: 258397 - DNA, 257 bp, Homo sapiens
  misc_feature: GYAE6OF01EE0UJ.19.78.H01.1.454.CMB.1.raw
  modified_base (237)..(257): a, c, t, g, unknown or other
  misc_feature (237)..(257): n is a, c, g, or t
tcagtactctcgtgcacgaccggtgctcgatttagtgtgagtagtttgggttggtgggtcgtccactcccgccttgacgaggctgattactactgctgctcatatgcacggtcgtatctcttatgtcttcggaactgggaccaaggtcaccgtcctaggtcagcccaaggccaacccactgtcactctgttcccgccctcctcacgagagtactgagcggctggcaaggcgcatagnnnnnnnnnnnnnnnnnnnnn

SEQ ID NO: 258398 - DNA, 238 bp, Homo sapiens
  misc_feature: GYAE6OF01A9VG5.19.78.H01.1.454.CMB.1.raw
  modified_base (236)..(238): a, c, t, g, unknown or other
  misc_feature (236)..(238): n is a, c, g, or t
tcagtactctcgtgcacgaccggtgctcgatttagtgtgagtagtttgggttggtggtctccactcccgccttgacgaggctgattactactgctgctcatatgcaggtcgtatctcttatgtcttcggaactgggaccaaggtcaccgtcctaggtcagcccaaggccaacccactgtcactctgttcccaccctcctccacgagagtactgagcgggctggcaaggcgcatagnnn

SEQ ID NO: 258399 - DNA, 239 bp, Homo sapiens
  misc_feature: GYAE6OF01CZVJT.19.78.H01.1.454.CMB.1.raw
  modified_base (237)..(239): a, c, t, g, unknown or other
  misc_feature (237)..(239): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaacccactgtcactctgttcccaccctcctccacgagagtactgagcgggctggcaaggcgcatagnnn

SEQ ID NO: 258400 - DNA, 239 bp, Homo sapiens; identical to SEQ ID NO: 258395
  misc_feature: GYAE6OF01CNOCW.19.78.H01.1.454.CMB.1.raw
  modified_base (237)..(239): a, c, t, g, unknown or other
  misc_feature (237)..(239): n is a, c, g, or t

SEQ ID NO: 258401 - DNA, 238 bp, Homo sapiens
  misc_feature: GYAE6OF01EGD61.19.78.H01.1.454.CMB.1.raw
  modified_base (237)..(238): a, c, t, g, unknown or other
  misc_feature (237)..(238): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaacccactgtcactctgttcccgccctcctccacgagagtactgagcgggctggcaaggcgcatagnn

SEQ ID NO: 258402 - DNA, 322 bp, Homo sapiens
  misc_feature: GYAE6OF01D7W3Q.19.78.H01.1.454.CMB.1.raw
  modified_base (196)..(196): a, c, t, g, unknown or other
  misc_feature (196)..(196): n is a, c, g, or t
  modified_base (255)..(260): a, c, t, g, unknown or other
  misc_feature (255)..(260): n is a, c, g, or t
  modified_base (262)..(322): a, c, t, g, unknown or other
  misc_feature (262)..(322): n is a, c, g, or t
tcagtactctcgtgcacgaccggtgctcgatttagtgtgagtagtttgggtttggggtgggtactccactcccgcctttggaccgaggctagattacgtaactcgctgctcatatgcaggtcgtatctcttagtgtccttggaactggaccaaggtcacgtctaggtcagcccaagccaaccccactgtccacctntgttcccacctcctccacggaagagtacctcgagccgggctggcgaaggcgcagtaggnnnnnncnnnnnnnnnnnnnnnnnnnnnnnnnnnnnnnnnnnnnnnnnnnnnnnnnnnnnnnnnnnnn

SEQ ID NO: 258403 - DNA, 238 bp, Homo sapiens; identical to SEQ ID NO: 258398
  misc_feature: GYAE6OF01AN4EN.19.78.H01.1.454.CMB.1.raw
  modified_base (236)..(238): a, c, t, g, unknown or other
  misc_feature (236)..(238): n is a, c, g, or t

SEQ ID NO: 258404 - DNA, 250 bp, Homo sapiens
  misc_feature: GYAE6OF01A88SR.19.78.H01.1.454.CMB.1.raw
  modified_base (239)..(250): a, c, t, g, unknown or other
  misc_feature (239)..(250): n is a, c, g, or t
tcagtactctcgtgcacgaccggtgctcgatttagtgtgagtagtttgggtttggtggtcgtccactcccgccttgacgaggctgattacgtactgctgctcatatgcaggtcgtatctcttatgtcttcggaactgggaccaaggtcaccgtctaggtcagcccaaggccaacccactgtcactctgttcccgccctcctccacgagagtactggagcgggctggcaaggcgcatagnnnnnnnnnnnn

SEQ ID NO: 258405 - DNA, 237 bp, Homo sapiens
  misc_feature: GYAE6OF01A2VIY.19.78.H01.1.454.CMB.1.raw
  modified_base (237)..(237): a, c, t, g, unknown or other
  misc_feature (237)..(237): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaacccactgtcactctgttcccaccctcctccacgagagtactgagcgggctggcaaggcgcatagn

SEQ ID NO: 258406 - DNA, 273 bp, Homo sapiens
  misc_feature: GYAE6OF01CFNB0.19.78.H01.1.454.CMB.1.raw
  modified_base (238)..(273): a, c, t, g, unknown or other
  misc_feature (238)..(273): n is a, c, g, or t
tcagtactctcgtgcacgaccggtgctcgatttagtgtgagtagtttgggtttgggtggtctccactcccgccttgacgaggctgattactactgctgctccatatgcaggtcgtatctcttatgtcttggaactgggaccaaggtcacgtcctaggtcagcccaaggccaacccactgtcactctgttccccgccctcctccacgagagtactgagcgggctggcaaggcgcatagnnnnnnnnnnnnnnnnnnnnnnnnnnnnnnnnnnnn

SEQ ID NO: 258407 - DNA, 240 bp, Homo sapiens
  misc_feature: GYAE6OF01EAFEB.19.78.H01.1.454.CMB.1.raw
  modified_base (238)..(240): a, c, t, g, unknown or other
  misc_feature (238)..(240): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcgccgtcctaggtcagcccaaggccaaccccactgtcactctgttcccaccctcctccacgagagtactgagcgggctggcaaggcgcatagnnn

SEQ ID NO: 258408 - DNA, 238 bp, Homo sapiens; identical to SEQ ID NO: 258401
  misc_feature: GYAE6OF01D115B.19.78.H01.1.454.CMB.1.raw
  modified_base (237)..(238): a, c, t, g, unknown or other
  misc_feature (237)..(238): n is a, c, g, or t

SEQ ID NO: 258409 - DNA, 240 bp, Homo sapiens
  misc_feature: GYAE6OF01DPE9C.19.78.H01.1.454.CMB.1.raw
  modified_base (238)..(240): a, c, t, g, unknown or other
  misc_feature (238)..(240): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccactgtcactctgttcccaccctcctccacgagagtactgagcgggctggcaaggcgcatagnnn

SEQ ID NO: 258410 - DNA, 241 bp, Homo sapiens
  misc_feature: GYAE6OF01AED6S.19.78.H01.1.454.CMB.1.raw
  modified_base (102)..(102): a, c, t, g, unknown or other
  misc_feature (102)..(102): n is a, c, g, or t
  modified_base (237)..(241): a, c, t, g, unknown or other
  misc_feature (237)..(241): n is a, c, g, or t
tcagtactctcgtgcacgaccggtgctcgatttagtgtgagtagtttgggtttggtggtctccactcccgccttgacgaggctgattactactgctgctcanatgcaggtcgtatctcttatgtcttcggaactgggaccaaggtcaccgtcctaggtcagcccaaggccaacccactgtcactctgttcccaccctcctccacgagagtactgagcgggctggcaaggcgcatagnnnnn

SEQ ID NO: 258411 - DNA, 239 bp, Homo sapiens
  misc_feature: GYAE6OF01CKNVT.19.78.H01.1.454.CMB.1.raw
  modified_base (238)..(239): a, c, t, g, unknown or other
  misc_feature (238)..(239): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccactgtcactctgttcccgccctcctccacgagagtactgagcgggctggcaaggcgcatagnn

SEQ ID NO: 258412 - DNA, 249 bp, Homo sapiens
  misc_feature: GYAE6OF01D2JVH.19.78.H01.1.454.CMB.1.raw
  modified_base (238)..(249): a, c, t, g, unknown or other
  misc_feature (238)..(249): n is a, c, g, or t
tcagtactctcgtgcacgaccggtgctcgatttagtgtgagtagtttgggtttggtggtctccactcccgccttgacgaggctgattacctactgctgctcatatgcaggtcgtatctcttatgtcttcggaactgggaccaaggtcaccgtcctaggtcagcccaaggccaaccccactgtcactctgttcccaccctcctccacgagagtactgagcggctggcaaggcgcatagnnnnnnnnnnnn

SEQ ID NO: 258413 - DNA, 240 bp, Homo sapiens; identical to SEQ ID NO: 258409
  misc_feature: GYAE6OF01ATG8O.19.78.H01.1.454.CMB.1.raw
  modified_base (238)..(240): a, c, t, g, unknown or other
  misc_feature (238)..(240): n is a, c, g, or t

SEQ ID NO: 258414 - DNA, 264 bp, Homo sapiens
  misc_feature: GYAE6OF01BK1F1.19.78.H01.1.454.CMB.1.raw
  modified_base (229)..(229): a, c, t, g, unknown or other
  misc_feature (229)..(229): n is a, c, g, or t
  modified_base (235)..(264): a, c, t, g, unknown or other
  misc_feature (235)..(264): n is a, c, g, or t
tcagtactctcgtgcacgaccggtgctcgatttagtgtgagtagtttgggtttggtgggtctccactcccgccttgacgaggctgattactactgctgctccatatgcaggtcgtatctctatgtcttcggaactgggaccaaggtcaccgtcctaggtcagccaaaggccaacccactgtcactctgttcccacctctccacgagagtactgagcgggctggcaagcncatagnnnnnnnnnnnnnnnnnnnnnnnnnnnnnn

SEQ ID NO: 258415 - DNA, 241 bp, Homo sapiens
  misc_feature: GYAE6OF01BGN1D.19.78.H01.1.454.CMB.1.raw
  modified_base (238)..(241): a, c, t, g, unknown or other
  misc_feature (238)..(241): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccactgtcactctgttcccgccctcctccacgagagtactgagcgggctggcaaggcgcatagnnnn

SEQ ID NO: 258416 - DNA, 242 bp, Homo sapiens
  misc_feature: GYAE6OF01ETVHU.19.78.H01.1.454.CMB.1.raw
  modified_base (238)..(242): a, c, t, g, unknown or other
  misc_feature (238)..(242): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccactgtcactctgttcccaccctcctccacgagagtactgagcgggctggcaaggcgcatagnnnnn

SEQ ID NO: 258417 - DNA, 241 bp, Homo sapiens
  misc_feature: GYAE6OF01CGUT8.19.78.H01.1.454.CMB.1.raw
  modified_base (238)..(241): a, c, t, g, unknown or other
  misc_feature (238)..(241): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccactgtcactctgttcccaccctcctccacgagagtactgagcgggctggcaaggcgcatagnnnn

SEQ ID NO: 258418 - DNA, 239 bp, Homo sapiens
  misc_feature: GYAE6OF01DJJY5.19.78.H01.1.454.CMB.1.raw
  modified_base (238)..(239): a, c, t, g, unknown or other
  misc_feature (238)..(239): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccactgtcactctgttcccaccctcctccacgagagtactgagcgggctggcaaggcgcatagnn

SEQ ID NO: 258419 - DNA, 240 bp, Homo sapiens
  misc_feature: GYAE6OF01CRHJY.19.78.H01.1.454.CMB.1.raw
  modified_base (237)..(240): a, c, t, g, unknown or other
  misc_feature (237)..(240): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgccttcggaactgggaccaaggtcaccgtcctaggtcagcccaaggccaacccactgtcactctgttcccgccctcctccacgagagtactgagcgggctggcaaggcgcatagnnnn

SEQ ID NO: 258420 - DNA, 239 bp, Homo sapiens; identical to SEQ ID NO: 258418
  misc_feature: GYAE6OF01EGDH0.19.78.H01.1.454.CMB.1.raw
  modified_base (238)..(239): a, c, t, g, unknown or other
  misc_feature (238)..(239): n is a, c, g, or t

SEQ ID NO: 258421 - DNA, 264 bp, Homo sapiens
  misc_feature: GYAE6OF01C8QFU.19.78.H01.1.454.CMB.1.raw
  modified_base (242)..(264): a, c, t, g, unknown or other
  misc_feature (242)..(264): n is a, c, g, or t
tcagtactctcgtgcacgaccggtgctcgatttagtgtgagtagtttgggtttgggtggtactccacctcccgccgttgacgacggctgattactactgctgctcatatgcaggtcgtatctcttatgtcttcggaactgggaccaaggtcaccgtcctaggtcagcccaaggccaacccactgtcactctgttcccgccctcctccacgagagtactgagcgggctggcaaggcgcatagnnnnnnnnnnnnnnnnnnnnnnn

SEQ ID NO: 258422 - DNA, 505 bp, Homo sapiens
  misc_feature: GYAE6OF01BE9NY.19.78.H01.1.454.CMB.1.raw
  modified_base (442)..(442): a, c, t, g, unknown or other
  misc_feature (442)..(442): n is a, c, g, or t
  modified_base (498)..(498): a, c, t, g, unknown or other
  misc_feature (498)..(498): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaatcatcatttatgatgccactaagcggccctcaggggtttctaatcgcttctctggctccaagtctggcaacacggcctccctgacaatctctggctccaggctgaggacgaggctgattactactgctgctcatatgcaggtcgtatctnttatgtcttcggaactgggaccaggtcaccgtctggtcagcccaaggcccaacccntgtcacc

SEQ ID NO: 258423 - DNA, 240 bp, Homo sapiens; identical to SEQ ID NO: 258409
  misc_feature: GYAE6OF01C6NMV.19.78.H01.1.454.CMB.1.raw
  modified_base (238)..(240): a, c, t, g, unknown or other
  misc_feature (238)..(240): n is a, c, g, or t

SEQ ID NO: 258424 - DNA, 517 bp, Homo sapiens
  misc_feature: GYAE6OF01AG37Z.19.78.H01.1.454.CMB.1.raw
  modified_base (304)..(304): a, c, t, g, unknown or other
  misc_feature (304)..(304): n is a, c, g, or t
  modified_base (434)..(434): a, c, t, g, unknown or other
  misc_feature (434)..(434): n is a, c, g, or t
  modified_base (447)..(447): a, c, t, g, unknown or other
  misc_feature (447)..(447): n is a, c, g, or t
  modified_base (508)..(508): a, c, t, g, unknown or other
  misc_feature (508)..(508): n is a, c, g, or t
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatccaccaaataaacgcccccaaactcatcatttangatgccactaagccggccctcgagggtttctaatcgctttctctggctccaagtctggcaacacggcctccctgacaatctcgtgggctccaggctggaggacgaggctgattactactgctgctcatangcaggtctatctnttatgttcttacggactgggacctaaggtccaccgtctaggtcagcccaaggcccaacccntcgtctacc

SEQ ID NO: 258425 - DNA, 501 bp, Homo sapiens
  misc_feature: GYAE6OF01DU2GL.19.78.H01.1.454.CMB.1.raw
  modified_base (498)..(498): a, c, t, g, unknown or other
  misc_feature (498)..(498): n is a, c, g, or t
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaccaaataaagcccccaaatcatcatttatgatgccactaagcggccctcaggggtttctaatcgcttctctggctccaagtctggcaacacggcctcctgacaatctctgggctccaggctgaggacgaggctgattactactgctgatcatatgcaggtctatctcttatgtcttggactgggaccaaggtcaccgtctaggcagcccaaggcccaacccactgtnacc

SEQ ID NO: 258426 - DNA, 504 bp, Homo sapiens
  misc_feature: GYAE6OF01C9ST5.19.78.H01.1.454.CMB.1.raw
  modified_base (498)..(498): a, c, t, g, unknown or other
  misc_feature (498)..(498): n is a, c, g, or t
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaaccaaataaagcccccaaactcatcatttatgatgccactaagcggccctcaggggtttctaatcgcttctctggctccaagtctggcaacacggcctcctgacaatctctgggctccaggctgaggacgaggctgattactactgctgctcatatgcaggtcgtatctcttatgtcttcggaactgggaccaaggtcacgtctaggcagcccaaggcccaacccnctgcac

SEQ ID NO: 258427 - DNA, 241 bp, Homo sapiens
  misc_feature: GYAE6OF01C1S8S.19.78.H01.1.454.CMB.1.raw
  modified_base (238)..(241): a, c, t, g, unknown or other
  misc_feature (238)..(241): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggctgccccctcggtcactctgttcccaccctcctccacgagagtactgagcgggctggcaaggcgcatagnnnn

SEQ ID NO: 258428 - DNA, 245 bp, Homo sapiens
  misc_feature: GYAE6OF01BF0MJ.19.78.H01.1.454.CMB.1.raw
  modified_base (234)..(245): a, c, t, g, unknown or other
  misc_feature (234)..(245): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtctaggtcagcccaaggccaacccatgtcactctgttcccaccctcctccacgagagtactgagcggctggcaaggcgcatagnnnnnnnnnnnn

SEQ ID NO: 258429 - DNA, 533 bp, Homo sapiens
  misc_feature: GYAE6OF01C5GLG.19.78.H01.1.454.CMB.1.raw
  modified_base (454)..(454): a, c, t, g, unknown or other
  misc_feature (454)..(454): n is a, c, g, or t
  modified_base (522)..(522): a, c, t, g, unknown or other
  misc_feature (522)..(522): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatcctcctgcactggaaccagcagtgatgttggaaattctaaccttgtctcctggtaccaacatcaacccaaaataaacgcccccaaatcatcatttatgatgaccactaagcggccctcgagggtttctaatcgcttctctgctcaagtctggcaacacggcctccctgacaatctcgtgggcctcgaggctagaggacgaggctagtattactactgctgcttcatagtgctaggtctatcttntttatcgtcttcggaactcgggaccaaggtccaccgtcctaggtccacgacccaacggacccaacccnctcgtctaccg

SEQ ID NO: 258430 - DNA, 226 bp, Homo sapiens
  misc_feature: GYAE6OF01DW5GH.19.78.H01.1.454.CMB.1.raw
  modified_base (226)..(226): a, c, t, g, unknown or other
  misc_feature (226)..(226): n is a, c, g, or t
tcagtactctcgtgcacgaccggtgctcgatttagtgtgagtagtttgggtttggggctgaggacgaggctgattactactgctgctcatatgcaggtcgtatctcttatgtcttcggaactgggaccaaggtcaccgtcctaggtcagcccaaggccaaccccactgtcactctgttcccaccctcctccacgagagtactgagcgggctggcaaggcgcatagn

SEQ ID NO: 258431 - DNA, 252 bp, Homo sapiens
  misc_feature: GYAE6OF01BFLQB.19.78.H01.1.454.CMB.1.raw
  modified_base (228)..(252): a, c, t, g, unknown or other
  misc_feature (228)..(252): n is a, c, g, or t
tcagtactctcgtgcacgaccggtgctcgatttagtgtgagtagtttgggttgggggctggaggacgaggctgattactacgtgctgctcatatgcaggtcgtatctcttatgtcttcggaactgggaccaaggtcaccgtcctaggtcagcccaaggccaaccccactgtcactctgttcccaccctcctccacgagagtactgagcgggctggcaaggcgcatagnnnnnnnnnnnnnnnnnnnnnnnnn

SEQ ID NO: 258432 - DNA, 237 bp, Homo sapiens
  misc_feature: GYAE6OF01B36JP.19.78.H01.1.454.CMB.1.raw
  modified_base (227)..(237): a, c, t, g, unknown or other
  misc_feature (227)..(237): n is a, c, g, or t
tcagtactctcgtgcacgaccggtgctcgatttagtgtgagtagtttgggtttgggggctgaggacgaggctgattactactgctgctcatatgcaggtcgtatctcttatgtcttcggaactgggaccaaggtcaccgtcctaggtcagcccaaggccaaccccactgtcactctgttcccaccctcctccacgagagtactgagcgggctggcaaggcgcatagnnnnnnnnnnn

SEQ ID NO: 258433 - DNA, 503 bp, Homo sapiens
  misc_feature: GYAE6OF01C115J.19.78.H01.1.454.CMB.1.raw
  modified_base (305)..(305): a, c, t, g, unknown or other
  misc_feature (305)..(305): n is a, c, g, or t
  modified_base (498)..(498): a, c, t, g, unknown or other
  misc_feature (498)..(498): n is a, c, g, or t
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaacccaaataaacgcccccaaactcatcatttangatgccactaagcggcctcagggtttctaatcgcttctctggctccaagtctggcaacacggcctcctgacaatctctgggcctccaggctgaggacgaggctgattactactgctgctcatatgcaggttctatcttcttatgttcttcggaactgggacaaggtcaccgtctaggcagccaagccaacccntgcac

SEQ ID NO: 258434 - DNA, 510 bp, Homo sapiens
  misc_feature: GYAE6OF01AF8QH.19.78.H01.1.454.CMB.1.raw
  modified_base (303)..(303): a, c, t, g, unknown or other
  misc_feature (303)..(303): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
  modified_base (501)..(501): a, c, t, g, unknown or other
  misc_feature (501)..(501): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaccaaataaagcccccaaactcatcatttangatgccactaagcggccctcagggtttctaatcgcttctctggctccaagtctggcaacacggccctccctgacaatctctgggctccaggctgaggacgaggctgattactactgctgctnatntgcaggtctatcttcttatgttcttcggaactgggaccaaggtcacgtcaggtccagcccaaggcccaacccnctgtctacc

SEQ ID NO: 258435 - DNA, 241 bp, Homo sapiens; identical to SEQ ID NO: 258415
  misc_feature: GYAE6OF01CTD32.19.78.H01.1.454.CMB.1.raw
  modified_base (238)..(241): a, c, t, g, unknown or other
  misc_feature (238)..(241): n is a, c, g, or t

SEQ ID NO: 258436 - DNA, 242 bp, Homo sapiens
  misc_feature: GYAE6OF01BCXXQ.19.78.H01.1.454.CMB.1.raw
  modified_base (238)..(242): a, c, t, g, unknown or other
  misc_feature (238)..(242): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccactgtcactctgttcccgccctcctccacgagagtactgagcgggctggcaaggcgcatagnnnnn

SEQ ID NO: 258437 - DNA, 242 bp, Homo sapiens
  misc_feature: GYAE6OF01CHFWH.19.78.H01.1.454.CMB.1.raw
  modified_base (239)..(242): a, c, t, g, unknown or other
  misc_feature (239)..(242): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccactgtcactctgttccccaccctcctccacgagagtactgagcgggctggcaaggcgcatagnnnn

SEQ ID NO: 258438 - DNA, 241 bp, Homo sapiens; identical to SEQ ID NO: 258417
  misc_feature: GYAE6OF01ERWA3.19.78.H01.1.454.CMB.1.raw
  modified_base (238)..(241): a, c, t, g, unknown or other
  misc_feature (238)..(241): n is a, c, g, or t

SEQ ID NO: 258439 - DNA, 246 bp, Homo sapiens
  misc_feature: GYAE6OF01DYF45.19.78.H01.1.454.CMB.1.raw
  modified_base (241)..(246): a, c, t, g, unknown or other
  misc_feature (241)..(246): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggcccaaccccactgtcactctcgttccccgccctcctccacgagagtactgagcgggctggcaaggcgcatagnnnnnn

SEQ ID NO: 258440 - DNA, 239 bp, Homo sapiens; identical to SEQ ID NO: 258418
  misc_feature: GYAE6OF01CTNPM.19.78.H01.1.454.CMB.1.raw
  modified_base (238)..(239): a, c, t, g, unknown or other
  misc_feature (238)..(239): n is a, c, g, or t

SEQ ID NO: 258441 - DNA, 241 bp, Homo sapiens; identical to SEQ ID NO: 258415
  misc_feature: GYAE6OF01AWWHX.19.78.H01.1.454.CMB.1.raw
  modified_base (238)..(241): a, c, t, g, unknown or other
  misc_feature (238)..(241): n is a, c, g, or t

SEQ ID NO: 258442 - DNA, 240 bp, Homo sapiens; identical to SEQ ID NO: 258409
  misc_feature: GYAE6OF01A2ONQ.19.78.H01.1.454.CMB.1.raw
  modified_base (238)..(240): a, c, t, g, unknown or other
  misc_feature (238)..(240): n is a, c, g, or t

SEQ ID NO: 258443 - DNA, 238 bp, Homo sapiens
  misc_feature: GYAE6OF01CXXUU.19.78.H01.1.454.CMB.1.raw
  modified_base (238)..(238): a, c, t, g, unknown or other
  misc_feature (238)..(238): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccactgtcactctgttcccaccctcctccacgagagtactgagcgggctggcaaggcgcatagn

SEQ ID NO: 258444 - DNA, 241 bp, Homo sapiens
  misc_feature: GYAE6OF01CIPMY.19.78.H01.1.454.CMB.1.raw
  modified_base (237)..(241): a, c, t, g, unknown or other
  misc_feature (237)..(241): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaacccactgtcactctgttcccaccctcctccacgagagtactgagcgggctggcaaggcgcatagnnnnn

SEQ ID NO: 258445 - DNA, 634 bp, Homo sapiens
  misc_feature: GYAE6OF01DJKVF.19.78.H01.1.454.CMB.1.raw
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtagaaattctaacttgtctctggtacaacatcaccaaataaacgccccaaactcatcatttatgatgccaactaacgccggccctcgtagggtttctaatcgtcttctctcggctacctaagtctggacaacgacggcctaccctgacaatctcgtcggcctcgacggtctacggacggacgaggtctaggtaacttacctacgtcgtctggcttacattaacgtcgactagggttccgttaattccttactttaacgttcgtttaccgttacgggtaaaccgttacggggtaacctaaacgggttcccaacccggtttaccgtaacgggttccaaccgggtaacccccgtaaaccgggaccccctaaacccccggtacttcccgtccgttaacccc

SEQ ID NO: 258446 - DNA, 241 bp, Homo sapiens; identical to SEQ ID NO: 258417
  misc_feature: GYAE6OF01CRJEQ.19.78.H01.1.454.CMB.1.raw
  modified_base (238)..(241): a, c, t, g, unknown or other
  misc_feature (238)..(241): n is a, c, g, or t

SEQ ID NO: 258447 - DNA, 239 bp, Homo sapiens
  misc_feature: GYAE6OF01DFTNW.19.78.H01.1.454.CMB.1.raw
  modified_base (237)..(239): a, c, t, g, unknown or other
  misc_feature (237)..(239): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtctaggtcagcccaaggccaacccactgtcactctgttccccgccctcctccacgagagtactgagcgggctggcaaggcgcatagnnn

SEQ ID NO: 258448 - DNA, 244 bp, Homo sapiens
  misc_feature: GYAE6OF01CCZYU.19.78.H01.1.454.CMB.1.raw
  modified_base (238)..(244): a, c, t, g, unknown or other
  misc_feature (238)..(244): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaacccactgtcactctcgttcccgccctcctccacgagagtactgagcgggctggcaaggcgcatagnnnnnnn

SEQ ID NO: 258449 - DNA, 511 bp, Homo sapiens
  misc_feature: GYAE6OF01CMHQ5.19.78.H01.1.454.CMB.1.raw
  modified_base (208)..(208): a, c, t, g, unknown or other
  misc_feature (208)..(208): n is a, c, g, or t
  modified_base (226)..(226): a, c, t, g, unknown or other
  misc_feature (226)..(226): n is a, c, g, or t
  modified_base (263)..(263): a, c, t, g, unknown or other
  misc_feature (263)..(263): n is a, c, g, or t
  modified_base (298)..(298): a, c, t, g, unknown or other
  misc_feature (298)..(298): n is a, c, g, or t
  modified_base (434)..(434): a, c, t, g, unknown or other
  misc_feature (434)..(434): n is a, c, g, or t
  modified_base (453)..(453): a, c, t, g, unknown or other
  misc_feature (453)..(453): n is a, c, g, or t
  modified_base (457)..(457): a, c, t, g, unknown or other
  misc_feature (457)..(457): n is a, c, g, or t
  modified_base (504)..(504): a, c, t, g, unknown or other
  misc_feature (504)..(504): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcggtcaccntctcctgcactggaaccngcagtgatgtagaaattctaacttgtctctgtacaanatcaaccaataaagcccccaaactcatacatttangatgccactaagccggccctcgtagggtttctaatccgctttctctggcttccaagtctaggcaacacggccctcctgactaatctcgtgggctcgaggctaggacggtacgagcctagacttactactgctgctnatagtgctaggtctatctnttangtcttagactggacaggtcacgtctagcagcccaacggaccaacccntcgctac

SEQ ID NO: 258450 - DNA, 239 bp, Homo sapiens
  misc_feature: GYAE6OF01C2EK8.19.78.H01.1.454.CMB.1.raw
  modified_base (236)..(239): a, c, t, g, unknown or other
  misc_feature (236)..(239): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtctaggtcagcccaaggccaacccactgtcactctgttcccaccctcctccacgagagtactgagcgggctggcaaggcgcatagnnnn

SEQ ID NO: 258451 - DNA, 502 bp, Homo sapiens
  misc_feature: GYAE6OF01EI3YY.19.78.H01.1.454.CMB.1.raw
  modified_base (495)..(495): a, c, t, g, unknown or other
  misc_feature (495)..(495): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaccaaataaagcccccaaatccatcatttatgatgccactaagcggccctcagggtttctaatcgcttctctggctccaagtctggcaacacggcctccctgacaatctctggctccaggctgaggacgaggctgattactactgctgctcatatgcaggtcgtattctcttatgtcttcggactggaccaggtcacgtctggtcagcccaaggcccaacccnctgctac

SEQ ID NO: 258452 - DNA, 508 bp, Homo sapiens
  misc_feature: GYAE6OF01CK2FE.19.78.H01.1.454.CMB.1.raw
  modified_base (500)..(500): a, c, t, g, unknown or other
  misc_feature (500)..(500): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaattctaacttgtctctggtaccaacatcaccaaataaacgcccccaaactcatcatttatgatgccactaacgccggccctcgagggtttctaatcgcttctctggctccaagtctgcaacacggcctcctgacaatctctggctcgaggctgaggacgaggctgacttactactgctgctcatatgcaggtctatcttcttatgtcttcggactcgggaccaggtcaccggtctaggcacgcccaacggcccaacccntgtcctac

SEQ ID NO: 258453 - DNA, 520 bp, Homo sapiens
  misc_feature: GYAE6OF01DH794.19.78.H01.1.454.CMB.1.raw
  modified_base (227)..(227): a, c, t, g, unknown or other
  misc_feature (227)..(227): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtgatgtgaaattctaacttgtctctgtaccaacatcaccaaataaacgccccaaactcatcatttatgatgccactaagcggccctcagggtttctaatcgcttctctgctcaagtctggcaacacggcctcctgacaatctctggctccgaggctgaggacgaggctgattactactgctgctcatatgcaggttcgtatcttacttatgtcttacggaacgtcgggacctaaggtccaccgtcgtacggtcacgacccctaacggacccaacccactcgtctacccg

SEQ ID NO: 258454 - DNA, 557 bp, Homo sapiens
  misc_feature: GYAE6OF01A6A47.19.78.H01.1.454.CMB.1.raw
  modified_base (464)..(464): a, c, t, g, unknown or other
  misc_feature (464)..(464): n is a, c, g, or t
  modified_base (547)..(547): a, c, t, g, unknown or other
  misc_feature (547)..(547): n is a, c, g, or t
tcagtactctcgtgcacgaccggtgctcgatttagtgtgagtagtttgggtttgggggggtcacaagagcagcgctctcgggacgtctaccaccatggcctgggctctgctgctcctcactctcctcactcaggacacagggtcctgggcccagtctgccctgacctcacgtctgcctccgtgtctgggtctcctggacagtcggtcaccatctcctgcactggaaccagcagtgatgttggaaattcaaccttgtcttcctggtaccaacatcaacccaaataaacgcccccaaactcatcatttatgatgccactaagcggcctgagggtttctaaatcgctttctctggctccaagttctcggcaaccgaccggccctccctgaaccaaatctacctcgggaccttcccaggcttaggaacggacgacgggcttaggattaactactgctgcttacaattntcgacgtacggtcgtatcttcttatgtcttcggaacgtggaccaaggtcacccgtctaggtccacgcccaaggcccaaccccnttgcgtaccg

SEQ ID NO: 258455 - DNA, 241 bp, Homo sapiens; identical to SEQ ID NO: 258417
  misc_feature: GYAE6OF01EUDU1.19.78.H01.1.454.CMB.1.raw
  modified_base (238)..(241): a, c, t, g, unknown or other
  misc_feature (238)..(241): n is a, c, g, or t

SEQ ID NO: 258456 - DNA, 514 bp, Homo sapiens
  misc_feature: GYAE6OF01AIRQL.19.78.H01.1.454.CMB.1.raw
  modified_base (504)..(504): a, c, t, g, unknown or other
  misc_feature (504)..(504): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagcgccctcagggtttctaatcgcttctctggctcaagtctggcaacacggcctccctgacaatctctggctccaggctggaggacgaggctgattactactgctgctcatatgctaggtcgtatctcttatgtcttcggaactgggaccaaggtccaccgtctggtccagccccaaggccccaacccnctcgtctacc

SEQ ID NO: 258457 - DNA, 241 bp, Homo sapiens; identical to SEQ ID NO: 258417
  misc_feature: GYAE6OF01B7SW9.19.78.H01.1.454.CMB.1.raw
  modified_base (238)..(241): a, c, t, g, unknown or other
  misc_feature (238)..(241): n is a, c, g, or t

SEQ ID NO: 258458 - DNA, 533 bp, Homo sapiens
  misc_feature: GYAE6OF01DFCPM.19.78.H01.1.454.CMB.1.raw
  modified_base (422)..(422): a, c, t, g, unknown or other
  misc_feature (422)..(422): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaacttgtctcctgtaccaacatcaccaaataaacgccccaaactcatcatttatgatgccactaagcgcctcgagggttctaatcgcttctctgctcagtctgcaacacgcctcctgacatctctggctccgaggctagaggacgaggctgtattactactgctgtctcatagngcgaggtcgtatcttacttagtcgttcgttacggtaacgtgggacctaaggtccctaccgttccgtaggtccacgaccccgaacggaccccaacccctactcgtcctaccg

SEQ ID NO: 258459 - DNA, 240 bp, Homo sapiens
  misc_feature: GYAE6OF01ENPQK.19.78.H01.1.454.CMB.1.raw
  modified_base (239)..(240): a, c, t, g, unknown or other
  misc_feature (239)..(240): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccactgtcactctgttcccacccctcctccacgagagtactgagcgggctggcaaggcgcatagnn

SEQ ID NO: 258460 - DNA, 243 bp, Homo sapiens
  misc_feature: GYAE6OF01CNK4G.19.78.H01.1.454.CMB.1.raw
  modified_base (239)..(243): a, c, t, g, unknown or other
  misc_feature (239)..(243): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccactgtcactctgttccccgccctcctccacgagagtactgagcgggctggcaaggcgcatagnnnnn

SEQ ID NO: 258461 - DNA, 263 bp, Homo sapiens
  misc_feature: GYAE6OF01CZMHY.19.78.H01.1.454.CMB.1.raw
  modified_base (239)..(263): a, c, t, g, unknown or other
  misc_feature (239)..(263): n is a, c, g, or t
tcagtactctcgtgcacgaccggtgctcgatttagtgtgagtagtttgggtttgggtggtctccactcccgccttgacgaggctgattactactgctgctcatatgcaggtcgtatctcttatgtcttcggaactgggaccaaggtcaccgtcctaggtcagcccaaggccaaccccatgtcactctgttcccaccctcctccacgagagtacctgagcgggctggcaaggcgcatagnnnnnnnnnnnnnnnnnnnnnnnnn

SEQ ID NO: 258462 - DNA, 243 bp, Homo sapiens
  misc_feature: GYAE6OF01DH37Q.19.78.H01.1.454.CMB.1.raw
  modified_base (238)..(243): a, c, t, g, unknown or other
  misc_feature (238)..(243): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccactgtcactctgttcccaccctcctccacgagagtactgagcgggctggcaaggcgcatagnnnnnn

SEQ ID NO: 258463 - DNA, 240 bp, Homo sapiens; identical to SEQ ID NO: 258409
  misc_feature: GYAE6OF01AXLZR.19.78.H01.1.454.CMB.1.raw
  modified_base (238)..(240): a, c, t, g, unknown or other
  misc_feature (238)..(240): n is a, c, g, or t

SEQ ID NO: 258464 - DNA, 229 bp, Homo sapiens
  misc_feature: GYAE6OF01DK0A8.19.78.H01.1.454.CMB.1.raw
  modified_base (228)..(229): a, c, t, g, unknown or other
  misc_feature (228)..(229): n is a, c, g, or t
tcagtactctcgtgcacgaccggtgctcgatttagtgtgagtagtttgggtttgggggctgaggacgaggctgattactactgctgctcatatgcaggtcgtatctcttatgtcttcggaactgggaccaaggtcaccgtcctaggtcagcccaaggccaaccccactgtcactctcgttcccaccctcctccacgagagtactgagcgggctggcaaggcgcatagnn

SEQ ID NO: 258465 - DNA, 242 bp, Homo sapiens; identical to SEQ ID NO: 258436
  misc_feature: GYAE6OF01EGAOA.19.78.H01.1.454.CMB.1.raw
  modified_base (238)..(242): a, c, t, g, unknown or other
  misc_feature (238)..(242): n is a, c, g, or t

SEQ ID NO: 258466 - DNA, 630 bp, Homo sapiens
  misc_feature: GYAE6OF01DCBO0.19.78.H01.1.454.CMB.1.raw
  modified_base (229)..(229): a, c, t, g, unknown or other
  misc_feature (229)..(229): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatcctcctgcactggaaccngcagtgatgttagaaattctaacttgtctcctggtaccaacactacaaccaaaataaacgacccccaaactcaatactaatttatgatcgaccactaagccggccctcgtagggtttctaatcgtcttctctggctacaagtctgcaacgacgcctcctgactaatctcgtggcctcgagctagaggacgagctagtattactactgctgtctctatagtcgacgtacggttacgtacttcgttactttagttcgttccgtttaccgggtaacgttaccggggtaaaccgtaaacgggttacccgaaccccgggtttaccgttacgggttacccaaccgggtacccccgaaaccgggtaccccccaaacccccgttaccgtaccggttacccttaaccccg

SEQ ID NO: 258467 - DNA, 554 bp, Homo sapiens
  misc_feature: GYAE6OF01DXLUV.19.78.H01.1.454.CMB.1.raw
  modified_base (435)..(435): a, c, t, g, unknown or other
  misc_feature (435)..(435): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctggtaccaacatcaaccaaataaacgcccccaaactcatcatttatgatgccactaagcggccctgagggtttcaatcgcttctctggctccaagtctggacaacacgcctccctgaacaatctctgggcctccaggtctggaggacgaggctagattactactgctgctcatntgcgtaggtctattcttacttatcgttcttacggaactcgggaaccaaggttccaacccggttccgtaggtaccacgaccccgtaaacggacccccaaaccccgcttcgtcctaacccg

SEQ ID NO: 258468 - DNA, 241 bp, Homo sapiens
  misc_feature: GYAE6OF01BQCCM.19.78.H01.1.454.CMB.1.raw
  modified_base (238)..(241): a, c, t, g, unknown or other
  misc_feature (238)..(241): n is a, c, g, or t
tcagtactctcgtgcacgaccggtgctcgatttagtgtgagtagtttggttttggtggtctccactcccgccttgacgaggctgattactactgctgctcatatgcaggtcgtatctcttatgtcttcggaactgggaccaaggtcaccgtcctaggtcagcccaaggccaaccccactgtcactctgttcccgccctcctccacgagagtactgagcgggctggcaaggcgcatagnnnn

SEQ ID NO: 258469 - DNA, 242 bp, Homo sapiens; identical to SEQ ID NO: 258436
  misc_feature: GYAE6OF01AZWMR.19.78.H01.1.454.CMB.1.raw
  modified_base (238)..(242): a, c, t, g, unknown or other
  misc_feature (238)..(242): n is a, c, g, or t

SEQ ID NO: 258470 - DNA, 542 bp, Homo sapiens
  misc_feature: GYAE6OF01BM6KH.19.78.H01.1.454.CMB.1.raw
  modified_base (266)..(266): a, c, t, g, unknown or other
  misc_feature (266)..(266): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctggtaccaanatcaaccaaataaacgcccccaaactcatcatttatgatgcactaagcggccctcagggtttctaatcgcttctctggctcaagtctggcaacacggcctccctgacaatctcgtggctccaggctggaggacgaggctagacttactactgctgctcattatgcaggtcgtatcttcttatgttcgttacggaacgtcgggaacctaagggtccacccggttaccgtacggtcacgaccccgaaacggacccccaaacccctactcgtctacccg

SEQ ID NO: 258471 - DNA, 545 bp, Homo sapiens
  misc_feature: GYAE6OF01ARW6T.19.78.H01.1.454.CMB.1.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacaggatcctgggctcagtctgccctgactcagcctcactcagtgtccgggtctcctggacagtcagtcaccatctcctgcactggaaccagcagtgatgttggtggttataactatgtctcctggtaccaacaacacccaggcaaggcccccaaagtcatgatttatgatgtcagtgagcggccctcgacggggtccctgatcgcttctctggctccaagtctggcaacacggcctccctaaccatctctcgggcctccgaggctgacggtatgacggctgattacttactgctgctacatatgcgaggctaggtactacgttttggtacgtttccggggacgggtaacgggaccctaaggccttacggtaacccggttcccgtaagggtccacggccccgtaacggg

SEQ ID NO: 258472 - DNA, 288 bp, Homo sapiens
  misc_feature: GYAE6OF01A9G4X.19.78.H01.1.454.CMB.1.raw
  modified_base (244)..(244): a, c, t, g, unknown or other
  misc_feature (244)..(244): n is a, c, g, or t
  modified_base (250)..(288): a, c, t, g, unknown or other
  misc_feature (250)..(288): n is a, c, g, or t
tcagtactctcgtgcacgaccggtgctcgatttagtgtgagtagtttggggtttgggtggtctccactcccgcttgacgaggctgattactactgctgctccatatgcaggtcgtatctcttatgtcttcggaactgggaccaaggtccaccgtcctaggtcagcccaaggcccaaccccactgtccacctctcgttccccaccctcctccacggagagtactgacgcgggctggcaagggccncatagnnnnnnnnnnnnnnnnnnnnnnnnnnnnnnnnnnnnnnn

SEQ ID NO: 258473 - DNA, 545 bp, Homo sapiens
  misc_feature: GYAE6OF01EVWG1.19.78.H01.1.454.CMB.1.raw
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtccgggtctcctggacagtcagtcaccatctcctgcactggaaccagcagtgatgttggtgttataactatgtctctgtaccaacaacaccagcaacggcccccaaagtcatgatttatgatgtcagtgagcggccctcgaggggtccctgatcgcttctctggctccaagtctggacaacacggcctccctaaccatctctgggcctcgaggctgaggatgaggtctgtatttattactgtctgtctttatatcgcgaggcgtaggtactacgtttggtacgttcgggacggaacggaccgtacggtcgtacggtacccgtcgtaggtccacggacccgaaggcctccggcccccgttacgg

SEQ ID NO: 258474 - DNA, 571 bp, Homo sapiens
  misc_feature: GYAE6OF01ERZD4.19.78.H01.1.454.CMB.1.raw
  modified_base (421)..(421): a, c, t, g, unknown or other
  misc_feature (421)..(421): n is a, c, g, or t
  modified_base (552)..(552): a, c, t, g, unknown or other
  misc_feature (552)..(552): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctcctggtaccaacatcaaccaaaataaacgcccccaaactcatcatttatgatgccaactaagcgccctctagggtttctaatcgcttctctggctcaagtctgcaacacgcctcctgacatctctggcctcagctgaggacgagctgattactactgctgctacntatgactaggtctattcttcttagtcgttcttacgggaaccgttacgggaaccctaaacgggtccctaacccggttcccgttaacgggtaccaaccggtacccccgtaaacgggaccccctaaaacccccncgttcgttcccttaacccg

SEQ ID NO: 258475 - DNA, 556 bp, Homo sapiens
  misc_feature: GYAE6OF01CPIX7.19.78.H01.1.454.CMB.1.raw
  modified_base (302)..(302): a, c, t, g, unknown or other
  misc_feature (302)..(302): n is a, c, g, or t
  modified_base (448)..(448): a, c, t, g, unknown or other
  misc_feature (448)..(448): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgattgttggtgttataactatgtctctgtaccaacaacaccaggacaacggccccaaagtcatgatttangatgtcagtgagcggccctcgacggggtccctgatcgctttctcgtggctccaagtctacggaccaacgaccggccctaccctaacctctcgtcgtcgggcctccaggtctagaggatggaggctagtactttattactgctgctnatgtgtcaggcgaggttactacgtttggtagttcgggacggaagggaccaagccgttcgacccgttccgttaggtaccaacgccccgaaggtccctccggtccccccg

SEQ ID NO: 258476 - DNA, 527 bp, Homo sapiens
  misc_feature: GYAE6OF01DW22V.19.78.H01.1.454.CMB.1.raw
  modified_base (428)..(428): a, c, t, g, unknown or other
  misc_feature (428)..(428): n is a, c, g, or t
  modified_base (516)..(516): a, c, t, g, unknown or other
  misc_feature (516)..(516): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctcctggtaccaacatcaccaaataaacgcccccaaactcatcatttatgatgccactaagcgccctcagggtttctaatcgcttctctggctccaagtctggcaacacggcctcctgacaatctctgggcctccaggctggacggacgaggctgattactactgctgctcatntgcaggttctattcttcttatcgtcttacggactgggaaccaggtccacccgttctacggtcacgaccccaaggaccccaaccccgtntcgtctacccg

SEQ ID NO: 258477 - DNA, 508 bp, Homo sapiens
  misc_feature: GYAE6OF01B405E.19.78.H01.1.454.CMB.1.raw
  modified_base (228)..(228): a, c, t, g, unknown or other
  misc_feature (228)..(228): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
  modified_base (446)..(446): a, c, t, g, unknown or other
  misc_feature (446)..(446): n is a, c, g, or t
  modified_base (499)..(499): a, c, t, g, unknown or other
  misc_feature (499)..(499): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtgatgttagaaattctaacttgtctcctggtaccaacatcaaccaaataaacgcccccaaactcatcattatgatgccactaagcgccctcgagggtttctaatcgtcttctctggctcaagtctgcaacgcggcctcctgacatctcgtggctcgaggctggaggacgaggtactgtattactacgtgctgtctnatangcgagtcgtatctnttatgtctcgatggacagtctaccgtctagccacgaccctacgacccaacccntcgctaccg

SEQ ID NO: 258478 - DNA, 550 bp, Homo sapiens
  misc_feature: GYAE6OF01A98PQ.19.78.H01.1.454.CMB.1.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctcctggtaccaacatcaccaaataaacgcccccaaactcatcatttatgatgccactaacgccggccctcgtaggggtttctaatcgcttctctggctcaagtctggcaacacgcctcctgacatctcgtggctcgaggctggaggacgaggctgacttactactgctgctcatatgactacggtcttattcttcttagtcgttacgttacggaacgtcgggaacccgtaaggtcctacccgttacgtacggtaccacgaccccgaacggaccccaaacccctctcgtcctaccg

SEQ ID NO: 258479 - DNA, 241 bp, Homo sapiens
  misc_feature: GYAE6OF01BM77Z.19.78.H01.1.454.CMB.1.raw
  modified_base (237)..(241): a, c, t, g, unknown or other
  misc_feature (237)..(241): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccatgtcactctgttccccaccctcctccacgagagtatgagcgggctggcaaggcgcatagnnnnn

SEQ ID NO: 258480 - DNA, 636 bp, Homo sapiens
  misc_feature: GYAE6OF01C490X.19.78.H01.1.454.CMB.1.raw
  modified_base (316)..(316): a, c, t, g, unknown or other
  misc_feature (316)..(316): n is a, c, g, or t
  modified_base (528)..(528): a, c, t, g, unknown or other
  misc_feature (528)..(528): n is a, c, g, or t
tcagtactctcgtgcacgaccggtgctcgatttagtgtgagtagtttggggtttgggggggtcacaagaggcagcgctctcgggacgtctccaccatggcctgggctctgctgctcctcactctcctcactcaggacacagggtcctgggcccagtctgccctgactcagtctgcctcgtgtctgggtctccgtggactaggtcggtacacctatcctcctgcacgtggaaccagcagtgatgttagaaattcgtaacttgtctcctgtaaccaacatacaacccaaaagtaacaccccaaatcaactctatttangatcgaccaagtaacgccgtcctacgtagggttactaatcgtcttctctcggacctacaagttcctggaccgaacaccggtccctacccgtacgaacctaacttccgtcgtcggaccttaccaagtcgtaaggaacggacgtaacggtactgtaacttaccgtactcggctagtcctagaattagtcgtagtacggttacttacgtaccttnttacgtgttaccgttacggtaacctacgggtaaccaacggttccgaccgttaccgtacggtacaccgtaaccctaacggaccccctaacccgtatccggtcttacccg

SEQ ID NO: 258481 - DNA, 244 bp, Homo sapiens
  misc_feature: GYAE6OF01BWOP2.19.78.H01.1.454.CMB.1.raw
  modified_base (237)..(244): a, c, t, g, unknown or other
  misc_feature (237)..(244): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaacccactgtcactctgttcccaccctcctccacgagagtactgagcgggctggcaaggcgcatagnnnnnnnn

SEQ ID NO: 258482 - DNA, 536 bp, Homo sapiens
  misc_feature: GYAE6OF01ENQEU.19.78.H01.1.454.CMB.1.raw
  modified_base (306)..(306): a, c, t, g, unknown or other
  misc_feature (306)..(306): n is a, c, g, or t
  modified_base (458)..(458): a, c, t, g, unknown or other
  misc_feature (458)..(458): n is a, c, g, or t
  modified_base (527)..(527): a, c, t, g, unknown or other
  misc_feature (527)..(527): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctggtaccaacatcaaccaaataaacgcccccaaactcatcatttangatgccactaagccggccctcgtagggtttctaatcgtcttctctggctcaagtctggcaacaccggccctccctgactaatctcgtgggcctccgaggctggaggacgaggctgattactactgctgctcatatgactaggtctattcttnttagtgttctacggaactgggaacctacggtcaccgtctaggtccacggacccaacggacccaaccccntcgtctacc

SEQ ID NO: 258483 - DNA, 499 bp, Homo sapiens
  misc_feature: GYAE6OF01DRESA.19.78.H01.1.454.CMB.1.raw
  modified_base (418)..(418): a, c, t, g, unknown or other
  misc_feature (418)..(418): n is a, c, g, or t
  modified_base (436)..(436): a, c, t, g, unknown or other
  misc_feature (436)..(436): n is a, c, g, or t
  modified_base (491)..(491): a, c, t, g, unknown or other
  misc_feature (491)..(491): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaaccaaataaagcccccaaaactcatcatttatgatgccactaagcgcctcagggtttcaatcgcttctctgctcaagtctggcaacacggcctccctgacaatctctggctcagctgaggacgaggctgattactactgctgctnatatgcaggtctatcttnttatgtcttcggactgggacaggtcaccgtctagcacgcccgaacgcccaacccntgtctacc

SEQ ID NO: 258484 - DNA, 271 bp, Homo sapiens
  misc_feature: GYAE6OF01CBETS.19.78.H01.1.454.CMB.1.raw
  modified_base (239)..(271): a, c, t, g, unknown or other
  misc_feature (239)..(271): n is a, c, g, or t
tcagtactctcgtgcacgaccggtgctcgatttagtgtgagtagtttgggtttggtggtctccactcccgccttgacgaggctgattaactactgctgctcatatgcaggtcgtatctcttatgtcttcggaactgggaccaaggtcaccgtcctaggtcacgcccaaggccaaccccactgtcactctgttcccacctcctccacgagagtactgagcgggctggcaaggcgcatagnnnnnnnnnnnnnnnnnnnnnnnnnnnnnnnnn

SEQ ID NO: 258485 - DNA, 514 bp, Homo sapiens
  misc_feature: GYAE6OF01ANPKQ.19.78.H01.1.454.CMB.1.raw
  modified_base (305)..(305): a, c, t, g, unknown or other
  misc_feature (305)..(305): n is a, c, g, or t
  modified_base (504)..(504): a, c, t, g, unknown or other
  misc_feature (504)..(504): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttangatgccactaagcggccctcagggtttctaatcgcttctctggctcaagtctggcaacacggcctccctgacatctctgggctccaggctgaggacgaggctgattactactgctgctcatatgcaggtctatctcttatcgtcttcggaactgggaccaggtccaccgtctaggtccacgcccaacggccccaacccnctcgtctacc

SEQ ID NO: 258486 - DNA, 513 bp, Homo sapiens
  misc_feature: GYAE6OF01CYP9A.19.78.H01.1.454.CMB.1.raw
  modified_base (226)..(226): a, c, t, g, unknown or other
  misc_feature (226)..(226): n is a, c, g, or t
  modified_base (296)..(296): a, c, t, g, unknown or other
  misc_feature (296)..(296): n is a, c, g, or t
  modified_base (417)..(417): a, c, t, g, unknown or other
  misc_feature (417)..(417): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcggtcaccatctcctgcactggaaccngcagtgatgtgaaattctaacttgtctctgtacaacatcaccaaataaacgccccaaactcatcatttangatgccactaagcggcctcagggtttcaatcgcttctctgctcaagtctggcaacacggcctcctgactaactctcgtgggctccgaggctggaggacgagctagattactactgctgctnatatgcaggttcgtattctcttagtgtcgttacggaacgtacggaccaaggtcaccgtctaggccacgccctaacggacccaacccactgtctacc

SEQ ID NO: 258487 - DNA, 518 bp, Homo sapiens
  misc_feature: GYAE6OF01E4SIX.19.78.H01.1.454.CMB.1.raw
  modified_base (323)..(323): a, c, t, g, unknown or other
  misc_feature (323)..(323): n is a, c, g, or t
  modified_base (440)..(440): a, c, t, g, unknown or other
  misc_feature (440)..(440): n is a, c, g, or t
  modified_base (508)..(508): a, c, t, g, unknown or other
  misc_feature (508)..(508): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgctcctggtaccaacatcacccaaataaagcccccaaactcatcatttatgatgccactaagcggccctnaggggtttctaatcgcttctctggctcaagtctggcaacacgacctccctgacatctctggctcaggctgaggacgaggctgacttactactgctgctcatatgacaggtctatctnttatgtcgttcggactgggaaccaaggtcctaccgtcgtagtccagccccgaaacggccccaaacccnctcgctaccg

SEQ ID NO: 258488 - DNA, 742 bp, Homo sapiens
  misc_feature: GYAE6OF01BZCVQ.19.78.H01.1.454.CMB.1.raw
  modified_base (204)..(204): a, c, t, g, unknown or other
  misc_feature (204)..(204): n is a, c, g, or t
  modified_base (321)..(321): a, c, t, g, unknown or other
  misc_feature (321)..(321): n is a, c, g, or t
tcagtactctcgtgcacgaccggtgctcgatttagtgtgagtagtttgggtttgggggggtcgacaagaggcagccgctctcgggacgtctccaccatgggcctgggctcgtcgctgctcctcacgtctcctcactcaggacacgacgggtccctgggcccagtctgccctgactcagtctgcctcgtgtctggtctcctggcngtcgtcacatctctgcactgaaccagccagtgacgtcgttaggaattctaaccttgtctccgtggttaccaacatccaacccaaataaacgcccccaaactaccagtactactttancgtatcgacctactaaggccggccccgtttacgtaacgggggttttacaaagttccggtacttccttcgtcggtaccttacccgaaggttcgtacgggacaaaccgtccggtccctacccgtagaacctaacgttccttcgtcgggccctaccgagggccgttagggaacgggaccgtacgggtcttacggtaacttttaaccgtacgttcggtaccttggaccctttactaagttacgtcggaccgttaacggttaccgtttaatttccttttacgtttacggttcggtttaccggttaaccgggaacgttaccgggggaaaccctaaggggttccctaacccggttaccgtaacggtaccgaaccggtaccccgtaaacggtaccccctaaacccccgtagttccggtaccttacccgg

SEQ ID NO: 258489 - DNA, 534 bp, Homo sapiens
  misc_feature: GYAE6OF01DZ7VK.19.78.H01.1.454.CMB.1.raw
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaacccaaataaacgcccccaaactcatcatttatgatgccactaagccgccctcgtagggtttctaatcgcttctctggctccaagtctgcaacacggcctcctgacaatctctggcctccaggctgacggacgaggctagattactactgctgctcatatgcaggtcgtattctcttatcgttcgttacggaacgtgggaacctaaggtcctacgtcctaggtccgagccccgaacggaccccaaccctctgtcctaccg

SEQ ID NO: 258490 - DNA, 531 bp, Homo sapiens
  misc_feature: GYAE6OF01C2SJ7.19.78.H01.1.454.CMB.1.raw
  modified_base (380)..(380): a, c, t, g, unknown or other
  misc_feature (380)..(380): n is a, c, g, or t
tcagtactctcgtgcacgaccggtgctcgatttagtgtgagtagtttgggtttggggggggtcacaaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaattctaacttgtctctggtaccaacatcaaccaaataaacgccccaaactcatcatttatgatgccactaagcggccctcaggggtttctaatcgcttctctggctcaagtctggcaacacggcctccctgacaatctntgggctccaggctggaggacgaggctgattactactgctgctcatatgacaggttcgtatcttcttagtgttcttcggaactcgggacctaagggtccacccggttctaggtccacgaccccgaacggacccaaccccactcgtctacccg

SEQ ID NO: 258491 - DNA, 507 bp, Homo sapiens
  misc_feature: GYAE6OF01CT0R7.19.78.H01.1.454.CMB.1.raw
  modified_base (227)..(227): a, c, t, g, unknown or other
  misc_feature (227)..(227): n is a, c, g, or t
  modified_base (297)..(297): a, c, t, g, unknown or other
  misc_feature (297)..(297): n is a, c, g, or t
  modified_base (361)..(361): a, c, t, g, unknown or other
  misc_feature (361)..(361): n is a, c, g, or t
  modified_base (495)..(495): a, c, t, g, unknown or other
  misc_feature (495)..(495): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtgatgtgaattctaacttgtctctggtaccaacatcaccaaataacgccccaaactcatcatttangatgccactaagcgccctcagggtttctaatcgcttctctggctcagtctgcaacacgcctccngacatctctggctccaggctggaggacgaggctgacttactactgctgctcatatgcaggtctatcttcttatgtcttcggaactggaccaggtccaccgttccgtaggtccacgacccgaacgccccaacccnctcgtcctaccg

SEQ ID NO: 258492 - DNA, 541 bp, Homo sapiens
  misc_feature: GYAE6OF01AG65C.19.78.H01.1.454.CMB.1.raw
  modified_base (308)..(308): a, c, t, g, unknown or other
  misc_feature (308)..(308): n is a, c, g, or t
  modified_base (430)..(430): a, c, t, g, unknown or other
  misc_feature (430)..(430): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatcctcctgcactggaaccagcagtgatgttaggaaattctaaccttgtctcctggtacccaacatcacccaaataaagcccccaaactcatcattttangatgccactaagcggccctcagggtttctaatcgcttctctggctcaagtctggcaacacggccctcctgacatctctggctcgagctgaggacgaggctagattactactgctgctcatangacgaggtctatcttcttagtgttcgttacggacgtcgggaaccctaggtcctaccggtccgtacggtaccacggtacccaacggccccaaacccctactcgtcctacccg

SEQ ID NO: 258493 - DNA, 243 bp, Homo sapiens
  misc_feature: GYAE6OF01EP771.19.78.H01.1.454.CMB.1.raw
  modified_base (227)..(227): a, c, t, g, unknown or other
  misc_feature (227)..(227): n is a, c, g, or t
  modified_base (233)..(243): a, c, t, g, unknown or other
  misc_feature (233)..(243): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtctaggtcagcccaaggcccaacccatgtcactctgttcccgcctctccacgagagtactgagcggctggcaaggcncatagnnnnnnnnnnn

SEQ ID NO: 258494 - DNA, 505 bp, Homo sapiens
  misc_feature: GYAE6OF01CLDE1.19.78.H01.1.454.CMB.1.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtggaattctaacttgtctcctggtacaacatcaccaaataaagccccaaactcatcatttatgatgccactaagcgcctcagggtttctaatcgcttctctgctccaagtctggcaacacggcctcctgacatctctggctcaggctgagatgaggctgattattactgctgctcatatgcaggcaggttactacgtttggtattcgggcggagggaccaagtctagaccgtcctaggtccacgcccaaggctccgccccgtcggtacc

SEQ ID NO: 258495 - DNA, 522 bp, Homo sapiens
  misc_feature: GYAE6OF01D742A.19.78.H01.1.454.CMB.1.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaaccaaataaacgccccaaactcatcatttatgatgccactaagcgcctcagggtttctaatcgcttctctggctccaagtctggcaacacggcctccctgacaatctcgtgggcctccaggctaggacggacgaggctagtattactactgctgctcatatgctaggtctatcttcttatgtcttcggaactgggacctaggtcctaccgtcctggcacgacccaaggacccaacccactgtcctaccg

SEQ ID NO: 258496 - DNA, 241 bp, Homo sapiens
  misc_feature: GYAE6OF01BYUM2.19.78.H01.1.454.CMB.1.raw
  modified_base (239)..(241): a, c, t, g, unknown or other
  misc_feature (239)..(241): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccactgtcactctgttccccgccctcctccacgagagtactgagcgggctggcaaggcgcatagnnn

SEQ ID NO: 258497 - DNA, 562 bp, Homo sapiens
  misc_feature: GYAE6OF01EFQ27.19.78.H01.1.454.CMB.1.raw
  modified_base (322)..(322): a, c, t, g, unknown or other
  misc_feature (322)..(322): n is a, c, g, or t
  modified_base (361)..(361): a, c, t, g, unknown or other
  misc_feature (361)..(361): n is a, c, g, or t
  modified_base (548)..(548): a, c, t, g, unknown or other
  misc_feature (548)..(548): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctgtaccaacatcaccaaataacgcccccaaactcatcatttatgatgccactaagcgccctnagggtttcaatcgcttctctggctcaagtctggacaacncgcctccctgacaatctcgtggctccgagctgaggacgaggctagatttactactgctcgctcaattcgtgcgtaggtcgttattccttctttattcggttcttaccgggaacgttcgggaaacctaacgggtccctacccggttccgtaggtccaaccgaccccgaaacggaccccaaaccccctntccgtccgtacccg

SEQ ID NO: 258498 - DNA, 548 bp, Homo sapiens
  misc_feature: GYAE6OF01EAG7G.19.78.H01.1.454.CMB.1.raw
  modified_base (199)..(199): a, c, t, g, unknown or other
  misc_feature (199)..(199): n is a, c, g, or t
  modified_base (232)..(232): a, c, t, g, unknown or other
  misc_feature (232)..(232): n is a, c, g, or t
  modified_base (398)..(398): a, c, t, g, unknown or other
  misc_feature (398)..(398): n is a, c, g, or t
  modified_base (419)..(419): a, c, t, g, unknown or other
  misc_feature (419)..(419): n is a, c, g, or t
  modified_base (422)..(422): a, c, t, g, unknown or other
  misc_feature (422)..(422): n is a, c, g, or t
  modified_base (443)..(443): a, c, t, g, unknown or other
  misc_feature (443)..(443): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacngtcgtcaccatctctgcactggaaccagcagtnatgttagaaattctaacttgtctctgtaccaacatcaccaaataacgccccaaactcatctatttatgatgaccactaagccgcctcgtagggtttactaatcgtcttctctgctcaagtctgcaacacgcctcctgacatctcgtcggctcgagctaggagacgngctagattactactgctgctnatngacgtagttcgtattccgttnttacgttgttcgttacggaacgtcgggaaccgtaacggtcctaacccgttcgtacggaccgacgaccccgaacgggtaccccaaccccgacttcgtccctacccg

SEQ ID NO: 258499 - DNA, 576 bp, Homo sapiens
  misc_feature: GYAE6OF01EVECF.19.78.H01.1.454.CMB.1.raw
  modified_base (564)..(564): a, c, t, g, unknown or other
  misc_feature (564)..(564): n is a, c, g, or t
  modified_base (570)..(570): a, c, t, g, unknown or other
  misc_feature (570)..(570): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctggtaccaacatcaaccaaataaacgacccccaaactcatctatttatgatgaccactaacggccggtccctcgtaggggtttactaatcgcttctcgtcggctaccaagtctacggaccaaccgcgtccctcctgactaactctctgggcctccgagcgtggagacggaggctagaactttactacgttcgctcgcttacattagtcgacgtggtcgttactccttcttatcggttcgttacggaacgtcggaacctaaggtccctaccgtccgtaggccacgaccccaacggcccaacccngttccnctaccg

SEQ ID NO: 258500 - DNA, 278 bp, Homo sapiens
  misc_feature: GYAE6OF01BCEAZ.19.78.H01.1.454.CMB.1.raw
  modified_base (243)..(244): a, c, t, g, unknown or other
  misc_feature (243)..(244): n is a, c, g, or t
  modified_base (246)..(246): a, c, t, g, unknown or other
  misc_feature (246)..(246): n is a, c, g, or t
  modified_base (248)..(278): a, c, t, g, unknown or other
  misc_feature (248)..(278): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggcccaaccccatgtcactctcgttcccgcctacctcacgagagtacctggacgcgggctggcgaaggcgctagtgnntnannnnnnnnnnnnnnnnnnnnnnnnnnnnnnn

SEQ ID NO: 258501 - DNA, 751 bp, Homo sapiens
  misc_feature: GYAE6OF01BO3R4.19.78.H01.1.454.CMB.1.raw
  modified_base (236)..(236): a, c, t, g, unknown or other
  misc_feature (236)..(236): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctccgtggacagtcggtcaccatctcctgcacgtggaaccagcagtnatgttagaaattctaacttgtctctgtaccaacatacaccaaataacgccccaaactcatctatttatgatcgaccactaacggccggccctacgtaggggtttactaagtcgtccttactcgtcggtcctaccgaacgttcgtacggaccaaccgaccggtccctacccgtagaacctaaacgttccgttacgtacggggacccttacccggtagggtaccgttagggaacgggaaccgggtacgggaccgttacgtaactttaacccgttaccgtcgtcctacggtccttaccgtaattacgtcggaccgttagggttccgtttaacttcgtttaactttacgttacgtttaccggttaaccgggtaaaccgttaccggggaacccgttaaaccgggttccccgtaaccccggtttacccgttaacgggtaccccgtaacccggtaacccccggtaaaccgggtaaccccccctaaacccccgttaccgtttcccggttacccgttaaccccg

SEQ ID NO: 258502 - DNA, 243 bp, Homo sapiens
  misc_feature: GYAE6OF01BGKNM.19.78.H01.1.454.CMB.1.raw
  modified_base (240)..(243): a, c, t, g, unknown or other
  misc_feature (240)..(243): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggcccaaccccactgtcactctgttccccgccctcctccacgagagtactgagcgggctggcaaggcgcatagnnnn

SEQ ID NO: 258503 - DNA, 690 bp, Homo sapiens
  misc_feature: GYAE6OF01BIGLZ.19.78.H01.1.454.CMB.1.raw
  modified_base (197)..(197): a, c, t, g, unknown or other
  misc_feature (197)..(197): n is a, c, g, or t
  modified_base (206)..(206): a, c, t, g, unknown or other
  misc_feature (206)..(206): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacgagggtcctgggcccagtctgccctgactcagtctgcctcgtgtctgggtctcgtgacngtcgtcacntctctgcacgtggaaccagctagtgattggttagtaaacttcctaaccgtttgtaccttcccgtaggtaacccaactactaccaaaccctaaaattaaaccgacccccctaaaactcaacttacctaatttatgacttcgacctaacgtaacggcccggtaccctgtacgggtttactaactcgtcttcgtcgtcgtacctacgtaagtcgtcggaaccaacgtaccggtaccctccgtagaacctactcgtaccgtcggtctaccggaggtccgtaggaacggacggcggtacgtcgtaacttacgtactggtctacgtctacgtatacgtgacgttaggtaccttacgtacctttgttaacggtttctacggttaccgtaacggtaccggtaaccgttacggtcccgtaccggttacgtacgggtaccgacccggaacccgtaaccggaccccctaaacccgtgtaccgtacccttaacccg

SEQ ID NO: 258504 - DNA, 632 bp, Homo sapiens
  misc_feature: GYAE6OF01C135O.19.78.H01.1.454.CMB.1.raw
  modified_base (228)..(228): a, c, t, g, unknown or other
  misc_feature (228)..(228): n is a, c, g, or t
  modified_base (305)..(305): a, c, t, g, unknown or other
  misc_feature (305)..(305): n is a, c, g, or t
  modified_base (379)..(379): a, c, t, g, unknown or other
  misc_feature (379)..(379): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctccgtggacagtcggtcaccatctcctgcactggaaccngcagtgatgttagaaattctaacttgtctctgtacaacatccaaccaaataaacgcccccaaaactcatacatttangatcgccaactaacgcgccctacgtacgggtttcaatcgcttctctggctcaagtctggacaacacgcctccgngacactctacgtggctcgagcgtaggacggacgaggtctagactttacgtactcgtctcgtctacgaattacgtcgacgtacgggttccttaattccttctttaacgttcggttaccggttttaccggaaccgttaccggggtaaacccgtaacgggttcccgtaacccggttaccgttaccggggtacctaacccgggaaccccgtaaaccgggaaccccctaaaccccgtccgttacggtacccttacccg

SEQ ID NO: 258505 - DNA, 536 bp, Homo sapiens
  misc_feature: GYAE6OF01BSSBV.19.78.H01.1.454.CMB.1.raw
  modified_base (363)..(363): a, c, t, g, unknown or other
  misc_feature (363)..(363): n is a, c, g, or t
  modified_base (371)..(371): a, c, t, g, unknown or other
  misc_feature (371)..(371): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaccaaataaacgcccccaaatcatcatttatgatgaccactaagccgccctcgtagggtttctaatcgcttctctgctcaagtctgcaacncgcctccngacatctctggctccgagctagaggacgaggctgacttactactgtctgctcatatgacgtaggtcttatcttacttatcgttacgttacggacgtcgggaacctacggtcctacccgttcgtacgtccaccgcccgaacgacccaaccctcgtcgtccctaccg

SEQ ID NO: 258506 - DNA, 534 bp, Homo sapiens
  misc_feature: GYAE6OF01A3EWV.19.78.H01.1.454.CMB.1.raw
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagcggccctcaggggtttctaatcgcttctctggctccaagtctggcaacacggcctccctgacaatctctgggctccaggctgaggacgaggctgattactactgctgctcatatgacgaggtcgtattcttcttatcgttcttcggaacttcgggaacctaaggtcctaccgtccgtaggtcaacgcccaaacggcccaaccccatcgtcctaccg

SEQ ID NO: 258507 - DNA, 249 bp, Homo sapiens
  misc_feature: GYAE6OF01C08EX.19.78.H01.1.454.CMB.1.raw
  modified_base (241)..(249): a, c, t, g, unknown or other
  misc_feature (241)..(249): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaacccactgtcactctcgttccccgccctcctccacgagagtactggagcgggctggcaaggcgcaatggnnnnnnnnn

SEQ ID NO: 258508 - DNA, 638 bp, Homo sapiens
  misc_feature: GYAE6OF01CS3UP.19.78.H01.1.454.CMB.1.raw
  modified_base (299)..(299): a, c, t, g, unknown or other
  misc_feature (299)..(299): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcggtcaccatctcctgcactggaaccagcagtgatgtgaattctaacttgtctctggtaccaacatcaaccaaataaacgcccccaaatcatcatttangatgccactaagcgccctcgagggtttctaatcgcttctctgctccaagtctggacaacacgtcctcctgacaatctcgtgggcctcgaggtctaggacggacgaaggtcctaggtaactttaaccgtacgttacggccttcgaccttacaagttacgtcggaccgttaacgggttccgttaattctttaccgtttaagttcggttacccggtttaacgggaaacgttccggggaaaccgtaacgggttacctacccggttacccggttaaggtaccccgaacggacccccgaaacgggtaccccccaaacccccgtaacgttccggtcctaaccccgg

SEQ ID NO: 258509 - DNA, 554 bp, Homo sapiens
  misc_feature: GYAE6OF01CBGNK.19.78.H01.1.454.CMB.1.raw
  modified_base (376)..(376): a, c, t, g, unknown or other
  misc_feature (376)..(376): n is a, c, g, or t
  modified_base (430)..(430): a, c, t, g, unknown or other
  misc_feature (430)..(430): n is a, c, g, or t
  modified_base (434)..(434): a, c, t, g, unknown or other
  misc_feature (434)..(434): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaattctaacttgtctctgtaccaacatcaaccaaataaacgcccccaaatcatctatttatgatcgaccaactaagccggtccctacgtagggtttctaatcgcttctctgctcaagtctggcacacggcctccngacatctctcggctccaggctgaggacgaggctagacttactacgtgactgctnatangacgtaggtcgttattcttactttagtcgttccgttacggaacgttcgggaacctacggtcctacccgttccgttaggtccacgacccgaaccggaccccaaccctcgtcgtcctacccg

SEQ ID NO: 258510 - DNA, 698 bp, Homo sapiens
  misc_feature: GYAE6OF01ED7B4.19.78.H01.1.454.CMB.1.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggccagtctgccctgactcagtctgcctccgtgtctgggtctcctggacagtcggtcaccatctcctgcactggaaccagcagtgatgttaggaattctaacttgtctctggtaccaacatcaaccaaataaacgacccccaaactcaactacactttatgtatcgccaactaacgccggtccctacgtaggggttttacctaagttccgctttcctctgggtcctacctaacgtcgtacggaccaaaccgaccggtccctccctaggaacctaatccgttcgtcgggtacccttccgaagggtccgtacggaacgggtacgaacgggtcttacggaactttactacctcgtctcgctacctattacgtcggaccgttaagggttcgttaacttcctttacttacgttcgttccgtttaacgggtaaaccgttcggggaaacccgttaacgggttacccgtaacccggttaccggttaaccggtacccgaaaccggaaccccgtaaaccgggtaacccccaaaccccccgttgtccgtacccgttaacccg

SEQ ID NO: 258511 - DNA, 547 bp, Homo sapiens
  misc_feature: GYAE6OF01DJJ1X.19.78.H01.1.454.CMB.1.raw
  modified_base (369)..(369): a, c, t, g, unknown or other
  misc_feature (369)..(369): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgattgttagaaattctaacttgtctcctggtaccaacatcaacccaaataaacgccccaaactcatcatttatgatgccactaagcgcctcagggtttctaatcgcttctctggctcaagtctggcaacacgcctccngacaatctctggctcaggctgagacgagtctgattactactgctgctacatatgcgtaggttcgtatcttctttagtcgttcgttaccggtaacgttcgggaaccgtaacggtcctaccgttccgtacggtccaccgaccccgaacggaccccaaccccgtaccgtcgtcctaacccg

SEQ ID NO: 258512 - DNA, 505 bp, Homo sapiens
  misc_feature: GYAE6OF01DGWFS.19.78.H01.1.454.CMB.1.raw
  modified_base (228)..(228): a, c, t, g, unknown or other
  misc_feature (228)..(228): n is a, c, g, or t
  modified_base (336)..(336): a, c, t, g, unknown or other
  misc_feature (336)..(336): n is a, c, g, or t
  modified_base (361)..(361): a, c, t, g, unknown or other
  misc_feature (361)..(361): n is a, c, g, or t
  modified_base (393)..(393): a, c, t, g, unknown or other
  misc_feature (393)..(393): n is a, c, g, or t
  modified_base (411)..(411): a, c, t, g, unknown or other
  misc_feature (411)..(411): n is a, c, g, or t
  modified_base (425)..(425): a, c, t, g, unknown or other
  misc_feature (425)..(425): n is a, c, g, or t
  modified_base (496)..(496): a, c, t, g, unknown or other
  misc_feature (496)..(496): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtcctgccctgactcagtctgcctccgtgtctgggtctcctggacagtcggtcaccatctcctgcactggaaccngcagtgatgttagaaattcaaccttgtctcctggtaccaacatcaccaaataaacgccccaaatcatcatttatgatgccactaagcggccctgagggtttctaatcnttctctggctccaagtctggcaacncggcctccctgacatcgtcgtggctccagccngaggcgaggctgattacnctgctgactcattngcaggtcctatctcttagtgtcttcggacttgggacagtcacgtctaggtcagccctaacggcccaacccnctgtctacc

SEQ ID NO: 258513 - DNA, 730 bp, Homo sapiens
  misc_feature: GYAE6OF01EPW47.19.78.H01.1.454.CMB.1.raw
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctctgcactggaaccagcagtgatgttaggaaattctaaccttgtctcctggtaccaacataccaaccaaataacgccccaaactcatcatttatgatcgaccactaacggccggtccctcgtaggggtttctaagtccgactttctcgtggtcctaccgtaagtccgttaggacctaaccgaccgggtccctccctacggacctaacttcgtaccgttcgggccttaccggaaggtcgtacgggaagggaccggacgggtcttacggtaactttaaccgtacgttcgtacttcggtaccttacgtaagttaacgtcggtacgttacgggttaccgttacgtttccctttacgtttacgttccggtttaccggtttaccgggtaaaccggttcggggaaacccgttaaccggggttcccgttaaccccgggttacccggttaacgggttacccgaaccggtaacccccggtaaaccgggacccccctaaaacccccgtcgttaccgtcccttaaccccgg

SEQ ID NO: 258514 - DNA, 582 bp, Homo sapiens
  misc_feature: GYAE6OF01EEMRT.19.78.H01.1.454.CMB.1.raw
  modified_base (364)..(364): a, c, t, g, unknown or other
  misc_feature (364)..(364): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctggtaccaacatcaccaaataacgcccccaaactcatcatttatgatgccactaacgcggccctcgtagggtttctaatcgcttctctgctcaagtctgcaacncggcctcctgacatctctgggctccgaggctgaggacgagctgattacactgctgctacatatgcgtaggttctattcttacttagttcgttcgttaccgggtaacgttccgggaaccgtaaacggttcccgtaacccgttaccgtacgggtcccaacggaccccccgtaaacgggacccccctaaacccccgtaccgttaccgtcccgttaaacccg

SEQ ID NO: 258515 - DNA, 555 bp, Homo sapiens
  misc_feature: GYAE6OF01CGWKE.19.78.H01.1.454.CMB.1.raw
  modified_base (371)..(371): a, c, t, g, unknown or other
  misc_feature (371)..(371): n is a, c, g, or t
  modified_base (380)..(380): a, c, t, g, unknown or other
  misc_feature (380)..(380): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaattctaacttgtctctgtaccaacatcaaccaaataaacgccccaaactcatcatttatgatcgccaactaagccggccctcgtagggtttctaatcgtcttctctgctcaagtctgcaacacgcctccngacatctcnggctcgagctgaggacgaggctagacttactactgctgctacatatgacgtaggtcgttattcttacttactgttacgttacggaacgtcgggaacctaacggtccctaaccggttccttacgggtaccaaccggaccccgaaacggaccccaaaccccgtactcgtcctacccg

SEQ ID NO: 258516 - DNA, 704 bp, Homo sapiens
  misc_feature: GYAE6OF01CROPA.19.78.H01.1.454.CMB.1.raw
  modified_base (228)..(228): a, c, t, g, unknown or other
  misc_feature (228)..(228): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacgagggtcctgggcccagtctgccctgactcagtctgcctccgtgtctgggtctcctggacagtcgtcacatctcctgcacgtggaaccngcagtgatgtagtaattctaacttgtcctctgtaccaacactaccaaccaaactaaaccgaccccctaaactctaactactattttacagactacgaccctaacgtaacgccggtaccctacggttaagggtttactaagtccgtcttctcgtcggactaccgtaagtctacgaccaaccgaccggtccctaccgtacgtactaactccgttacgtcggccttaccgacggtctacgggacggacggtaacggtcttacgtaactttaacgttccgtcggtccttggtaccttacgtaacgttacgtcggtacgtacgggtttactactttaccgttcgtttaaccgttgttaccggtttacgaaaacgggttcggtaaccgaaccgggttccgttacccggtacggttaccggtcccaaacccggacccgtaaacccggtaacccaaccccggttacttccgtcccgttaacccg

SEQ ID NO: 258517 - DNA, 587 bp, Homo sapiens
  misc_feature: GYAE6OF01BF47F.19.78.H01.1.454.CMB.1.raw
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
  modified_base (417)..(417): a, c, t, g, unknown or other
  misc_feature (417)..(417): n is a, c, g, or t
  modified_base (470)..(470): a, c, t, g, unknown or other
  misc_feature (470)..(470): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatcctcctgcactggaaccagcagtgatgttaggaaattctaaccttgtctcctcggtaccaacatcaaccaaataaacgaccccaactcatctatttatgatcgaccacgtaacgccgtccctcgtacgggtttctaatcgtcttctcgtgctcagtcngcacncgcctcctagactatctctcggctcgagctggaggacgaggctntactttactactcgctcgcttacatagtgtacgtaggttacgttcttactttnttagttcgttaccggttacggtaccgttacgggtaaccgtaacgggttcctaccgtccggttacggtaccacccggacccgtaaaccggacccctaaccccgctcccgttcctaccg

SEQ ID NO: 258518 - DNA, 699 bp, Homo sapiens
  misc_feature: GYAE6OF01DBFKT.19.78.H01.1.454.CMB.1.raw
  modified_base (303)..(303): a, c, t, g, unknown or other
  misc_feature (303)..(303): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacgagggtcctgggcccagtctgccctgactcagtctgcctccgtgtctgggtctcctggacagtcggtcaccatcctcctgcacgtggaaccagcagtgatgtagaattctaacttgtctctgtaccaacatacaaccaaataaacgaccccaaatcatcatttangatgacataacgcgcctagtagggtttactaatcgtacttctcgtcggtactacaagtcgtacggacaacgaccggtccctacccgtagaacctaacttccgttacgtcgggtacccttaccgaacggtcgttaagggaacggacggtaagggtaccttaggtaacctttaaccgtaacgttcggtccttacggtacctttagaactttacgtacggtaaccgttacgggtttacttaacttccgttttacgtttagttaccggttacggttaaccggtaacggtaccgggtaaacccgtaacggttcccgtaacccgttaccggttacggtaccgtacccgaaccccgtaaaccgggaccccctaaaccccgtcgttaccggtcccttaaccccg

SEQ ID NO: 258519 - DNA, 241 bp, Homo sapiens; identical to SEQ ID NO: 258415
  misc_feature: GYAE6OF01DRAAF.19.78.H01.1.454.CMB.1.raw
  modified_base (238)..(241): a, c, t, g, unknown or other
  misc_feature (238)..(241): n is a, c, g, or t

SEQ ID NO: 258520 - DNA, 594 bp, Homo sapiens
  misc_feature: GYAE6OF01E2HSP.19.78.H01.1.454.CMB.1.raw
  modified_base (306)..(306): a, c, t, g, unknown or other
  misc_feature (306)..(306): n is a, c, g, or t
  modified_base (419)..(419): a, c, t, g, unknown or other
  misc_feature (419)..(419): n is a, c, g, or t
  modified_base (579)..(579): a, c, t, g, unknown or other
  misc_feature (579)..(579): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcggtcaccatctcctgcactggaaccagcagtgatgttagaaattctaaccttgtctcctggtaccaacataccaaccaaataaacgcccccaaatcatcatttangatgaccactaagccggtccctcgtagggtttctaatcgtcttctctggctcaagtctggaccaacgacgtccctcctgacactctacgtcggcctccgaggctggaggacgnggctagacttactactcgtctcgctacatagtgacgtaggttcttattcttctttagtcggttaccgttacgggaaccgttcggggaaccctaacgggtccctacccggttccgtaagggttcccacggacccccgtaaacgggacccccaaacccccgngttccgtcctacccg

SEQ ID NO: 258521 - DNA, 586 bp, Homo sapiens
  misc_feature: GYAE6OF01EWQ2D.19.78.H01.1.454.CMB.1.raw
  modified_base (309)..(309): a, c, t, g, unknown or other
  misc_feature (309)..(309): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaacttgtctcctggtaccaacactacaaccaaataaacgaccccaaactcatctatttangatcgccactagccgcctcgtagggtttctatcgtcttctctgctcaagtctggacaacgacgcctccgagactatctcgtcggcctcgaggctaggagacgagtctagattactctgctacgtctactattacgtgactacgggttcttaacttcttagttatcgttaccgttaggaaccgttacggggacctaacggtccctaccggtaccgttacgggaccctaacgacccccgtaaacggaccccctaaacccgcgttacgtccctaacccgg

SEQ ID NO: 258522 - DNA, 240 bp, Homo sapiens
  misc_feature: GYAE6OF01CQ04P.19.78.H01.1.454.CMB.1.raw
  modified_base (238)..(240): a, c, t, g, unknown or other
  misc_feature (238)..(240): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccatgtcactctgttccccaccctcctccacgagagtactgagcgggctggcaaggcgcatagnnn

SEQ ID NO: 258523 - DNA, 517 bp, Homo sapiens
  misc_feature: GYAE6OF01EKO1Z.19.78.H01.1.454.CMB.1.raw
  modified_base (433)..(433): a, c, t, g, unknown or other
  misc_feature (433)..(433): n is a, c, g, or t
  modified_base (435)..(435): a, c, t, g, unknown or other
  misc_feature (435)..(435): n is a, c, g, or t
  modified_base (507)..(507): a, c, t, g, unknown or other
  misc_feature (507)..(507): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctctgcactggaaccagcagtgatgttagaaattctaaccttgtctcctggtaccaacatacaaccaaataaacgcccccaaatcatcattactgatgccactagcggcctcgtagggtttactaatcgcttctctggctcaagtctggacaacacggtcctccgtagacaatctcgtagggcctccgaggctggagcgagctgattactctgctgctcatangnacggtctattctacttatcgtctcggaactggaactagtccaccgtctaggcagacccgtaagcccaacccnctgtctaccg

SEQ ID NO: 258524 - DNA, 566 bp, Homo sapiens
  misc_feature: GYAE6OF01DE2CP.19.78.H01.1.454.CMB.1.raw
  modified_base (304)..(304): a, c, t, g, unknown or other
  misc_feature (304)..(304): n is a, c, g, or t
  modified_base (382)..(382): a, c, t, g, unknown or other
  misc_feature (382)..(382): n is a, c, g, or t
  modified_base (434)..(434): a, c, t, g, unknown or other
  misc_feature (434)..(434): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacaggtcctgggcccagtctgccctgactcagtctgcctccgtgtctgggtctcctggacagtcggtcaccatctcctgcactcggaaccagcagtgattgttagaaattctaacttgtctcctggtaccaacatcaaccaaataaacgccccaaactcatcatttangatgccactaagcggcctcgagggtttctaatcgcttctctgctcaagtctggcaacacggcctcctgacaatctcgngggcctccgaggctaggaggacgaggctgtacttactactgctgctcattangactaggttcgtacttcttactttattgttccgttaccggaacttcggggaacctaacgggtacctacccggttaccgtacggtaccgaacgacccccgaacggaccccaacccctaccgtcgtcgtacccg

SEQ ID NO: 258525 - DNA, 614 bp, Homo sapiens
  misc_feature: GYAE6OF01DJO00.19.78.H01.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacgagggtcctgggcccagtctgccctgactcagtctgcctccgtgtctggtctctggacngtcgtcaccatctcctgcactggaaccngcagtgatggttagaaattctaaccttgtctctgtaccaacatcaccaaataacgccccaaactcatctatttatgatcgaccaactaagccgtccctagtacgggtttactaactcgtcttctctgctcaagtctgcaacgcgcctccctgacatctcgtcggctccgagcgtaggacggacggaggtctagtacgtttactacgtcgcgttcgacttcaattagtcgactacgggttcgttaactcctttacgtttagttcggttccgtttaccgggtaaacctaccggggtaaccgtaaccggttcccgtaaccccggttccgtaacgggtacccgacggacccccgtaaaccggccccaaaccccctcgttcgtaccttaccccg

SEQ ID NO: 258526 - DNA, 709 bp, Homo sapiens
  misc_feature: GYAE6OF01CZKKD.19.78.H01.1.454.CMB.1.raw
  modified_base (344)..(344): a, c, t, g, unknown or other
  misc_feature (344)..(344): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacgagggtcctggacccagtctgccctgactcagtctgcctccgtgtcgtgggtctcctggactagtccggtcaccatctcctgcacgtaggaaccagcagtgtattggttaggtaaactttcctaactttgtccttaccgtacggtaaccaaactacttaccaaacccaaaactaaacgaccccctaaatctaatacctattttangtactacgaccaacgtaacgccggtaccctacggtacgggtttactaacgtcgtctttcgtacgtcgtcctactaacgtctacgaccaacgtacggtaccctaccgtagacctaactcgtcgtcggtcctacgacgtcgtacggaacggacgtacgggtctacgtaacttactaacgtcgtcgtccgtactagtacttagtcgacgttacggttacgttaaccttcttacgtttacgtcgtttaaccgtaccgggtaaaccggtacgggtaaaccgtaacggttcccgtaccgttaaccggtacgtaccggaaccgtaccccgaacccgtaacccctaacccgtccttaacgtccgttaaccccg

SEQ ID NO: 258527 - DNA, 540 bp, Homo sapiens
  misc_feature: GYAE6OF01BX5FH.19.78.H01.1.454.CMB.1.raw
  modified_base (420)..(420): a, c, t, g, unknown or other
  misc_feature (420)..(420): n is a, c, g, or t
tcagtactctcgtgcacgaccggtgctcgatttagtgtgagtagtttgggtttggggggggtcacaagaggcagcgctctcgggacgtctccaccatgtcctgggctctgctgctcctcactctcctcactcaggacacagggtcctgggcccagtctgccctgactcagtctgcctccgtgtctgggtctcctggacagtcggtcaccatctcctgcactggaaccagcagtgatggttggaaattctaaccttgtctcctggtaccaacatcaccaaataaacgcccccaaactcatcatttatgatgaccactaagccggccctgtaggggtttctaatcgtcttctctggctccagtctgcacacgcctcctgacatctcgtggctcaggctggagacgagctgattactacgtcnctgctcagtactgctaggtcgttattccttcttaatcggttcttaccgggaactcgggaacctacggtccaccggttccgtggaccacgacccgaggaccccaaccctctgtccctaccg

SEQ ID NO: 258528 - DNA, 233 bp, Homo sapiens
  misc_feature: GYAE6OF01C0T7A.19.78.H01.1.454.CMB.1.raw
  modified_base (221)..(221): a, c, t, g, unknown or other
  misc_feature (221)..(221): n is a, c, g, or t
  modified_base (227)..(233): a, c, t, g, unknown or other
  misc_feature (227)..(233): n is a, c, g, or t
tcagtactctcgtgcacgaccggtgctcgatttagtgtgagtagtttgggtttgggggctgaggacgaggctgattactactgctgctcatatgcaggtcgtatctcttatgtcttcggaactgggaccaaggtcaccgtcctaggtcagcccaaggcccaaccccactgtcactctgttcccgccctcctcacgagagtactgagcgggctggcaaggcncatagnnnnnnn

SEQ ID NO: 258529 - DNA, 703 bp, Homo sapiens
  misc_feature: GYAE6OF01E09E8.19.78.H01.1.454.CMB.1.raw
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaaccttgtctctgtaccaacatacaaccaaataaacgacccccaaactcatactatttatgatcgccaactaacgccggtccctcgtagggtttactaatcgtcttctctggcctacgaagtctacggacaaccgacggtccctccctagaactaacttctcgtcggcctaccgaggtcgtaggacggacgaggctacggtaactttaaccgtacgttcgtccttgtaccttaccgtaagttagtcgtaaccggtacgggtttacgttaactttccgtttacgtttagtttaccgtttaccggtttaaccgggtaaccggttaccggggaaacccgttaaacgggttaccccgtaacccggtttaacccggtacgggttaacccgtaacccggaacccccggtaaaacccggtaccccctaaacccccgtcgttacccgttcccgttaaccccgg

SEQ ID NO: 258530 - DNA, 246 bp, Homo sapiens
  misc_feature: GYAE6OF01CPZ41.19.78.H01.1.454.CMB.1.raw
  modified_base (237)..(246): a, c, t, g, unknown or other
  misc_feature (237)..(246): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcacgtcctaggtcagcccaaggccaacccatgtcactctcgttccccaccctcctcacgagagtactgaggcggctggcaaggcgacatagnnnnnnnnnn

SEQ ID NO: 258531 - DNA, 678 bp, Homo sapiens
  misc_feature: GYAE6OF01D6TRQ.19.78.H01.1.454.CMB.1.raw
  modified_base (228)..(228): a, c, t, g, unknown or other
  misc_feature (228)..(228): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacgagggtcctgggcccagtctgccctgactcagtctgcctcgtgtctggtctccgtggacagtcggtcaccatctcctgcactggaaccngcagtgatgttagaaattctaacttgtctctgtaccaacatacaaccaaataacgaccccaactctactctatttatgtatcgaccacgtaacgccggcccttacgtacgggtttactaagtccgtccttctcgtcggtcctaccgtagtcgtacggaccaaccgtacccgggtccctacccgtacggtaacctaacttccgtcggttcgggtacctaccgacgggtctaggggaacggtacgggacggttcgtagttactttaacgttacgtcgtccgttcggtacttacgtaattacgtacggtacgttaacggttacgttacttctttacgtttaacgtcggttaccgttacgggtaaccggtcgggtaaccgtacgggttccctaccggtacgtacggaccaccgacccgaaccggacccctaacccgtacgttccgtcttacccg

SEQ ID NO: 258532 - DNA, 700 bp, Homo sapiens
  misc_feature: GYAE6OF01DJLR3.19.78.H01.1.454.CMB.1.raw
  modified_base (420)..(420): a, c, t, g, unknown or other
  misc_feature (420)..(420): n is a, c, g, or t
  modified_base (433)..(433): a, c, t, g, unknown or other
  misc_feature (433)..(433): n is a, c, g, or t
  modified_base (522)..(522): a, c, t, g, unknown or other
  misc_feature (522)..(522): n is a, c, g, or t
  modified_base (684)..(684): a, c, t, g, unknown or other
  misc_feature (684)..(684): n is a, c, g, or t
tcagtactctcgtgcacgaccggtgctcgatttagtgtgagtagtttgggtttgggggggtcacaagaggcagcgctctcgggacgtctccaccatggcctgggctctgctgccctcctactctcctccactacagacgacacggtccgtcggtccgacgtcgtcgccgtcgtctacagtctcgtccgtccgtcgtcgtcggtcgtcctcgacgacgtcggtccgaccacctctcctcgcaccgtacggaaccgaacgcgtacgtgtagttagttagggtaaacttactttaaccttcgttcctacctacggtaccaaactaacctactaaacccaaaccgtaaaacgacccccaaacctactacttactaagtttatagcacaccgactaacgccgtccgtacttagggttacgttacncgttcctcgttcncgtccgataacgagtcggaacaaccgacggtcctcctagaacacttctcgcggcacgaggacgtgacggacgtacgatcgtaaacgttntacgagtccctgtaccctgaacttagtagtccgaggttaaccttgtttaccacgtttattccggtacggttaaccggacggttaacggaccctaaaggttacccgtccctacggttaacggcctaaaccggaccctaccggaaccccctaccgtacccgttnaccttccccgtacccg

SEQ ID NO: 258533 - DNA, 680 bp, Homo sapiens
  misc_feature: GYAE6OF01DHOCJ.19.78.H01.1.454.CMB.1.raw
  modified_base (205)..(205): a, c, t, g, unknown or other
  misc_feature (205)..(205): n is a, c, g, or t
  modified_base (223)..(223): a, c, t, g, unknown or other
  misc_feature (223)..(223): n is a, c, g, or t
tcagtactctcgtgcacgaccggtgctcgatttagtgtgagtagtttgggtttgggggggtcacaagaggcagcgctctcgggacgtctccaccatggcctggctctgctgctcctcactctcctcactcaggacacaggtcctgggcccagtctgccctgactcagtctgcctccgtgtctggtctcctggacagtcgtcaccntctcctgcactggaaccngcagtgatgttagaattctaacttgtctctcgtacaacataccaaccaaataaacgaccccctaaactcaactctatttatgactacgaccacgtaacgccggtcccgttacgtagggtttacctaagtccgtcttctcgtacggtcctacctaagttcgtacgaccaacgtaccggtaccctcccgtagtaactaacttccgtacgtacggcctacgacgtcgtaggacggacgaggtcgtacgtagtttacctacgtcgtcgttacgtaccgttacattacgtcgtacgtaacggttccgtttacttcgtttacgtttaagttccggttaccgttaccggtaacggtaccgggtaaacctaacgggttccctaacccggttacccgttacggtaccccacggaaaccccgacccgtaacccccgaaacccttaccgttcgtacccttaaccccgg

SEQ ID NO: 258534 - DNA, 587 bp, Homo sapiens
  misc_feature: GYAE6OF01B46IB.19.78.H01.1.454.CMB.1.raw
  modified_base (413)..(413): a, c, t, g, unknown or other
  misc_feature (413)..(413): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctcctggtaccaacatcaaccaaataaacgcccccaaactcatcatttatgatgaccactaagccggccctcgtagggtttctaatcgcttctctggctcaagtctgacacgacgcctcctagactaatctacgcggtcctccgaggctaggaggacgnggtctaggtacttactacgtgtcgtcgactcgaattagtcgtcgtagggtcttaactcgtttacttagttcgttaccgttacggaacgttccgggaacccgtaacggtcccgttacccgttcgtaacggtccaccggaacccaacggtacccccaacccgtctgcccgtacccg

SEQ ID NO: 258535 - DNA, 746 bp, Homo sapiens
  misc_feature: GYAE6OF01BSJHS.19.78.H01.1.454.CMB.1.raw
  modified_base (250)..(250): a, c, t, g, unknown or other
  misc_feature (250)..(250): n is a, c, g, or t
  modified_base (257)..(257): a, c, t, g, unknown or other
  misc_feature (257)..(257): n is a, c, g, or t
tcagtactctcgtgcacgaccggtgctcgatttagtgtgagtagtttggggttgggggggttcggacgaaagaggcagcgtcgtcctcgggacggtacctccaccgaatccggcctgggctcgtcgtccttgtccttcccttcaccttcctcctcgactccaggacaccacgggtcctggccctagttctacgccctgactcagtctcgcctccgtgtcgtgggtctccgtgggacagtcggtccacctntcctcgngcgactggaaccagcgagttcgacttggttacggtaaattcctaaccgttcgtaccttaaccgtcggtaaccaactacctaccaaccgaaactaaccgaccccaaactacctatacgtactttaactacgtactacgaccgtaactaacgccggtccctacgtacgggtttactaacgtcgtcttacgtcggcgcgtacgtacgtcgtcggacaacgtaccgtcctcccgtagacaactctacgtcggctccggacgtcgtacgacggtacgtagtccgtagtaacttacgttacgtgtactacggtcctacgtacgtacgtcggacgttacgttacgttcttaccgtttcggttaacttccgggttacttaccgggaaacgtccggggaaacgttaccggtaccgtaacccgggttacgtcggttccgaacccgggacccgtaacccggtacccctaaaccccgttgttacccgtaccgttaaccccg

SEQ ID NO: 258536 - DNA, 243 bp, Homo sapiens
  misc_feature: GYAE6OF01CJ9NR.19.78.H01.1.454.CMB.1.raw
  modified_base (238)..(243): a, c, t, g, unknown or other
  misc_feature (238)..(243): n is a, c, g, or t
tcagtactctcgtgcacgaccggtgctcgatttagtgtgagtagtttgggtttggtggtctccactcccgccttgacgaggctgattactactgctgctcatatgcaggtctatctcttatgtcttcggaactgggaccaaggtcaccgtctaggtcagcccaaggcccaaccccatgtcactctcgttccccaccctcctccacgagagtactgagcgggctggcaaggcgcatagnnnnnn

SEQ ID NO: 258537 - DNA, 746 bp, Homo sapiens
  misc_feature: GYAE6OF01AB22H.19.78.H01.1.454.CMB.1.raw
tcagtactctcgtgcacgaccggtgctcgatttagtgtgagtagtttgggtttgggggggtcacaagaggcagcgctctcgggacgtctccaccgatggcctgggctctgctgctcctcactctcctcactcaggacacagggtcctgggcccagtctgccctgactcagtctgcctccgtgtctgggtctccgtggacagtcgtcaccatctcctgcacgtggaaccagtcagtgattgttggaaactttctaaccttgtactcgtggtacctaacatccaccgaaataaacgccccaaatcatcatttatgaactgccactaacgcggaccctcgagggtttcaagttcgctttactcgtggacctaccgtaaacgtctcgggacctaaacgtaccgggtacccttaccccgtaggtaaccctaaaagttcccgtttacgtcggggtcccttaaccggaacggggtccgttcgggaaacgggtaaccggaacggggtccttaagggtaaccctttaaccgtaaaccgtttccggtaactccggttacttaacctacggttaactcggtaaccgtacgggtttaccgtacttaccggtttactttaactcggttaccgtttaacgggtaacccgtacgggtaaaacccgaaaccggttcctaaccggttacccggtaaacggttacccgaaccggacccccgaaacggtcccccaaaaaccccgttccgtacgttcctaaccccg

SEQ ID NO: 258538 - DNA, 242 bp, Homo sapiens
  misc_feature: GYAE6OF01DHCK4.19.78.H01.1.454.CMB.1.raw
  modified_base (236)..(242): a, c, t, g, unknown or other
  misc_feature (236)..(242): n is a, c, g, or t
tcagtactctcgtgcacgaccggtgctcgatttagtgtgagtagtttgggtttggtggtctccactcccgccttgacgaggctgattactactgctgctcatatgcaggtctatctcttatgtcttcggaactgggaccaaggtcaccgtctaggtcagcccaaggccaaccccatgtcactctgttcccacccttcctccacgagagtactgagcgggctggcaaggcgcatagnnnnnnn

SEQ ID NO: 258539 - DNA, 525 bp, Homo sapiens
  misc_feature: GYAE6OF01A0FP1.19.78.H01.1.454.CMB.1.raw
  modified_base (227)..(227): a, c, t, g, unknown or other
  misc_feature (227)..(227): n is a, c, g, or t
  modified_base (347)..(347): a, c, t, g, unknown or other
  misc_feature (347)..(347): n is a, c, g, or t
  modified_base (365)..(365): a, c, t, g, unknown or other
  misc_feature (365)..(365): n is a, c, g, or t
  modified_base (429)..(429): a, c, t, g, unknown or other
  misc_feature (429)..(429): n is a, c, g, or t
  modified_base (513)..(513): a, c, t, g, unknown or other
  misc_feature (513)..(513): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtgatgttagaaattctaaccttgtctcctggtaccaacatcacccaaataaacgccccccaaatcatcatttatgatgccactaagccggccctcgaggggtttctaatcgcttcnctgctcagtctggcaacncgcctcctgacatctctgggctccgaggtcctgacggacgaggctgactttacatgctgctacntatgctagtcgtattctcttatcgtcgttcgactcgggaacctaggtccacccgtctagtccacgaccccaaggccccaacccnctcgtctacccg

SEQ ID NO: 258540 - DNA, 693 bp, Homo sapiens
  misc_feature: GYAE6OF01CP7XU.19.78.H01.1.454.CMB.1.raw
  modified_base (262)..(262): a, c, t, g, unknown or other
  misc_feature (262)..(262): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctcgtgtctggtctcctggacagtcgtcaccatctcctgcactggaaccagcagtgatgtagaattctaacttgtctctgtaccaanatacaaccaaataaacgaccccaatcatactaatttatgactcgacctaacgtaaacgccggtaccccttcgtaacggggttttactaacgtccgtactttcctcgtcggtacctaccgtaacgtcgtacggaccaaccgtaccggtcccttccctagaacctaatccgtcgtcgggaccttccgaggtcgtaggaacggacgaggtctagtaactttactaccgtgtcgttacgtacttacaagttagtcgtacgttacgggttcttacttacctttacgttaacgtttcgttaccgttacgggtaaccggttaccggggaaacccgttaaacgggttcccgtaacccggtttaccggtacggtacccgaacccggtaaccccgtaaccgtaacccccaaccccgttacctacgttacccgttaaccccg

SEQ ID NO: 258541 - DNA, 644 bp, Homo sapiens
  misc_feature: GYAE6OF01EG9FZ.19.78.H01.1.454.CMB.1.raw
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctccgtggacagtcggtcaccatctcctgcactggaaccagcagtgatgttagaaattctaaccttgtctctggtaccaacataccaaccaaataaacgaccccaaactcatctatttatgtatcgaccactaacggccggtccctacgtagggtttactaagtccgtcttctctggcctacctaagtctggaccaaccgacggtccctccctcgaacctaattctacgtcgggtcctaccgaggtctaggacggacgacggtcgttagtactttaccgtacgtcgtctcgtctactattacgtgacgtacggttcgttacttcgtttctttagttcgttacgttacggtaacgtccgggtaaccgtaacgggttaccctaccggttacccgttacgggtaccgtaaccggtaccctaacgtacccgaccccctaacccgtaccgttcgtacccc

SEQ ID NO: 258542 - DNA, 737 bp, Homo sapiens
  misc_feature: GYAE6OF01BW42Z.19.78.H01.1.454.CMB.1.raw
  modified_base (192)..(192): a, c, t, g, unknown or other
  misc_feature (192)..(192): n is a, c, g, or t
  modified_base (196)..(196): a, c, t, g, unknown or other
  misc_feature (196)..(196): n is a, c, g, or t
  modified_base (204)..(204): a, c, t, g, unknown or other
  misc_feature (204)..(204): n is a, c, g, or t
  modified_base (220)..(220): a, c, t, g, unknown or other
  misc_feature (220)..(220): n is a, c, g, or t
  modified_base (299)..(299): a, c, t, g, unknown or other
  misc_feature (299)..(299): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacgagggtcctgggcccagtctgccctgactcagtctgcctcgtgtctggtctcngacngtcgcacntctctgcactgaaccngcagtgatgttagaacttctaccttgtctctgtaccaatactccaaccaaataaaccgccccaaactcactctatttangactcgaccaacgtacgccgcccttagtacgggttctaatcgtcttctcgtacgtctactaacgttcgtacgaccgaacgtaccggtccctccgtaagtactacttccgtcgtcggccttacgacggtcgttacgggaacggacggtacggtacgttacgtactttaccgtaccgttcgtccgtacgtaccttactaacgttacggttaccggtacgttaaccgggtttacgtttaaccgttcctttaacgtttacgttaccggtttaaccggttaaacccgggtaaaccggttaccggggtaaacccccgttaacggggttaccccaacccggttttacccgggttaaccggtaccccggtaaccccgtaaaccccgggtaaaccccgaacccccgttaaaccccgtctttaaaccccggtcccctttaacccccgg

SEQ ID NO: 258543 - DNA, 793 bp, Homo sapiens
  misc_feature: GYAE6OF01EQQC4.19.78.H01.1.454.CMB.1.raw
tcagtactctcgtgcacgaccggtgctcgatttagtgtgagtagtttgggtttggggggggtcacaagaggcagcgctctcgggacgtctccaccatggcctgggctctgctgctcctcactctcctcactcgaggacacgacgggtccgtcgggcccagtctcgccctgactcagtctcgtcctcgtgtcgtcggtctccgtgactagtcggtcaccatcctcctgcacgtacggaaccagctagtgtagttggttaggtaaacttaccttaaccgtttgttcccttccgttacggtaacccaaactactacccaaaccctaaaaactaaaccgacccccctaaaactaccacttactaattttactaggtactccgaccctaacgtaacggcccggtccccttacggttaacggggtttacctaacgtccgtcctttccgtcgtcggtacctaccgaagttccgtacggaccaaccgacccggtccctccgtacaactaactcttcggtcggcctaccggagcgtgggaacggacggacggcttagactttaccgtactcgcgttccgactacgtatacgtcggtaccgttagggttccttaacgttcctttacgtttaggtttaccgttcccgggttaacggtaaaccgggttaccgggaaacccggttaaacgggtcccccgtaacccgggtttccgttaaaccgggtacccgaacccgggtaaacccccggtaaacccggtaaccccccgaaaccccgttaccggttaccgttccccggttaaccccg

SEQ ID NO: 258544 - DNA, 731 bp, Homo sapiens
  misc_feature: GYAE6OF01CBUID.19.78.H01.1.454.CMB.1.raw
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctctgcactggaaccagcagtgatgtaggaaattctaaccttgtctcctggtaccaacatccaaccaaaataaacgacccccaaactccatctatttatgatcgaccaactaacgccggccctcgtaaggggtttctaactcgtcttctctggcctccgaacgttctcggaccaaaccgccggcccctaccctagactaacgttcctccgtacgggcccttaccgacgggtctacgggaggtaacggacggtccttaaggtactttaccgtaacgttcgtacgtcgtcttactaattacgtcggtacgtacgggtttacttacgtttccttacgtttaacgtttcggttacccggtttaccgggaaaccggttaccggggtaaacccgtaacggggttccccgtaaccccgggttacccggttaaccgggtacccgtaaacccgggtaccccccgtaaaaccggggtacccccccctaaaacccccggttacccgttccggtaccccgtttaacccccgg

SEQ ID NO: 258545 - DNA, 631 bp, Homo sapiens
  misc_feature: GYAE6OF01B2C8Z.19.78.H01.1.454.CMB.1.raw
  modified_base (226)..(226): a, c, t, g, unknown or other
  misc_feature (226)..(226): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcacatctctgcactggaaccngcagtgatgtagaattctaacttgtctctgtaccacataccaaccaaataacgacccctaaatcatctatttatgatcgaccaacgtaacggccggaccctcggtacgggtttactaacgtccgtcttcgtcgtcggtcctaccgtaagtcgtcggaccaaccgtacccggccctaccctagaacctaacttccgtcgtcgggcctccgagggtcgtaggacggtacgaggtctagtactttactacgtgtctacgctctatacgtcgtacgtacggttcgttacttcttacttacgttcgttacgttacgggtaaccgtacgggtaaccgtaacggtccgtaccgttacggtacgtaccgacggaccccgtaacggacccctaacccgtctccgtccgtacccg

SEQ ID NO: 258546 - DNA, 549 bp, Homo sapiens
  misc_feature: GYAE6OF01CD0I3.19.78.H01.1.454.CMB.1.raw
  modified_base (471)..(471): a, c, t, g, unknown or other
  misc_feature (471)..(471): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaattctaacttgtctctggtaccaacatcaaccaaataaacgccccaaactcatctatttatgatgaccactaagccgccctcgtagggtttctaatcgtcttctctcgtctccaagtcgtgacaacacgccctacccgtagaactaactctcgtgggtcctccgaggtctaggacgacggaggctacgtattacttactgactgactcatatgcacggttctatcttnttattcgtcttacggactcgggaaccaggtctaccgtacgtggacacgacccgaaccgacccaaccctctgtcctacc

SEQ ID NO: 258547 - DNA, 701 bp, Homo sapiens
  misc_feature: GYAE6OF01DIXHD.19.78.H01.1.454.CMB.1.raw
  modified_base (239)..(239): a, c, t, g, unknown or other
  misc_feature (239)..(239): n is a, c, g, or t
  modified_base (342)..(342): a, c, t, g, unknown or other
  misc_feature (342)..(342): n is a, c, g, or t
tcagtactctcgtgcacgaccggtgctcgatttagtgtgagtagtttgggtttggggggggtcacaagaggcacgcgctctcgggacgtctcccaccatggcctgggctctgctgctcctcacctctcctcactcaggacacgagggtcctgggcccagtctgccctgactcagtctgcctccgtgtctgggtctccgtggacagtccggtcaccatcctcctgctaccgtaggaaccngcagtgtagttgttaggtaaactttcctaaccttgtctccgtcggtaaccaactactaccaaccctaaaactaaaccgacccccaaactcattactaatttangactcgaccacgtaacgccggtaccctcgtagggtttactaagtctcttctcgtcgtcctacgacgtcgtacggacaccgacccggcccttcccgtacgtactaacgttccgtcggtcggtaccctacgaacggtcgaggacggtacgaggtctagttacttacttactcgtctgtctactagttacgtcgtacgttacggttcttactttccgttactttacgttccggtttacggtaccgggttaaccggtacgggtaccctaaccgggttccctacccgggttacgttaccgggtacccgaccgacccccggtaaccggtaaccccctaacccgtcgttccgttcccgttaacccg

SEQ ID NO: 258548 - DNA, 713 bp, Homo sapiens
  misc_feature: GYAE6OF01DQUKR.19.78.H01.1.454.CMB.1.raw
  modified_base (231)..(231): a, c, t, g, unknown or other
  misc_feature (231)..(231): n is a, c, g, or t
  modified_base (313)..(313): a, c, t, g, unknown or other
  misc_feature (313)..(313): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacgagggtcctgggcccagtctgccctgactcagtctgcctccgtgtctgggtctcctggacagtcggtcaccatctcctgccacgtggaaccngcagtgatgtagaaacttctaacttgtctcctgtaaccaacactacaaccaaataaaccgaccccaaatcatactaatttangatcgaccaactaacggcccgtacccttacggttaacggggtttactaaacgtccgtctttcctcgtacggtcctaccgaagttccgtacggaccaaccgtacccgtccctacccgtagaacctaacgtcctcggtcgggtaccctaccggaaggtcgtaagggacgggtaaccggtaaggtactacggttaacttaccgttaacgtcggtacctcggtactactaatacgtccgtacggtttacgtcgtttacttccttacgtttactacggtttaccggttaccggtaacggtaccgggtaacctaacgggttacccctaccggttacggtaaccggtaccgacccgtaaccccggaaccggtaaccccaacccccgtcgttccgttacccgtacccg

SEQ ID NO: 258549 - DNA, 678 bp, Homo sapiens
  misc_feature: GYAE6OF01DEDL6.19.78.H01.1.454.CMB.1.raw
  modified_base (322)..(322): a, c, t, g, unknown or other
  misc_feature (322)..(322): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctccgtggacagtcggtcaccatctcctgcactaggaaccagcagtgtatggtagtaaacttctaacttgtctccgtacggtaaccaacactaccaaacctaaataaaccgaccccaactcatactaatttangtactcgacctacgtaacggccgtccgtacgtacgggtttctaacgtctacttcgtcgtgtacctactagtcgtacggtaacaaccgtaacccggtccctaccgtacgtaacctactccgtcgtcggtcctaccggaggtcgtacgggacggtacggacggtactacgttacttaccgtacgtcgtacttcgtcctacgtatacgtcgtaccggtaggttaccgtcttaccgttcgtttaagtccgttacggttaccgggtaacgtaccgggtaccgtaacggtcccgtaccggttcggttacgaccgaaccgaccccgtaaccgaacccctaacccgtcgttcgtcccttacccg

SEQ ID NO: 258550 - DNA, 248 bp, Homo sapiens
  misc_feature: GYAE6OF01ALRGQ.19.78.H01.1.454.CMB.1.raw
  modified_base (238)..(248): a, c, t, g, unknown or other
  misc_feature (238)..(248): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaacccactgtcactctgttcccgccctcctccacgagagtactgagccgggctggcaaggcgcatagnnnnnnnnnnn

SEQ ID NO: 258551 - DNA, 579 bp, Homo sapiens
  misc_feature: GYAE6OF01DMGHL.19.78.H01.1.454.CMB.1.raw
  modified_base (216)..(216): a, c, t, g, unknown or other
  misc_feature (216)..(216): n is a, c, g, or t
  modified_base (226)..(227): a, c, t, g, unknown or other
  misc_feature (226)..(227): n is a, c, g, or t
  modified_base (232)..(232): a, c, t, g, unknown or other
  misc_feature (232)..(232): n is a, c, g, or t
  modified_base (430)..(430): a, c, t, g, unknown or other
  misc_feature (430)..(430): n is a, c, g, or t
  modified_base (456)..(456): a, c, t, g, unknown or other
  misc_feature (456)..(456): n is a, c, g, or t
  modified_base (465)..(465): a, c, t, g, unknown or other
  misc_feature (465)..(465): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcgaggacaacgagggtcctgggccctagtcctgccctgactcagtctgcctccgtgtctggtctccgtgacagtcgtcacatctcngcactgaacnncagtnagtgtagaattctaacttgtctctgtaacacatcaaccaaataaacgacccaaactcatcattatgatcgaccactaagcgcccttcgtagggtttctaactcgtacttctcttaggctacgtaagtcgtggaactaacgacgtccctacctagaactaatcgtcgtcggcctccgaggtctagggaggcgaacggtntcgtaattactactgctagctcaatnagacaggtntacttcttcttaagttctcgttaaccggtacgacggtaaccgagtaccgaccgttaccgtacgggtacctacgaacccgtaaccgaaccccgaaccctcgtccgttctaacccg

SEQ ID NO: 258552 - DNA, 619 bp, Homo sapiens
  misc_feature: GYAE6OF01DJQOE.19.78.H01.1.454.CMB.1.raw
  modified_base (227)..(227): a, c, t, g, unknown or other
  misc_feature (227)..(227): n is a, c, g, or t
  modified_base (299)..(299): a, c, t, g, unknown or other
  misc_feature (299)..(299): n is a, c, g, or t
  modified_base (345)..(345): a, c, t, g, unknown or other
  misc_feature (345)..(345): n is a, c, g, or t
  modified_base (361)..(361): a, c, t, g, unknown or other
  misc_feature (361)..(361): n is a, c, g, or t
  modified_base (369)..(369): a, c, t, g, unknown or other
  misc_feature (369)..(369): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacgagggtcctgggcccagtctgccctgactcagtctgcctccgtgtctggtctccgtggacagtcgtcaccatctctgcactcggaaccngcagtgattgtagaattctaacttgtctctgtaccacatacaaccaaataaccacccaaactcatctattangatcgcctactaagccgtccctagtacgggtttcaatcgtcttctntgctcagtctgacacncgcctcanacactctcgtcggctccgaggctaggacgacgagtctagttacttactaccgtcgtctcgtacctactaattagtcggaccgttacgggttccttaactttcgttacttttaggttccggttacgttaccgggtaaacgttccgggtaaacccggttaacggtccccgttaaacgttccccggtaaaggtaccccgaacggtacccccgaacggaccccctaaaccccggtactccgttaccccgtaccg

SEQ ID NO: 258553 - DNA, 276 bp, Homo sapiens
  misc_feature: GYAE6OF01BTT7S.19.78.H01.1.454.CMB.1.raw
  modified_base (239)..(276): a, c, t, g, unknown or other
  misc_feature (239)..(276): n is a, c, g, or t
tcagtactctcgtgcacgaccggtgctcgatttagtgtgagtagtttgggtttgggtggtcgtccactcccgccttgacgaggctgattactactgctgctcatatgcaggtcgtatctcttatgtcttcggaactgggaccaaggtcaccgtctaggtcagcccaaggcccaaccccatgtccactctgttccccacctcctcgagagagtactgagcgggctggcaaggcgcatagnnnnnnnnnnnnnnnnnnnnnnnnnnnnnnnnnnnnnn

SEQ ID NO: 258554 - DNA, 690 bp, Homo sapiens
  misc_feature: GYAE6OF01DKGFX.19.78.H01.1.454.CMB.1.raw
  modified_base (231)..(231): a, c, t, g, unknown or other
  misc_feature (231)..(231): n is a, c, g, or t
  modified_base (273)..(273): a, c, t, g, unknown or other
  misc_feature (273)..(273): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacgagggtcctgggcccagtctgccctgactcagtctgcctcgtgtctggtctccgtggactgtcgtcacctatcctcctagcacgtcggaaccngtcagtgattggtagaaattctaacttgtctctggtaccaanactcaaccaaataacgaccccaaactcatctattatgatcgaccacgtaacgccgtcctacgtagggtttactaacgtcgtcttcctcgtcgacctaccgtaagttcgacggacctaacgaacccggtccctacctacgtaactaactcgtacgtcggccttacgacggtcgtacggacggtaacgaggtactaggtaacttacgtacgtacggtcctcggtacttaccagttaacgtcgtaacggtacggttcgttaacttccgtttacttacgttacggttaccggttaacggtaaccggtaccggttaaacccgtaaacggttccccgaacccggttaccgtacgggtacccgaacggtaaccccgaaccgtaacccccgtaaccccgtaccgttccgtacccgttaaccccgg

SEQ ID NO: 258555 - DNA, 604 bp, Homo sapiens
  misc_feature: GYAE6OF01BJ92U.19.78.H01.1.454.CMB.1.raw
  modified_base (303)..(303): a, c, t, g, unknown or other
  misc_feature (303)..(303): n is a, c, g, or t
  modified_base (364)..(364): a, c, t, g, unknown or other
  misc_feature (364)..(364): n is a, c, g, or t
  modified_base (376)..(376): a, c, t, g, unknown or other
  misc_feature (376)..(376): n is a, c, g, or t
  modified_base (396)..(396): a, c, t, g, unknown or other
  misc_feature (396)..(396): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctctgcactggaaccagcagtgatgttggaaattctaacttgtctcctggtaccaacataccaccaaataacgcccccaactcatctatttangatgaccactaagccggccctcgacgggtccctgactcgcttctcgtgctcagtctgcacncgcctcctaacntctctggctcgagcgtgagntggagtctagtatttatacgtgtcctgtccttacgattacgtggtaccgagggtacgtaggttaccttacgttttaggtaccggtttcggggacgggtaaccggggtaaccctaagggtccgttacggtaccccggttccggttaacgggtacccaaccggtaccccgtaacgggtcccttaccccggtcccccgttaccgggtaccc

SEQ ID NO: 258556 - DNA, 657 bp, Homo sapiens
  misc_feature: GYAE6OF01DLOD1.19.78.H01.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (272)..(272): a, c, t, g, unknown or other
  misc_feature (272)..(272): n is a, c, g, or t
  modified_base (324)..(324): a, c, t, g, unknown or other
  misc_feature (324)..(324): n is a, c, g, or t
  modified_base (518)..(518): a, c, t, g, unknown or other
  misc_feature (518)..(518): n is a, c, g, or t
  modified_base (643)..(643): a, c, t, g, unknown or other
  misc_feature (643)..(643): n is a, c, g, or t
tcagtactctcgtgcacgaccggtgctcgatttagtgtgagtagtttgggtttggggggggtcacaagaggcagcgctctccgggacgtctccaccatggcctgggctctgctgctcctcactctcctcactcaggacacagggtcctgggcccagtctgccctgactcagtctgcctcgtgtcgtggtctctggacngtcgtcacntctctgcactggaaccagcagtgatgttaggaaacttctaaccttgtctaccgtggtaaccaacnctaccaaaccaaaataaaccgaccccctaaaactctaacttctaacttttanagtacttcgccctaacgtaacggccggtaccctcggtaagggtttctaacgtcgtcttctcgtcggtcctacgaacgttctcggacaaaccgtccgcccttaccctagaacctaacgttcgtcgtacgggtcctacccgaggtccgtaggacggacggacgtctagtaacttacgtactggtactcggccttanagttagtcgacggtacggtcgttaattccttatttcgtggttccgttaacgggaacgtcgggaaacctacgggtacctacccggttcgtaccggtaccgaccgacccgtaacgaccccaaccctntccgtactaccccg

SEQ ID NO: 258557 - DNA, 707 bp, Homo sapiens
  misc_feature: GYAE6OF01BA6C9.19.78.H01.1.454.CMB.1.raw
  modified_base (193)..(193): a, c, t, g, unknown or other
  misc_feature (193)..(193): n is a, c, g, or t
  modified_base (197)..(197): a, c, t, g, unknown or other
  misc_feature (197)..(197): n is a, c, g, or t
  modified_base (224)..(224): a, c, t, g, unknown or other
  misc_feature (224)..(224): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacgagggtcctgggcccagtctgccctgactcagtctgcctcgtgtctggtctcgngacngtcgtcacatctctgcactcggaaccngcagtgattgttagtaaacttcttaaccttgtcctccgttacggtaacccaatacttaccaaaccctaaaactaaaccgacccccctaaactctactactaatttatagacttcgacctaacgtacggccgtccctaggttaacgggtttactaactccgtaccttcgtcgtcggtacctaccgtagtcgtacggaaccaaccgtcccggtccctacccgtataacctaacttccgtcgtcggtcctaccgtacggtcgtaggaacggacggtacggtcttagtactttaacgtcgtacgtcctcgtacttacaagttgtaccgtacggtacgttacctttacgttcctttacgttacggttccgttaccgttaaacggtaccggtaccggtaaccgtaacggttaccctacccgggttacggtacgacccgtaccgaccccgtaaccgtacccctaacccgtcgttccgtccgttaaccccg

SEQ ID NO: 258558 - DNA, 645 bp, Homo sapiens
  misc_feature: GYAE6OF01DO71V.19.78.H01.1.454.CMB.1.raw
  modified_base (223)..(223): a, c, t, g, unknown or other
  misc_feature (223)..(223): n is a, c, g, or t
  modified_base (294)..(294): a, c, t, g, unknown or other
  misc_feature (294)..(294): n is a, c, g, or t
  modified_base (441)..(441): a, c, t, g, unknown or other
  misc_feature (441)..(441): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacaggtcctgggcccagtctgccctgactcagtctgcctcgtgtctggtctcgtggacagtcgtcaccatctctgcacgtcggacngcagtgattgtagaattctacttgtctcctgtaacacataccaaccaaataacaccccaatcatctattangatgaccactaagccgtcctagtacggtttacaatccgtacttctcgtcgacctaccaacgttctacggacaaaccgcggtaccctcccgtagaaccttaatccgttacgtcgggtacctaccggaggtcgttaggaacggtaccgnggtactggttaacttaacgtcctgtccgtactctaacctagttacgtcgaacgttcggttacttaccgttctttaactttagttccgtaccgttacggtaacggtaccgggtaacctaacgggtcctacccgttacggtacggtacccgtaaccggacccctaaaccggaccccctaaaccccgtcgttgtacccgtttacccg

SEQ ID NO: 258559 - DNA, 250 bp, Homo sapiens
  misc_feature: GYAE6OF01DNUS6.19.78.H01.1.454.CMB.1.raw
  modified_base (213)..(213): a, c, t, g, unknown or other
  misc_feature (213)..(213): n is a, c, g, or t
  modified_base (231)..(231): a, c, t, g, unknown or other
  misc_feature (231)..(231): n is a, c, g, or t
  modified_base (237)..(250): a, c, t, g, unknown or other
  misc_feature (237)..(250): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtctaggtcagcccaaggccaacccatgtcactctcgttccccaccctcctccacgagagtacngagcgggctggcaaggcncatagnnnnnnnnnnnnnn

SEQ ID NO: 258560 - DNA, 639 bp, Homo sapiens
  misc_feature: GYAE6OF01DOV34.19.78.H01.1.454.CMB.1.raw
  modified_base (189)..(189): a, c, t, g, unknown or other
  misc_feature (189)..(189): n is a, c, g, or t
  modified_base (227)..(227): a, c, t, g, unknown or other
  misc_feature (227)..(227): n is a, c, g, or t
  modified_base (299)..(299): a, c, t, g, unknown or other
  misc_feature (299)..(299): n is a, c, g, or t
tcagtactctcgtgcacgaccggtgctcgatttagtgtgagtagtttgggtttgggggggtcacaagaggcagcgctctcgggacgtctccaccatggcctgggctctgcctcctcctcagcctcctcactcagggcacaggatcctgggctcagtctgccctgactcagcctcactcagtgtccggtntcctggacagtcagtcaccatctcctgcactggaaccngcagtgatgttggtagttataactatgtctcgtagtacaacacaccagcaacgcccaagtcatagtattagngacgtgtacagtgacgccgacctgtacgggtcctagactcgtccttctcctaggtcctaccgtaagtccgtagaaccaaaccgtaccggtaccccttaacccaaacctacgtccgttaacgtcgggtaccctacccgtagggtacctaaggacggtagtcggtaacggtcctaggttaaccttttaattactggtcttacgtcttaacatagcggtacacggtagtaacggtaacttcggttacggttaggttacccgggacgggtaaccgggtaacccaaggccgtaaccgtaacccggtcgttaaacggccgtaaacggtcccgtaacgggtaccccg

SEQ ID NO: 258561 - DNA, 593 bp, Homo sapiens
  misc_feature: GYAE6OF01BM6LP.19.78.H01.1.454.CMB.1.raw
  modified_base (229)..(229): a, c, t, g, unknown or other
  misc_feature (229)..(229): n is a, c, g, or t
  modified_base (395)..(395): a, c, t, g, unknown or other
  misc_feature (395)..(395): n is a, c, g, or t
  modified_base (420)..(420): a, c, t, g, unknown or other
  misc_feature (420)..(420): n is a, c, g, or t
  modified_base (433)..(433): a, c, t, g, unknown or other
  misc_feature (433)..(433): n is a, c, g, or t
  modified_base (452)..(452): a, c, t, g, unknown or other
  misc_feature (452)..(452): n is a, c, g, or t
  modified_base (459)..(459): a, c, t, g, unknown or other
  misc_feature (459)..(459): n is a, c, g, or t
  modified_base (463)..(463): a, c, t, g, unknown or other
  misc_feature (463)..(463): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtgatgttgaaattctaacttgtctctacggtaccaactactaccaaccctaaaataaaaccgacccccaaaactcaatactaatttatagactcgaccaacgtaacgccggtaccctacgtacgggtttactaagtcgcttctctgctcaacgtctgacacncgcctccagacatctcgtggctcgngctaggacgacgngtctagacttactactcgntcgctanatancgactaggttacttacttcttacgtttagttacgtttacggacgttcggtaaaccgtaacgtccgtacccggtacgtacgggccaaccggtacccgaacgtaccccaacccgtgtactaccctcgttccg

SEQ ID NO: 258562 - DNA, 244 bp, Homo sapiens
  misc_feature: GYAE6OF01DF1HK.19.78.H01.1.454.CMB.1.raw
  modified_base (176)..(176): a, c, t, g, unknown or other
  misc_feature (176)..(176): n is a, c, g, or t
  modified_base (242)..(244): a, c, t, g, unknown or other
  misc_feature (242)..(244): n is a, c, g, or t
tcagtactctcgtgcacgaccggtgctcgatttagtgtgagtagtttgggtttggtggtctccactcccgccttgacgaggctgattactactgctgctcatatgcaggtctatctcttatgtcttggaactgggaccaaggtcaccgtctaggtcagcccaaggcccaaaccccntgtcactcctcgttccccgccctcctccacgagagtactggagcgggctggacgaaggcgcagtgnnn

SEQ ID NO: 258563 - DNA, 827 bp, Homo sapiens
  misc_feature: GYAE6OF01C8CXK.19.78.H01.1.454.CMB.1.raw
  modified_base (227)..(227): a, c, t, g, unknown or other
  misc_feature (227)..(227): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctcgccctgactcagtctgcctccgtgtctggtctcctggacagtcgtcaccatctctgcacgtggaaccngcagtgattgttaggtaaactttccgttaaccttgtcctccgttacggtaaccaactacttaccaaaccctaaaacttaaaaccgaccccccctaaaacttacctaactttacctaatttttaacgtacggtaacttacggtaccctaacgttaaaccggcccggtacccctttacggtaacggggttttacctaaacgttccgttaccgtttcttcgttacggtccttacccgtaacgttaccgtacggacccgaaaccggtaacccggtcccttaccccgttaacggaaaccttaaacgttccgttcgttccggggtcccttacccggacgggtccgttaacgggaacgggtaaccggtaggtaccgttacgtaacctttaaccgttaacgtcggtactcggtaccttacgaacttacgtacggtacgttacgggtttacttacttcctttacgtttacgtttcgttaccggtttaaccggaacggttaccgggtaaacccgtaacggttacccgtacccggttcccggttcgggtaccctaacccggaccccgtaaaccggtacccccaaaccccgttcgtaccgtcccttaacccg

SEQ ID NO: 258564 - DNA, 897 bp, Homo sapiens
  misc_feature: GYAE6OF01A74TJ.19.78.H01.1.454.CMB.1.raw
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcgtcaccatctcctgcactggaaccagcagtgattgttgaaattctaacttgtctcctgtaccaacataccaaccaaactaaacgaccccctaaactcatacatttatgatcgaccactaacggccggtccctacgtagggtttactaacgttccgtctttcctcgtcggtcctaccgtaagtcgtacggtaccaaccgtaccggtccctcccgtacgaacctaacttcctacggttcgggaccttccggaacggtcgttacgggaacgggtaaccggtacgggtaccgttaggttaaccgtttaacccgttaaccggttcgtacccgttacggtaccctttaacccgttaaagtttaacggttacccgggtaaccggttaaccgggttttacccgttttaaaccgttttacccgtttttaaccggtttttaacggtttaccgggtttttaccccggttttaaacccggggggttaaaacccgggttaacccggggggttaaaaacccccgtttaaaccggggggtttaaccccccgttaaacccccggggttttaacccccgggtttaaaccgggtttaacccccggtaaacccccgggtaaacccccccggttaaaaccccgggggtaaccccccccgttaaaacccccccggttaccgtttaaccccgggttaacccccgtttaaccccccggg

SEQ ID NO: 258565 - DNA, 245 bp, Homo sapiens
  misc_feature: GYAE6OF01AU85F.19.78.H01.1.454.CMB.1.raw
  modified_base (239)..(245): a, c, t, g, unknown or other
  misc_feature (239)..(245): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggcccaaccccatgtcactctgttccccaccctcctccacgagagtactgagcgggctggcaaggcgcatagnnnnnnn

SEQ ID NO: 258566 - DNA, 668 bp, Homo sapiens
  misc_feature: GYAE6OF01CGZAI.19.78.H01.1.454.CMB.1.raw
tcagtactctcgtgcacgaccggtgctcgatttagtgtgagtagtttggggtttggggggggtcacaagaggcagcgctctcgggacgtctccaccatggcctgggctctgctgctcctcactctcctcactcaggacacgagggtcctgggcccagtctgccctgactcagtctgcctcgtgtctggtctctggacagtcggtcaccatcctcctgcactacggaaccagcagtgattgttaggtaacttctaacttgtctcctacgtaccaacactaccaaccaaaataaccgacccctaaactctatactaatttatagactcgaccctaacgtaacggccggtaccccgttagttaacggggtttactaacgtccgtactttcctcgtcgtactaccgaagttcgtcggaccaaccgtaccggccctaccgtacgtaactacgttccgttacggtcggtccgtccggacggtcgtacggaacgggtacgacggtcttacgtaactttacctacgtcgtcgttaccgtctaccgtattacgtcgtacgttacggttaccttacttctttacttagttcgttacgtacggtacgtacggtacacggtccgacgttaccgtcggtaccacgtacccgaaccggaccctacctacgttcgtctacccg

SEQ ID NO: 258567 - DNA, 810 bp, Homo sapiens
  misc_feature: GYAE6OF01BDZ93.19.78.H01.1.454.CMB.1.raw
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctctggacagtcggtcaccatctctgcacgtggaaccagcgagtgattggttaggtaaacttccttaaccttcgttccttccgtacggtaaccaaactactaccaaacccaaaactaaaccgaccccaaactcacttactatttatgatcgaccacgtaacggccggccgttacggtacgggtttactaactcgtcttctcgtacgtctacgtaacgtctacggaccaaccgtcccgtccctaccgtacgtaactaactccgttcggtcggtccctaccggaggtaccggtacgggtacgggaacggtacggtacttaaggttacctttaaccgtacgttcgtaccgttgtaccttaacgtaacgttacggtcggaaccggttaacgggtttacccgtttacgtttcccgtttacttttaccggttacggtttacccggtttaacccggggtaaacccgggttaaccgggggtaaacccggtttaaaacccggttcccggttaaaccccgggtttcccgggttaaaccgggtaccccgtaaacccgggggaaccccccgtaaaacccgggtacccccctaaaccccggttacccgttacccgttcccggtttaacccccg

SEQ ID NO: 258568 - DNA, 242 bp, Homo sapiens; identical to SEQ ID NO: 258416
  misc_feature: GYAE6OF01A16SF.19.78.H01.1.454.CMB.1.raw
  modified_base (238)..(242): a, c, t, g, unknown or other
  misc_feature (238)..(242): n is a, c, g, or t

SEQ ID NO: 258569 - DNA, 649 bp, Homo sapiens
  misc_feature: GYAE6OF01ECB9K.19.78.H01.1.454.CMB.1.raw
  modified_base (227)..(227): a, c, t, g, unknown or other
  misc_feature (227)..(227): n is a, c, g, or t
  modified_base (255)..(255): a, c, t, g, unknown or other
  misc_feature (255)..(255): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctcgtgtctggtctcctggacagtcgtcaccatctctgcactgaccagcagtnatgtagaattctactgtctctgtaccanatcaccaaataacgaccccaactcatctatttatgatcgaccactaacgccggtccctacgtagggtttctaagtcgtcttctcgtcgctaccagtctcggaccaaccacggccctaccgtgaacctaatccgtcgtcgggtcctccgaggctacggaacggacggtacggtactacggtaactttaaccgtaccgtgtccgtcgtcttacgtaattacgtcgaccgtagggttacgttactttcgttacctttagttcggttaccgttacggtaacccggtacgggtaacccgtaacggttcccgtaacccggttaccggttaaccggtaccgaaccccggaaccccgtaaccgtacccccgaacccccgtacttcccggtacccttaccccg

SEQ ID NO: 258570 - DNA, 776 bp, Homo sapiens
  misc_feature: GYAE6OF01AVKQF.19.78.H01.1.454.CMB.1.raw
  modified_base (229)..(229): a, c, t, g, unknown or other
  misc_feature (229)..(229): n is a, c, g, or t
  modified_base (264)..(264): a, c, t, g, unknown or other
  misc_feature (264)..(264): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctccgtggactgtccggtcaccatctctgcactggaaccngcagtgatgttagaattctactgtctctgtacacntacaccaaataacgccccaaactcactctatttatagatcgacctactaacggccgtacccctcgtagggtttacctaacgttcgtccttacctcgtcggtcctacccgtagtactcggaccaaccgacccggtacccctacccgtacgaactacttctaccgtcgggtcctaccgacggtccggtagacggacggtaggacgttagtaacgtttactaacgtgtccgtacgtactacgtaagttaacgtggaccggttaacggttccgttaaccgtttacgttttaccgtttacggttaccggttttaacccgggttaaccgggttaaaaccgggttaccggggtaaacccggttaaaccgggtttaaccccggtaacccccgggtttacccgggttaaaccgggttaacccccgtaaacccgggtaaaccccccggtaaaaccccgggtaacccccccgaaaaccccccggtttacccgttaccggttaacccccgtttaaccccccggg

SEQ ID NO: 258571 - DNA, 766 bp, Homo sapiens
  misc_feature: GYAE6OF01AQRV3.19.78.H01.1.454.CMB.1.raw
  modified_base (263)..(263): a, c, t, g, unknown or other
  misc_feature (263)..(263): n is a, c, g, or t
tcagtactctcgtgcacgaccggtgctcgatttagtgtgagtagtttgggttggggggggtcacaagaggcagcggctcctcgggaccgtcgtccttaccagtggtcctgggtcttctgctggctcctacactctcctacactcaggacgacgtaggggtcctgggcccagttcgtcgttccctgacgtctaagttacgtgcctcgtgtctgggtctctaggctggtcggtcaccagtccggtcctgtctacgtggaacccgngggtcctaggtgtacttcggttacggtaaacttccgtaaccttggtccttccgttagggtaaccctaactacttaccgaaccctaaaattaaaccgccccctaaaactcaactctacgtttagtccggactcggtaccctaacgtaaacggccggtccccggttacggtaacgggggttttctaaacggttccgtaccgtttacgtacgttacggtacgtaccgtaaggttaccgtacggactaaaccgtaccgggtaccctacccgtacgtaacctaacgtaccgtcgttcgggtacctaccgtacggtctacggaagggacgtacggtacttacggaacttaaccacgtcgtactaccgtctacaacgttagtcgaacgtacggtcgttattccgtacttacgtcgttaccgtaccggtacgtacgtaaccgtacggtacctaaccggtactacgaccgtacgaccgtaaccggcccaacccgacgtcgtaccgtaacccg

SEQ ID NO: 258572 - DNA, 711 bp, Homo sapiens
  misc_feature: GYAE6OF01ES9OS.19.78.H01.1.454.CMB.1.raw
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgagttgttaggaaatttcctaaccttgtcctccgtaggtaacccaacactaccaaccctaaaactaaaaccgaccccctaaactactactacctaatttatacgactcgacccaacgtaacgccggtcccttacggtacgggtttactaagtccgtcttctcgtcgctacctaagtctacggaccaaccgaccggtccctccctagaacctaacgttccgtacgtcgggcccttaccgacggtcgacgggaacgggacgtacggtcgtagttaacctttaacttaccgtcgtacgtcggacccttacgtaacttacgttcggaaccggttacgggttacttagttcctttacgtttacgtcgtttaccggtacggtaacggtaccgggaaaccttacggtacccgttaccggttaccgtacggtaccgaacccgacccggtaaccgtacccccaacccgtacgtccgttacctacccg

SEQ ID NO: 258573 - DNA, 1018 bp, Homo sapiens
  misc_feature: GYAE6OF01A4M02.19.78.H01.1.454.CMB.1.raw
tcagtactctcgtgcacgaccggtgctcgatttagtgtgagtagtttggggttgggggggtcgacgaagaggcagcgtcgtcctcgggacggtacctccaccgaatccggcctgggcctctcgtccttgtccttccctcaccttcctcctcgacctccaggacaccacgggtcctgggccctagttctcgccctgactccagtctgtcctcgtgtctggtctccgtgggacagtcggtccacctactcctccgtcgcgacctacggaaccaggctaggttcgacgttgttacggtaaactttcctaaccgttcgtacctaacccgtggtaacccaaactaccttacccaaccgtaaactaaaccgtaccccctaaacttccaacttcgtaactttactacgtaacctaccggacccgtaaccgtaaccgggtcccggtaccccgtacggttaaccggggtttacctaacgttccggttaccttcggtcgtacggtacctccgtaacgttcgtacggaccaaccgtacccggtccctacccgtacgtaaccgttaactccgttacgtacggggtaccctacccgggtacgggtaccccgttaacggggaacgggtaacccgggttacgggtttaccgttaacggttaacgtttttaacccgttaaccgtttcgggttaccctttacgggtaccctttaacggttaacgggtttaccggttaccgggttaccccgggtttaaccggggtttaacccttttaaccgtttaccccggttttaacccggttttaaccgggttaacccggggttttaacccggtttaacccgggggttaaacccgggttaacccgggggtaaaacccggttaaacccgggggttaccccgttaaacccccggggttttacccgttaaacccggggtaccccggttaaaccccgggaaccccccggttaaacccgggtaaacccccccttaaaccccccgtttacgttaccgggtttacccccttaaacccccgg

SEQ ID NO: 258574 - DNA, 551 bp, Homo sapiens
  misc_feature: GYAE6OF01EFB2Z.19.78.H01.1.454.CMB.1.raw
  modified_base (343)..(343): a, c, t, g, unknown or other
  misc_feature (343)..(343): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatggttagaaattctaaccttgtctcctggtaccaacatcaaccaaataacgcccccaaatcatcatttatgatcgccactaagcggccctcgtagggtttctaagtcncttctctgctcagtctgcacacgcctcctgacatctcgtggctcagtcgtgaggacgaggctgtattactactcgactgctacatatgcgtaggtcgtattcttcgttatcgttacgttcgtacgtacgggtaccgtaacggtcctaccgttaccgtacggtaccgacgacccgaacgaccccaactaccccccccctgtcctacccg

SEQ ID NO: 258575 - DNA, 834 bp, Homo sapiens
  misc_feature: GYAE6OF01BLA0W.19.78.H01.1.454.CMB.1.raw
  modified_base (309)..(309): a, c, t, g, unknown or other
  misc_feature (309)..(309): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctcgtgtctgggtctctggacagtcggtcaccatctcctgcactgggaccagcagtgatggttaggaaattctaaccttgtctccgtgtaccaacatacaacccaaataacgacccccaaactcatctatttacngtactcgacctacgtaacggccggtccccttacgtacggggttttacctaaacgttccgtcctttaccgttccgtcgggtcccttacccgtaaacggttccgttacgggaccctaaacccggtacccgggtaccccttacccccgttaggtaaaccctaaaccgtttcccgtttccgggttaccggggtacccctttaccccggaacggggtcccggtttaacggggaaccggggtaaccgggtaacgggtaccgttaacggttaaaccgttttaacccgttaaccgtcggtacccgtttcggtacccttacgtaaacgttgttaccggtaccggttacgggtttccggttaactttccgtttactttacggttacgtttaccggttaaccgggtaaccggttcggggtaaacccgttaacgggttcccgttaacccggttaccggttaccggtacccgtaacccggacccccggtaaaccggacccccctaaaccccttacgttccgttacccgttaaaccccg

SEQ ID NO: 258576 - DNA, 281 bp, Homo sapiens
  misc_feature: GYAE6OF01CPBUE.19.78.H01.1.454.CMB.1.raw
  modified_base (117)..(117): a, c, t, g, unknown or other
  misc_feature (117)..(117): n is a, c, g, or t
  modified_base (172)..(172): a, c, t, g, unknown or other
  misc_feature (172)..(172): n is a, c, g, or t
  modified_base (239)..(240): a, c, t, g, unknown or other
  misc_feature (239)..(240): n is a, c, g, or t
  modified_base (242)..(281): a, c, t, g, unknown or other
  misc_feature (242)..(281): n is a, c, g, or t
tcagtactctcgtgcacgaccggtgctcgatttagtgtgagtagtttgggtttggtggtctccactcccgccttgacgaggctgattactactgctgctcatatgcaggtctatctntatgtcttggaactgggaccaaggtcaccgtctagtcagcccaaggccaaccccntgtcactctgttccccgccttcgtaccagagagtactgacggcgggtctggacaacggctcagtagnncnnnnnnnnnnnnnnnnnnnnnnnnnnnnnnnnnnnnnnnn

SEQ ID NO: 258577 - DNA, 801 bp, Homo sapiens
  misc_feature: GYAE6OF01AT6JC.19.78.H01.1.454.CMB.1.raw
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcggtcacctatctcctgcacgtcggaaccagcaggtgtagttgttacggtaaacttccttaaccgttcgtcctccgtacgggttaacccaacctattacccaaaccctaaaactaaaccgacccccctaaaacctcctaacttacctaatttactacggtactacggaccctaaccgttaacggcccggtaccccgttacggtaacggggttttactaactccgtaccttccgtacgtcgtcctaccgtacgtcgtcggacctaaccgacccgtccctaccgtacgacgtaacttcgtcggtcggaccctacggacggtccgtagggtacggaccggtacggtacgttaggttaaccttaaccgttacgtacgtcgtcgtacgttacgacttaacgtccggtacggtacggtttaccggttaacttccgtttacgttttacgtaccgttccggtttaaccgggtaaccggttccggggtaaacccttaaccggggttcccgtaaccccggttacggtacccggtaacccggtaaccccgtaaccccggtaaccccggtaaccccctaacccgtttacggtacccgttccttaacccccggg

SEQ ID NO: 258578 - DNA, 758 bp, Homo sapiens
  misc_feature: GYAE6OF01C3J7B.19.78.H01.1.454.CMB.1.raw
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacgagggtcctgggcccagtctgccctgacctcagtctgccctccgtgtctgggtctccgtggacaggtcgtcaccatcctcctgcacgtcggaaccagctagtgagttgttaacggtaactttcctaacctttcgtcctaccgttacggtaaccaactactaaccaaaccctaaaactaaacccgaaccccctaaactcctaacttacttaactttaagtacgtacgtacgaccctaaccggtaacggtcccggtacccgttacgggttaacgggtttactaaccgttccgttactttaccgtcgttcggtaccttaaccgtaacgttcgtacggtaccaacccgtacccggtcccctaccgtacgtaacctaaccgttccgttccggtaccggtaccctaccggtacggtcgtaggacgggtacgaggtacgtagttacttacgtactcggctcgtctactatcgtcgtacgtcggttacttcttccgtttacgttacgttcgttacggttaaccgggaacgttaccgggaaccgtacggtacccgtacccggttaccgtacggtaacccgaacccgacccgacccgttaaccccaccgttacgtcccgtcctaccccg

SEQ ID NO: 258579 - DNA, 750 bp, Homo sapiens
  misc_feature: GYAE6OF01CP40Y.19.78.H01.1.454.CMB.1.raw
tcagtactctcgtgcacgaccggtgctcgatttagtgtgagtagtttgggtttggggggggtcacaagaggcagcgctctcgggacgtctccaccatggcctggctctgctgctcctcactctcctcactcaggacacagggtcctgggcccagtctcgcctgactcagtctgcctcgtgtctggtctccgtggacagtcgtacacactctacctgcacgtcggaacctgacagtacgattggtagtaacttctaacttgtcctccgtcggtaaccaacacgtaccaaaccctaaataaaccgacccctaaactcaacttacgtaacttttatcgtaacttacgacctaacgttaacgcccggtacccttacggttaacggggttttactaaacgttccgtactttccgttacggtacggtacctaccgtaacggttccgtaggaccgaaccgtacccggacccttaccgtacgtaactaacgtcgttccgtacggtccttaccggacgggtcgtacgggacgggtacggtacggtacctaggtaacttaccgtaactcggtctactcgtactaagtcgtacgtacggtacggttactacgttaccgttacgttacgtccgtttacggtaaccggtaacggtaaccggaacccggttaacggtacccgtaaccgttaccggtaaccggtacccgtaaccgtaacccgtaaaccggacccctaaccccgtcgttacgtacccttacccggg

SEQ ID NO: 258580 - DNA, 647 bp, Homo sapiens
  misc_feature: GYAE6OF01BSN14.19.78.H01.1.454.CMB.1.raw
  modified_base (228)..(228): a, c, t, g, unknown or other
  misc_feature (228)..(228): n is a, c, g, or t
  modified_base (262)..(262): a, c, t, g, unknown or other
  misc_feature (262)..(262): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcggtcaccatcctcctgccactggaaccngcagtgatgtagaattcacttgtctctgtacaanctcaccaataacgccccaaatcatctagtttatgatcgccacgtaacgccgccctcgtacgggtttactaacgtcgtcttctcgtcgctaccgaagtctaggacaacgaccggtcctcctagaccaacttctcgtcggccttaccgaggtcgtacggacggtaacgaggtaccgttagtactttacgtacgtgtcgtcgcttacgattagtcgtacgtaacggttccgttacttccgttactttacgttacgttacgttaccggaaacggttccgggtaaaccgtaacggtcccgttaacccggtacggttaccgggtacccaaccggtaccccggtaaacccggtacccctaaacccccgttacgttccggtcccttaacccgg

SEQ ID NO: 258581 - DNA, 289 bp, Homo sapiens
  misc_feature: GYAE6OF01BN9CE.19.78.H01.1.454.CMB.1.raw
  modified_base (244)..(244): a, c, t, g, unknown or other
  misc_feature (244)..(244): n is a, c, g, or t
  modified_base (252)..(252): a, c, t, g, unknown or other
  misc_feature (252)..(252): n is a, c, g, or t
  modified_base (254)..(289): a, c, t, g, unknown or other
  misc_feature (254)..(289): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaaggcccaaaccccatgtcactctcgttccccaccctcctccacgagagtactgacggccgggctggacaaagggccgntaagtagnannnnnnnnnnnnnnnnnnnnnnnnnnnnnnnnnnnn

SEQ ID NO: 258582 - DNA, 252 bp, Homo sapiens
  misc_feature: GYAE6OF01CY2UP.19.78.H01.1.454.CMB.1.raw
  modified_base (240)..(252): a, c, t, g, unknown or other
  misc_feature (240)..(252): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggcccaacccatgtcactctcgttccccgccctcctccacgagtagtactgagcggctggacaaggcgcatagnnnnnnnnnnnnn

SEQ ID NO: 258583 - DNA, 777 bp, Homo sapiens
  misc_feature: GYAE6OF01C2A94.19.78.H01.1.454.CMB.1.raw
  modified_base (140)..(140): a, c, t, g, unknown or other
  misc_feature (140)..(140): n is a, c, g, or t
  modified_base (190)..(190): a, c, t, g, unknown or other
  misc_feature (190)..(190): n is a, c, g, or t
tcagtactctcgtgcacgaccggtgctcgatttagtgtgagtagtttggggtttgggggggtcacaagaggcagcgctctcgggactctccaccatggcctgggctctgctgctcctcacctctcctcactcaggacacngggtcctggccagtctgcctgactcagtctgcctcgtgtcgtggtctcgnggactagtcgtacacatctcctgcacgtcggaaccagcagttgattgtagtaaacttcctaacttcgtactcctaggtaaccaactactaccgaaacctaaactaaaccgacccctaaataccgtattacctagttttagacgtacgtaccgaccgtaacgtaacgtaccggtaccttacggtaacgggtttactaacgttccgtacttccgtcgttacgtacctaccgtacgttacgtacggtaaccgaaccgtacccggtaccctacccgtaacgtaaacttaccgttacgtaccggtcgggttacccacgggtaagtccgtaaacgggacgggtaacggacggttacgttaacggttaactttacgtacgtcgtacttaccgtacttactagtacgtacggttcgaacggtttacgtacgttacctttcgtttaacgttaccggtttacggtaaacccggttaacgggtcccgtaaacggttaacccgtaaccgtaccggtttaccggtaaacggggaccctaccgggaacccctaacccggggaaccccttaaccgtacccgttcgttaacccttaaccccgg

SEQ ID NO: 258584 - DNA, 694 bp, Homo sapiens
  misc_feature: GYAE6OF01AN8L0.19.78.H01.1.454.CMB.1.raw
  modified_base (328)..(328): a, c, t, g, unknown or other
  misc_feature (328)..(328): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtcgtgggtctcctggacaggtcggtcaccatcctcctgccactggaaccagcagtgagttgttagaaacttcctaaccgttgtcctcctacggtaccaacactaccaacccaaactaaaccgacccccaaactcactactatttangactcgacctacgtaacgccgtccgtacgtacgggtttactaacgtcgtccttctcgtcggctaccaagtcgtacgaccaacgaccggccctccgtagactactcgtacgtcggcctcgacggtcgtacggacggacgcggtcttagtacttactacgtgtctcgtctacgtatacgtcgtacgtacgggttcttaacgttccgtttactttacgtttccggttaccggttacgggtaaccgggttacccgggaaaccgttaaccgggtaccccgtacccgggttaccggtaacggttaccccgacccggtaaaccccgaacccggtaccccaaaccccgttacgttcccggttaccttaccccgg

SEQ ID NO: 258585 - DNA, 695 bp, Homo sapiens
  misc_feature: GYAE6OF01BJEY5.19.78.H01.1.454.CMB.1.raw
  modified_base (211)..(211): a, c, t, g, unknown or other
  misc_feature (211)..(211): n is a, c, g, or t
  modified_base (231)..(231): a, c, t, g, unknown or other
  misc_feature (231)..(231): n is a, c, g, or t
  modified_base (328)..(328): a, c, t, g, unknown or other
  misc_feature (328)..(328): n is a, c, g, or t
  modified_base (683)..(683): a, c, t, g, unknown or other
  misc_feature (683)..(683): n is a, c, g, or t
tcagtactctcgtgcacgaccggtgctcgatttagtgtgagtagtttgggtttggggggggtcacaagaggcagcgctctcgggacgtctccacatggcctgggctctgctgctcctcactctcctcactcaggacacgcgggtcctgggcccagtctcgccctgactcacgtctcgcctcgtgtcgtcggtctcgtggactgtcgtcacntcctctgcacgtacgaaccngcagtgtattagttagtaacttctacgttcgtcctcgtacgtaccaactactaccaaaccaaacgtaaccacccctaaatctaattactagtttacngtactacgacctaacgtaaccggtcccgtaccgtacggttacgggtttactaacgttccgttacgtttcgtaccgttcggaccttaccgtaacgttccgaacggtaaccaaccggtaccccgtcccgttaccgtagtaaacccttacgttcccggttacggtaccgggtaccctacgggaacggtcggtaacgggaacggtaaccggtcggtacttaagtacctttacgtacgtcgtactacgtactacgagttacgcgtaccgtaggttctacttctacgttgtacgtacgttacggacgtaccggtactacgccgtacgacggtcgaccacgtaaccgacccaccctaccgtntccgcctaaccg

SEQ ID NO: 258586 - DNA, 639 bp, Homo sapiens
  misc_feature: GYAE6OF01DLA2V.19.78.H01.1.454.CMB.1.raw
  modified_base (229)..(229): a, c, t, g, unknown or other
  misc_feature (229)..(229): n is a, c, g, or t
  modified_base (306)..(306): a, c, t, g, unknown or other
  misc_feature (306)..(306): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacgagggtcctgggcccagtctgccctgactcagtctgccctcgtgtctgggtctcctggacagtcggtcaccatctcctgcactggaaccngcagtgatgttagaattctaacttgtctctgtaccaacactacaaccaaataaaccgaccccaactcatctatttangtatcgaccactaagccggtacctcgtagggtttactaactcgtccttctcgtcggtctacctaacgtcgtagaccaaccgacccggtccctaccctagaacctaactcctcgtacgggcctccgaggtcgtagggacggacggtacggacgttagtaactttaccgtactcgctcgtcttacgattacgtcgtacgtacggttaccgttactcctttacgtttatcggttaccgttaccgggtaacgtccgggaaccgtaacggtaccgacccgttacgtacggtaccgaccgacccgtaaccgaccccgtaacccctcgtcgtcctacccg

SEQ ID NO: 258587 - DNA, 717 bp, Homo sapiens
  misc_feature: GYAE6OF01AJEFT.19.78.H01.1.454.CMB.1.raw
tcagtactctcgtgcacgaccggtgctcgatttagtgtgagtagtttgggtttggggggggtcacaagaggcagcgctctcgggacgtctcaccatggcctggctctgctgctcctcactctcctcactcaggacacagggtcctgggcccagtctgccctgactcagtctgcctcgtgtctgggtctcgtgacagtcggtcaccatctcctgcacgtaggaaccagctagtgtagtgttaggaaattcctaacttgtctcctacggtaccaacactacaacccaaactaacgaccccaaactcatactattatagactacacctactaacggccggtacccttcgtaacggggttttacctaagttccgtcttctacgtcggtcctaccgaacgttcgtcggaccaacgacccggtccctacccgtacggtaacctacttcgtaccgtcgggtcctaccggtacggtcgtaaggacgggaccggtacggtacttacggtaactttaccgttaaccgtcgtcctcggtacctacgtaacttagtacgtcgttaccggtcgttactttaccttacgtttaacggttccgttaccgggtttaacccggaggtacccggtaaccgtaaccggtcccgtaacccggttcccggtacggtacccgtaacccgaccccgtaacccggacccctaacccccgtcgttccgtcccgttaaccccg

SEQ ID NO: 258588 - DNA, 786 bp, Homo sapiens
  misc_feature: GYAE6OF01AND0C.19.78.H01.1.454.CMB.1.raw
  modified_base (237)..(237): a, c, t, g, unknown or other
  misc_feature (237)..(237): n is a, c, g, or t
tcagtactctcgtgcacgaccggtgctcgatttagtgtgagtagtttgggtttgggggggtcacaagaggcagcgctctcgggacgtctccaccatggcctggctctgctgctcctcactctcctcactcgaggacacgaggtcctggccctagtctcgccctgacctcagtctgcctcgtgtcgtggtcctcgtggactagtcggtacaccagtcctcctgactacgtacgaaccngcagtgtattcggttaagtaaacttccttaacgttcgttctaccgtaccggtaaccaactaactaccaaacccgtaaaactaaaccccgacccccaaactccaacttactaacttttatacgtacgtaccgtaccctaaccggtaacggccccggttacccgttacgggttaacggggttttaacctaacggttccttaccgtttccgttccggtaccggtacccttaccgtaacgttcgtaaccgactaaccggaacccggtcccttacctacgacttaaccgtcttcggaccggtacctccgtacgtacgtcgggaacgtacggtacgtagttacgttacgttaaccctgttcgtactcggtacgtattacgtacgttagtaccggtacgttaccgtttcttactttcggttaactcggttaaccgtaccggtaacggttaaccggaaccgttacgttaccccggtacggttacccgaccggttaaccgtaccccggaacccgtaccgggttaacccctaaccccgtcgttaccgttcccgtacccg

SEQ ID NO: 258589 - DNA, 750 bp, Homo sapiens
  misc_feature: GYAE6OF01BLMQS.19.78.H01.1.454.CMB.1.raw
  modified_base (257)..(257): a, c, t, g, unknown or other
  misc_feature (257)..(257): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtcgtggtctcctggacagtcgtcacctatctctgactactaggaaccagcagtgattgtagaaattctaaccttntcctactcgtaaccaacactaccaaaccctaaaataaaaccgacccccaaaactctaactctaatttagtacgactacgacctaacgtaacgcccggtaccctacggtacggggtttacctaaacgtcgtcttccgtcgtcgactaccgaacgttcgacgtaccaacgtacccggtcctacccgtagtaacctaacgttccgtcgttaccgggtaccttaccgacgggtacgtaacgggaacgggtaaccggaaggtcctaagtaaccgtttaccgtaacgttcgtaaccgttcgtacgttacgtaaacgttagtaccgtacggttaacggtccgtttactttaccgtttcgtttactaccggtttacggtttaaccggaaacgggttccgggtaaacccgtaacggttcccgaacccgtttccggaaacggtccctaaacccgggaacccgtaaccgacccccggtaaaccctaccgttcgtaccctacccg

SEQ ID NO: 258590 - DNA, 575 bp, Homo sapiens
  misc_feature: GYAE6OF01EF4A7.19.78.H01.1.454.CMB.1.raw
  modified_base (324)..(324): a, c, t, g, unknown or other
  misc_feature (324)..(324): n is a, c, g, or t
tcagtactctcgtgcacgaccggtgctcgatttagtgtgagtagtttgggtttggggggggtcacaagaggcagcgctctcgggacgtctccaccatggactgggctctgctgctcctcactctcctcactcaggacacagggtcctgggcccagtctgccctgactcagtctgcctcgtgtctgggtctcctggacagtcgtcaccatctcctgcactggaaccagcagtgatgttaggaaattctaaaccttgtctcctggtaccaaacatcaaccgaaaataaacgccccaaatcatcatttatgatgcactaagcgcctnagggtttctaaatcgcttctcgtaggctccaagtctggacaacacggcctccctgaacctaaagtcctactcgggactcccaagctagaaggaccgaagggtctaggatttaactacgtgctgctcatattcggcaaggttcgtaacttcgtacttattacgtcgtttacgaactggggaaccctaacgggtaccaccggttcctacggtaccagacccccaaaagggccccaaaccccgactgtctaccc

SEQ ID NO: 258591 - DNA, 793 bp, Homo sapiens
  misc_feature: GYAE6OF01BPO39.19.78.H01.1.454.CMB.1.raw
  modified_base (227)..(227): a, c, t, g, unknown or other
  misc_feature (227)..(227): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcggtcaccatctcctgcactggaaccngcagtgatgttagtaacttctaacttgtctcctaggtaccaacactaccaacctaaataaaccgacccccaaatcaattactatttatgatcgaccaacgtaacggccggtcccttacggtaggggttttaccttaacgttccggttacctttccgttccgttcgggtaccttaccgtaaacggttccgttacgggaccctaaaccggtacccgggtcccctttacccgtaacggtaaaccctaaactttcccgttaccgggttccggggtacccttacccggtaacgggtaccgttacgggaaacgggaccggtaacggggtacttacggttaactttaaccgttacgtcgtccttacgtcttacgtacgttacgtcgtacggttacgggttactttacgtttcctttacgtttacgttacggtttaccgttaacggggtaaccggttacggggaaacccgttaacgggtccccgttacccggttacccggttacgggttacccgaaccggtaaccccgtaaaccggacccccctaaacccgtcgttccgtcccgttaaccccgg

SEQ ID NO: 258592 - DNA, 632 bp, Homo sapiens
  misc_feature: GYAE6OF01E23RF.19.78.H01.1.454.CMB.1.raw
  modified_base (271)..(271): a, c, t, g, unknown or other
  misc_feature (271)..(271): n is a, c, g, or t
  modified_base (309)..(309): a, c, t, g, unknown or other
  misc_feature (309)..(309): n is a, c, g, or t
  modified_base (460)..(460): a, c, t, g, unknown or other
  misc_feature (460)..(460): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatcctcctgcactggaaccagcagtgatgttggaaattctaaccttgtctcctggtaccaanatcaaccaaaataaacgcccccaaactcatctatttangatgaccaactagccgtccctcgtagggtttactaagtcgtcttctcgtcgtactccaaagtctaggccaacaccggcccttccctagaaccaaacttcctacgtcgggcctccgaaggcgtaggacggacgaggtctaggtactactacngtctgctacatgtcgacgtagggttacctattcccgtttatttagttcgtttaccgttaccggaaccggttgggaaaccctaagggtccctaacccggtttccggtaacgggtaccgaacccggaacccggtaacccgggaccccaaaccccgtccttcggaccttaccccg

SEQ ID NO: 258593 - DNA, 638 bp, Homo sapiens
  misc_feature: GYAE6OF01BDLXY.19.78.H01.1.454.CMB.1.raw
  modified_base (314)..(314): a, c, t, g, unknown or other
  misc_feature (314)..(314): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctggtctctggacagtcgtcaccatctctgcactggaaccagcagtgatgttagaaactttctaaccttgtctcctagtaccaacataccaaccaaactaaaccgaccccaaactacatctatttatgtanacgaccacgtacgccgtccctacgtacgggtttactaacgtcgtctttacgtcgtcgcctaccgtacgtcgtcggacaaccgccgtccctcccgtagactaactcgtacgtcggtcctccgacggtcgtaggacggtacgacggtacgttacgacttactacgtgtacgtctctactacttacacgtaccgtacggttacgttacgttcttagtttctacgttccgttacgggtaaccgtccggaacgtaccggttaccgtaaccgttcgtacggtaccacccgtaaccgaaccgaccctaaaccccgtctacgttccgtaccg

SEQ ID NO: 258594 - DNA, 282 bp, Homo sapiens
  misc_feature: GYAE6OF01DP87H.19.78.H01.1.454.CMB.1.raw
  modified_base (159)..(159): a, c, t, g, unknown or other
  misc_feature (159)..(159): n is a, c, g, or t
  modified_base (219)..(219): a, c, t, g, unknown or other
  misc_feature (219)..(219): n is a, c, g, or t
  modified_base (238)..(238): a, c, t, g, unknown or other
  misc_feature (238)..(238): n is a, c, g, or t
  modified_base (240)..(241): a, c, t, g, unknown or other
  misc_feature (240)..(241): n is a, c, g, or t
  modified_base (243)..(282): a, c, t, g, unknown or other
  misc_feature (243)..(282): n is a, c, g, or t
tcagtactctcgtgcacgaccggtgctcgatttagtgtgagtagtttgggtttggtggtctccactcccgccttgacgaggctgattactactgctgctcatatgcaggtctatcttctatgtcttcggaactgggaccaaggtcaccgtctaggtcancccaaagccaacccactgtcactctcgtcccgcctactcaacgagagtactggagccggntggacaaggcacaagtagnanncnnnnnnnnnnnnnnnnnnnnnnnnnnnnnnnnnnnnnnnn

SEQ ID NO: 258595 - DNA, 824 bp, Homo sapiens
  misc_feature: GYAE6OF01DB3VF.19.78.H01.1.454.CMB.1.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcagacacgagggtcctcgggccccagtccgtcgccctgtacctcgtacgtctcgcccgtccgttgtccgtcggtcttccgtcggacgtacggtccgtaccacctacttccgtcctacgcctaacgtacggaaccacgcgtagtgtagttaggttaacggttaacttaccttaaccgttcgtccttacccgtacggtaaccaactacctaccaaacctaaaactaaaccccgacccctaactacctaagttacctttaattacgtagtacgtaccgaacccgtaacgtaccgggcccgttacccgttacgggttaacgggtttacttaaccggtccttccgttcctcggtccgtacctaacgtacgtcggtacgaaccgaccgtacccgtccgttaccacgtaaccttacttcccgtcggtaccggtaccctaccgggtacggtccggtaacggacgggtaccggtaacggtacgttccgttaacgtttaccgtaccggttcgtaccgtactacctacggtttatacgtcgggtaccgttacggtttccttacgtttcctttaagttcgtttacgtacccggttacgaacgggttacccgaaccgttaacggttaccccggtacttacggtacggtacccgaacccgtaaaccccgaccggtaaccccctacttacgttcgtccccttaacccgg

SEQ ID NO: 258596 - DNA, 620 bp, Homo sapiens
  misc_feature: GYAE6OF01C7UT3.19.78.H01.1.454.CMB.1.raw
  modified_base (273)..(273): a, c, t, g, unknown or other
  misc_feature (273)..(273): n is a, c, g, or t
  modified_base (318)..(318): a, c, t, g, unknown or other
  misc_feature (318)..(318): n is a, c, g, or t
  modified_base (525)..(525): a, c, t, g, unknown or other
  misc_feature (525)..(525): n is a, c, g, or t
  modified_base (603)..(603): a, c, t, g, unknown or other
  misc_feature (603)..(603): n is a, c, g, or t
  modified_base (608)..(608): a, c, t, g, unknown or other
  misc_feature (608)..(608): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacgagggtcctgggcccagtctgccctgactcagtctgcctccgtgtctgggtctcctggacagtcggtcaccatcctcctgcactacggaaccagcagtgattgtagaaattcctacttcgtctccgtgaccaanactaccaaaccaaataaccgacccctaaatctactactatttagngactcgaccaacgtacgccggtaccgtcgtagggttactaacgtccgtcttactcgtcgtacctacgaacgttcgtacgaccaacggtacccgcctacccgtagaaccttactcgtctacggtcctccgaaggtctacgggaacgtcgaagtctacgtacttaccgtctacgcttagtctaactatagttcgagtacggtttacttntaccttacgtttcgtcgtacgtacggacggtacggtacgacgtacctaccgtcgtaacgtccaacgcccgaacacccnctacncgttacccgtcc

SEQ ID NO: 258597 - DNA, 711 bp, Homo sapiens
  misc_feature: GYAE6OF01DS5PO.19.78.H01.1.454.CMB.1.raw
  modified_base (212)..(212): a, c, t, g, unknown or other
  misc_feature (212)..(212): n is a, c, g, or t
  modified_base (217)..(217): a, c, t, g, unknown or other
  misc_feature (217)..(217): n is a, c, g, or t
  modified_base (582)..(582): a, c, t, g, unknown or other
  misc_feature (582)..(582): n is a, c, g, or t
tcagtactctcgtgcacgaccggtgctcgatttagtgtgagtagtttggggttggggggggtcacaagaggcagcgctctcgggacgtctccaccatggcctgggctctgctgctcctcactctcctcactcgaggacacgagggtcctcgggccctagtctcgccctgactcagtctcgcctcgtgtcgtcggtctcgtgactgtcgcacntctcngcacgtacggactagcgtagtcgagttgttacgtaaacttctaacttcgtcctaccgtacgaacaacactaccaaaccgtaaaactaaccgacccctaaactacaacttactattacgtacgtactacgaacctaacgtaaccggtaccgtaccgttacggttaacgggtttacctaacgttccggtactttccgtacggttacgtaccgtaaccgtaagtaccggtacggaaccctaacgtacccgttaccctaccgtacgtaaactacgttccgtacggtacggtcgtaacggcgtacgagggtaccgacggtacgtacgttaagtaccttaacgtctcgtacctagtaccgtatacggtacncggtaccgttacggtacttaacgttcttacgttacgtacgtaacgtacggtaacgtcgggaaactccggtacctaccgtacgtcggaccctacgacccgaaacgtcccaacctcgttacgtccttcccg

SEQ ID NO: 258598 - DNA, 660 bp, Homo sapiens
  misc_feature: GYAE6OF01E4LPD.19.78.H01.1.454.CMB.1.raw
  modified_base (309)..(309): a, c, t, g, unknown or other
  misc_feature (309)..(309): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgccctccgtgtctgggtctcctggacagtcggtcaccatctcctgcactggaaccagcagtgatgttagaaattctaacttgtctcctgtaccaacatcaacccaaaataaacgacccccaaactcactcatttangatgccaactaagcgcctacagggtttctaatcgtcttctcgtgcctaccaagtcgtgcaaccacggtccctccctagactaactctacgtcggccctaccgacggtccgtaggaacgggtaaccgagggtcttaggtaactttaaccgtacgttcgccgttgtaccttacaattaagtcgacgtacggttaccgttaagttcctttacgtttaagttcgtttaccgttaaccgggaacgttaccggggaaacccgttaacgggtcccctaaaccggttccccgttaagggtacccaacggaaccccctaaacggcccccttaaaccccgtccgttacgtcccttaacccg

SEQ ID NO: 258599 - DNA, 884 bp, Homo sapiens
  misc_feature: GYAE6OF01BM4V2.19.78.H01.1.454.CMB.1.raw
  modified_base (350)..(350): a, c, t, g, unknown or other
  misc_feature (350)..(350): n is a, c, g, or t
tcagtactctcgtgcacgaccggtgctcgatttagtgtgagtagtttggggtttggggggggtcacaagaggcagcgctcgtcgggacgtctccaccatggcctgggctctgctgctcctcactctcctcactcgaggacacgagggtccgtcgggcccagtctcgccctgactctagtctgcctcgtgtcgtggtctcgtgacagtcgtcaccatcctcgtgcacgtacggaaccagtcgagtgattggtaacgtaacttactaacttgtactaccgtacgtaaccaactactaaccctaaaccgtaaaactaaacccgaccccctaaatctacttacttaacgtttanacgtactaccgtaccgtaaccggtaacggtacccgtaccgttacgggttacggttactaacgtccgttacctcgtacgtcgtaccgtactaacggcgtacgaacctaaccgtcccgtccctaccgtagaacctaacgttccgtcggtacgaccgttaccggacggtacgtacgggacgtaacgggtaccgttacgtaaggtttaacctaaccgtccgttacgtaccgttacgtaaccttacgtaacgttacgtacccgtaacggttttacggttaaccccgtttagttttaccgtttacggttttaacgggttccccgttaaacccgggggtttaaacggtaaacccgggggtttaacccgggtaaaaccgtttaacccccgggtccccgggttttaaaacccggttacccgggttaaaaccgggttaccccggaaaaccccccggtaaacccccggtaaaaacccccgggttaccccccctaaaccccggtttaaacccgtttccccgggaaccccgtttttaaacccccggg

SEQ ID NO: 258600 - DNA, 712 bp, Homo sapiens
  misc_feature: GYAE6OF01CQ2B6.19.78.H01.1.454.CMB.1.raw
  modified_base (169)..(169): a, c, t, g, unknown or other
  misc_feature (169)..(169): n is a, c, g, or t
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (230)..(230): a, c, t, g, unknown or other
  misc_feature (230)..(230): n is a, c, g, or t
  modified_base (238)..(238): a, c, t, g, unknown or other
  misc_feature (238)..(238): n is a, c, g, or t
  modified_base (263)..(263): a, c, t, g, unknown or other
  misc_feature (263)..(263): n is a, c, g, or t
  modified_base (328)..(328): a, c, t, g, unknown or other
  misc_feature (328)..(328): n is a, c, g, or t
tcagtactctcgtgcacgaccggtgctcgatttagtgtgagtagtttgggttggggggggtcacaagaggcagcgctctcgggacgtctccaccatggcctgggctctgctgctcctcactctcctcactcaggacacgagggtcctgggcccagtctgccctgactcngtctgcctcgtgtcgtggtctccgnggacngtcgtcacactcgtctagcacgtaggaaccngctaggtntagtgttaagtaacttctaacgttntcctacctacgtaaccaacactaccaaacctaaataaaccacccccaaatctaactactatttanacgtactacgacccgtaacgtaacgccggtacccgtacgttacgggtttacctaactccgttacttcctagtacggtacctaacgtaacgtcgtacgtaaccgaaccgacccgtaccgtacctacgtactaactcgtaccgttacggccgtaccgtagtacgagggtaacggacggtacgacttagtactttacgctgtactcgtacttacgtagtacgtcgtacggtacgttacttccgtttacctagtttaccggtagtttaccggtaccggtacgggtaccggtaacgaaccggttccctaccgttacggtccgggtacccgacccgtaacccgggtaaaccccacccgttaacccccgtagttccgtaacccgtccccgg

SEQ ID NO: 258601 - DNA, 778 bp, Homo sapiens
  misc_feature: GYAE6OF01A45GH.19.78.H01.1.454.CMB.1.raw
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctctgcactaggaaccagcagtgtatggttaggtaaacttctaacctttgtccttccgtaggtaacccaacactaccaacccaaaactaaaccgaccccctaaactactactactactttatacgactcgacctaaccgtaacggtcccggtaccccgttacggttaacggggttttacctaaacgttccgtcctttcgtccgtcggtacctaccgtaacggttcgtacggaccgaaacccgtacccgggtccccttaccctaacgtaacctaaaccttccgtcggtaccggtcccgttacccggacgggtaccgtacgggaacgggtaacggtacgggtaccttacggtaactttacccgtacgttcgtaccgttacgtaccgttactaagttacgtacggtacgttacgggtttaccgttacttccgtttacgtttacgttacgttaccggttaacgggtaaccgtaccgggaacccgttaacggtacccgttaaccgtacccggttacggacccgaaccgaaccccgtaaccggaccccaaccccgtactaccgtcccgtacccg

SEQ ID NO: 258602 - DNA, 934 bp, Homo sapiens
  misc_feature: GYAE6OF01C3WPB.19.78.H01.1.454.CMB.1.raw
  modified_base (130)..(130): a, c, t, g, unknown or other
  misc_feature (130)..(130): n is a, c, g, or t
tcagtactctcgtgcacgaccggtgctcgatttagtgtgagtagttggttggggggggtcaccaagaggcacgcgctcgtcggacgtctccgacctatggtcctggcctctcgctgctccgtcacctccncctctacctcgaccggtaccaccgagggtccctcgggtccctagtcgtcgccccttgaccgtccgtaggtctcgcccttccggtggttccgtcgggttccttcccgtagggaccgtacggtaccgggtaccaaccgacgttacccgtcccggtggtaccctaccggtacgggaaaaccgtagtcccgtaaggttcggtaaacgtttcggtttaacggtaaacttttccgttaaaccgtttcggtttacccgtaccgttaacggttaaccgtaaacgtaccgttacccgtaaacccgtaaaacggttaaaccccggaacccccgtaaactaccgtaacgtacccgttaaacgtttaacgacggaccgttacgaccgtaacggtaacggtcccggtaaccttacgggttaacggtttcctaaacggttccgtacgttaccgttacgtaccggtaccgtttaaccggtaaccgtccggtaacgtaaccccgtaacccgttacccccgtccccgttaacccgttaacgaaccgttacccgtaccgttccgtaccggttacccttaccgggacggtaccgtaacgggtaacgtaccggtaacgttactacgttacccttaaccgtccgttcggaccttcgtaacgttactaacgtccgtacggtaccgtaccggtttaccgtacgtcgtttaacgttcgttccgtaaccgtttaacggaacgttcgggaaccgtacggtcctacggttaacgtacggaccgtaccggaaccgtaccggtaccctacgtttcgtcgtacccgttacccgg

SEQ ID NO: 258603 - DNA, 770 bp, Homo sapiens
  misc_feature: GYAE6OF01ED1Z0.19.78.H01.1.454.CMB.1.raw
  modified_base (253)..(253): a, c, t, g, unknown or other
  misc_feature (253)..(253): n is a, c, g, or t
tcagtactctcgtgcacgaccggtgctcgatttagtgtgagtagtttggggtttggggggggtcacaagaggcagcgctctcgggacgtctccaccatggcctgggctctgctgctcctcactctcctcactcaggacacgacgggtccgtgggcccagtcctcgccctgactctagtcgtcgtcctccgtgtcgttgggtcctccgtggactcggtcgtaccacctacttcctctgacgtacgtacgaaccngcgtagtagtagttgttaacgtaaacttccgttaaccttcgtcctaccgtacgtaaccaactactaaccaaaccaaactaacccgaccctaatactatacttattacagtactcgaacctacgtaccggccgttaccgttacggttaacggtttacctacgtccttaccttcgtccggtacgttacctaccggttaacgtccggtaaccggtaacctaccccggtacccgtcccgttaaccgtaacgtaacctaaccttccggtacggtccggtaccctaccgggtagtaccgtaacgggacgggtacctacggttacgttacgttaaacgttccgtaccgttcgtacgtcctacgttactagtacgttcgtagttaccgttacttacgtttactttcgttaccgttcgttaacccgggtacgttaaccgggtaccgtaaaccggtccgttacccgtacgtaccggttacacccgtaccgaacccgtacccgtaccctacgtctccgaccgttcccg

SEQ ID NO: 258604 - DNA, 745 bp, Homo sapiens
  misc_feature: GYAE6OF01BWHQ4.19.78.H01.1.454.CMB.1.raw
  modified_base (177)..(177): a, c, t, g, unknown or other
  misc_feature (177)..(177): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacgagggtcctgggcccagtctcgccctgacctcagtccncgtccgtccgttcgtctcgggttcctaccgtggactggttccggacacctatcctcctgacacgtacggaaaccaggccaaggttgattggttaggtaaactttctaaccttgtaccgtctacgtaccaatactaccaaccaaactaaccgacccccaaaatctactactagtttaactagacgtccacgtaacgtaacggcccgtacccgttacggtacgggtttactaacgtccgttcgttacctcggttccggacttaccgaacggttccgacggtaccgaaaccgtacccggtcccttacccgtacggtaaacctaacgtcctcgggtccggccgttacccgaggtccggtaggacggtaacggacgtacgttattaccgttaaccttgtaggtcacggttcttacaagttcgtcggacttcggttacttcgttacttttaccgtagttcccggttacgtacggtacgaacggggtacctaacggttcccgtaccggtacgttaccgggcctaaacccggaccccgtaacccggaccctaaccccgtcgtacctcccgtacccg

SEQ ID NO: 258605 - DNA, 903 bp, Homo sapiens
  misc_feature: GYAE6OF01AQU1A.19.78.H01.1.454.CMB.1.raw
  modified_base (239)..(239): a, c, t, g, unknown or other
  misc_feature (239)..(239): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctcgcctccgtgtctcgggtcctccgtgggacaggtccggtccaccatcctcctgctactggaaccngcaggtgtatgttaggaaatttcgtaccttggtactccgtaggtaccaacacgttaccaaccctaaaacgttaaaccgaccccctaaaaccttacctaactaccgttaattttaactggtaactaccgaccctaaacgtacgggtacccggtcccgtacggtaacgggggttttaccctaacgttccggtacctttcgtccgttacggccgttacccgtaggttcggttacggaaccaaaccggtacccgggtacccttacccggttacggtaacctaaaccgttcgtacccggttacgggtaccctaccggtacgggtacccgttacgggtaaccgggggtacggtaaccgggttacccggttacgtttaacgtttaacccgttacccggttacgtcccggtttacgaacccgttacgtaaagttccggttaacgggaccgttaacggggtttacctaacgtttccctttaaccggttttacggttccggtttaacccgggttaaccgggggtaaaccgttacccgggggtaaaacccggttaacccgggttacccgtaacccggtttaacccgggaccggtttacccggacccggtaaaccccccgggtaaaccgtacccccgtaaaccccccgttaggtttaccccgtccggttaaccccg

SEQ ID NO: 258606 - DNA, 248 bp, Homo sapiens
  misc_feature: GYAE6OF01EGJ2O.19.78.H01.1.454.CMB.1.raw
  modified_base (238)..(248): a, c, t, g, unknown or other
  misc_feature (238)..(248): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccactgtcactctgttcccaccctcctccacgagagtactgagcgggctggcaaggcgcatagnnnnnnnnnnn

SEQ ID NO: 258607 - DNA, 581 bp, Homo sapiens
  misc_feature: GYAE6OF01ENECT.19.78.H01.1.454.CMB.1.raw
  modified_base (320)..(320): a, c, t, g, unknown or other
  misc_feature (320)..(320): n is a, c, g, or t
  modified_base (465)..(465): a, c, t, g, unknown or other
  misc_feature (465)..(465): n is a, c, g, or t
  modified_base (473)..(473): a, c, t, g, unknown or other
  misc_feature (473)..(473): n is a, c, g, or t
  modified_base (476)..(476): a, c, t, g, unknown or other
  misc_feature (476)..(476): n is a, c, g, or t
  modified_base (484)..(484): a, c, t, g, unknown or other
  misc_feature (484)..(484): n is a, c, g, or t
  modified_base (568)..(568): a, c, t, g, unknown or other
  misc_feature (568)..(568): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctggcccagtctgccctgactcagtctgcctccgtgtctgggtctcgtggacagtcggtcacctatctcctgcctacgtggaaccagcgtagtgattggttacgaaacttctaaccttgtctcctaggtaaccaactataccaaccaaataaacgcccccaaactcatcatttangatcgaccaacgtaacgcggtccctagtagggtttactaacgtcgtcttctcgtcggtctaccgagtctggactaaccgacgccctcgtgaacactacgtcgtcggcctcgaggtcaggtacgacgtaggcttagtatacgtacngctgctantangactggtntacttctattcgtagttcgtacggactcgggaacctggtacctacggtactcggtacaccggacccgaacgaccccaacccgtntccgtcctacccg

SEQ ID NO: 258608 - DNA, 722 bp, Homo sapiens
  misc_feature: GYAE6OF01CXJ5F.19.78.H01.1.454.CMB.1.raw
  modified_base (223)..(223): a, c, t, g, unknown or other
  misc_feature (223)..(223): n is a, c, g, or t
  modified_base (239)..(239): a, c, t, g, unknown or other
  misc_feature (239)..(239): n is a, c, g, or t
  modified_base (519)..(519): a, c, t, g, unknown or other
  misc_feature (519)..(519): n is a, c, g, or t
  modified_base (557)..(557): a, c, t, g, unknown or other
  misc_feature (557)..(557): n is a, c, g, or t
tcagtactctcgtgcacgaccggtgctcgatttagtgtgagtagtttggggtttggggggggtcacaagaggcagcgctctcgggacgtctccaccatggcctgggctctgctgctcctcactctcctcactcaaggacacgagggtcctcgggcccagtctcgccctgactcagtctcgcctcgtgtcgtggtctcgtggacaggtcgtcacctatcctccngacacgtacggaaccngactagtagtagttaggttaaggtaacttacctaccgttcgtaccgtccgtaacgtaaccaactactaacccaaacctaaaactaaaccccgaccccctaaatacctaacttacttatttaacgcgtaactaccgaacctaacggtaaccggtcccgtacccgttaagggttacgggtttacctaacgttccgtcgtttcgtcgtacgtaccttaacgacgttcgtacggacctaaccgtcccgtcctaccgtactactacgtccgtcgtcgcctacggngacgagggacgtacgacgtactaatacgttactacgtntctcttacacttagtacgtcggtacgtacggttcttactactttagttaccgtacggttaccgtaacggtaacggccggtaaaccgtccgtcccgtaccggtacgtaaccggtaccaacccggacccgtacccgacccttaaccgtcgtacccgtcccgtacccg

SEQ ID NO: 258609 - DNA, 710 bp, Homo sapiens
  misc_feature: GYAE6OF01EKNRD.19.78.H01.1.454.CMB.1.raw
  modified_base (545)..(545): a, c, t, g, unknown or other
  misc_feature (545)..(545): n is a, c, g, or t
  modified_base (552)..(552): a, c, t, g, unknown or other
  misc_feature (552)..(552): n is a, c, g, or t
  modified_base (582)..(582): a, c, t, g, unknown or other
  misc_feature (582)..(582): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacgacgggtcctcgggcccagtctcgccctgactcagtctcgtcctcgtgtcgtcggtctcgtggactacggtcgtacacctactcctctacgactacgtacggaaccagactaggtagtagttaggttaacgtaaactttccgttaacgttcgttccgtaccgtaaccgtaaccaactacctaaccaaaccgtaaaactaacccgacccctaaatctactactaattacgactacgtacgtacctaacgtacggtcccggtaccgttacggttaaggtttacctactccgtcttcgtcgtcgtactacgtacgtcgtacgaccgtaccgtccgtcccgacctagacctacgttcgtcggtcgtcctacggagtcgtacggtaaggacgtgtactattacgttcgtancgttacncgtacacgtctgtccgtacgttattacgtntttcgttacgttacgtcgttaccgggtacgtaaccggtcccggaaccgttacgtacccgttaccggttacaaccggttacgaacccccgaacgtccccgtaacccctaagtcttcccgacgttacccc

SEQ ID NO: 258610 - DNA, 609 bp, Homo sapiens
  misc_feature: GYAE6OF01BKL90.19.78.H01.1.454.CMB.1.raw
  modified_base (199)..(199): a, c, t, g, unknown or other
  misc_feature (199)..(199): n is a, c, g, or t
  modified_base (487)..(487): a, c, t, g, unknown or other
  misc_feature (487)..(487): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacngtcggtcaccatctcctgcactggaaccagcagtgatgttagaaacttctaacttgtctcctggtaccaacatccaacccaaataacgacccccaaactcatcatttatgatcgaccactaacgccgcccgtcgtacgggtttactaagtccgtcttcgtctcggctaccgaacgttcgtcggacctaaccgacggtcccctacccgtgaacctaactcctacgtcgggccttccgaggtccgtaggacggaacggtacggcttagacttacgtacgtgtcgtcgctnatgtcacgtagtcgttatccgttcttagtcgttcgtacggtacgtcgggaacctacggtcctacccgttacgtacgccgaaccgacccgtaacgacccctaacccgtactcgtccttacccg

SEQ ID NO: 258611 - DNA, 246 bp, Homo sapiens
  misc_feature: GYAE6OF01EDHF5.19.78.H01.1.454.CMB.1.raw
  modified_base (237)..(246): a, c, t, g, unknown or other
  misc_feature (237)..(246): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtctaggtcagcccaaggccaacccatgtcactctgtccccacctcctccacgagacgtactgagcgggctggacgaaggcgcatagnnnnnnnnnn

SEQ ID NO: 258612 - DNA, 740 bp, Homo sapiens
  misc_feature: GYAE6OF01EC0OQ.19.78.H01.1.454.CMB.1.raw
  modified_base (212)..(212): a, c, t, g, unknown or other
  misc_feature (212)..(212): n is a, c, g, or t
  modified_base (217)..(217): a, c, t, g, unknown or other
  misc_feature (217)..(217): n is a, c, g, or t
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
  modified_base (227)..(227): a, c, t, g, unknown or other
  misc_feature (227)..(227): n is a, c, g, or t
  modified_base (234)..(234): a, c, t, g, unknown or other
  misc_feature (234)..(234): n is a, c, g, or t
  modified_base (251)..(251): a, c, t, g, unknown or other
  misc_feature (251)..(251): n is a, c, g, or t
  modified_base (302)..(302): a, c, t, g, unknown or other
  misc_feature (302)..(302): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcgaggacacgagggtcctgggcccagtctcgccctgactcagtctcgcctcgtgtcgtcggtctcgtggactgtcgtcacntctcncncacngacngctagtnatgtagtacttctactntctcgtgtacacactaccaacaaactaaccaccctaatcatactattagtnacgtacgcctaacgtacggccggttacccgttacggtacggtttactacgttcgtaccttcttcgtacgtctaactacggtcgtacgacctaccggaccgtcccgttaccgacggtaacttaccgttccgggttacggtaccggttaccgtaccggtaccgggtacggtacggggaacggaacggttaccggtcgttaacgttaacttaccggttacggttacgtaccgttacggtacttaacgtaacgtttggtaaccggtacggtttacggttacgttaacgttttccggtttaactttacggttaccgttaacgggttaaccggttaacgggacccggttaacgtaaccgtcccgttaagttacccggttacggtaccctacccggacccggttaaaccacccccgaaaccgtttcttccgtaacgttaccccgg

SEQ ID NO: 258613 - DNA, 748 bp, Homo sapiens
  misc_feature: GYAE6OF01EY17P.19.78.H01.1.454.CMB.1.raw
tcagtactctcgtgcacgaccggtgctcgatttagtgtgagtagtttggggtttggggggggtcacaagaggcagcgctctcgggacgtctccaccatggcctgggctctgctgctcctcactctcctcactcgaggacacgagggtcctgggccagtctgccctgactcagtctgcctcgtgtcgtgggtctccgtggacacggtcggtcaccatcctcctgcactaggaaccagctagtgtagtggttagtaaacttcttaaccttgtcttccgtacggtaaccaactactaccaaccctaaaactaaaccgaccccaaactacaactactatttatacgatacgacctaacgtaacggccgtcccgttacggttacgggtttactaaacgttccgtacttccttcgtcgtactacgaacgtctacggacctaaccgacccgtccctacccgtactaacctaactccgttcggtccggtcctaccgacgtacgtagggaacgggaacgtacggtcgtaggtaactttaccgtacgtcgtcgtcgtacgtactagtactcggtacgtaacggttcgttacgttacctttacgttacgttccgttaccggtttaacggtaaccggttccgggtaacccggtaaaccgggtcccgttaaccccggtaccggttaacgggtaccccgtaaccgggaacccccgtaaccggtaacccccaaccccgttaaccgttcggtaacccttacccg

SEQ ID NO: 258614 - DNA, 627 bp, Homo sapiens
  misc_feature: GYAE6OF01B44JI.19.78.H01.1.454.CMB.1.raw
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctctgcactggaaccagcagtgatgtagaattctacttgtctctgacacatacaaccaaataacgaccccaaactcatactatttatgtatcgaccaactaacggccggtccctcgtacgggtttactaatccgtcttctctcggctacaagtctaggaccaacgaccggtccctacccgtagactaactccgttcgtcgggtcctacccggaggtaccgtagggaacggtacgacggtactagtactttaacgtactgtccttcgctactatgtcgtacgtaggttcttacttcttatttacgtcgttaccgttacgggtaacgtaccgggtaaccctaacgggtccctacccggttacgtacggtaccgaaccgaccccgaaccgaccccaaaccctcgttccgtcgttacccg

SEQ ID NO: 258615 - DNA, 302 bp, Homo sapiens
  misc_feature: GYAE6OF01B4GLO.19.78.H01.1.454.CMB.1.raw
  modified_base (252)..(253): a, c, t, g, unknown or other
  misc_feature (252)..(253): n is a, c, g, or t
  modified_base (255)..(255): a, c, t, g, unknown or other
  misc_feature (255)..(255): n is a, c, g, or t
  modified_base (258)..(260): a, c, t, g, unknown or other
  misc_feature (258)..(260): n is a, c, g, or t
  modified_base (262)..(302): a, c, t, g, unknown or other
  misc_feature (262)..(302): n is a, c, g, or t
tcagtactctcgtgcacgaccggtgctcgatttagtgtgagtagtttgggtttggtggtcgtccactcccgccttgacgaggcctgattactactgctgctcagtactgcaggtctatctcttatgtcttcggaactgggaccaaggtccaccgtctaggtcacgcccaacggcccaacccctctgtcactcgtcgttccccgcctctcgacggtagtacgtctgaggtcggctggacaaggccacatacgnngnacnnntnnnnnnnnnnnnnnnnnnnnnnnnnnnnnnnnnnnnnnnnn

SEQ ID NO: 258616 - DNA, 253 bp, Homo sapiens
  misc_feature: GYAE6OF01BGY12.19.78.H01.1.454.CMB.1.raw
  modified_base (239)..(253): a, c, t, g, unknown or other
  misc_feature (239)..(253): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaacccactgtcactctgttccccgccctcctccacgagatactgagcgggctaggcaaggcgctatagnnnnnnnnnnnnnnn

SEQ ID NO: 258617 - DNA, 785 bp, Homo sapiens
  misc_feature: GYAE6OF01CIK4H.19.78.H01.1.454.CMB.1.raw
  modified_base (237)..(237): a, c, t, g, unknown or other
  misc_feature (237)..(237): n is a, c, g, or t
tcagtactctcgtgcacgaccggtgctcgatttagtgtgagtagtttggggtttgggggggggtcacaagaggcagcgctctcgggacgtctccaccatggcctgggctctgctgctcctcactctcctcactcaggacacgacgggtcctgggccagtctcgccctgactcagtctcgcctccgtgtctcgggtctccgtggactagtcggtcaccatctctgcactacggaaccngcagtgattgtagaacttctaaccttgtcctccgtacgtaaccaactactaccaaacccaaaataaaccgaccccaaactacacgttactatttatcgactacgacctacgtaacggccgtacccgtacggttacgggtttactaacgtcgtcttcgtctcggtctacgaacgtcgtcgacaccgtaccgtccctaccgtacgtacctacgttccgtacgtcgggtcctacgacggtcgtagggtacgacgggtacgtcgtacgtacttactacggtcgtcgtacggttctacgtaacgttacgtacggttacggttaacggtttccggtactttaccggttttaacttttacgggtttaccggtttaaccggtttaaccggggtaaaccggttacccgggggttaaaacccggttaaaccgggtttaccccggtaacccgggtttacggttaacccggtacccgggtaaacccgggacccccgtaaaaccgggttacccccccgtaaacccggtttaaccggttccgttaaaccccgtttcccccgg

SEQ ID NO: 258618 - DNA, 698 bp, Homo sapiens
  misc_feature: GYAE6OF01A09L6.19.78.H01.1.454.CMB.1.raw
  modified_base (201)..(201): a, c, t, g, unknown or other
  misc_feature (201)..(201): n is a, c, g, or t
  modified_base (234)..(234): a, c, t, g, unknown or other
  misc_feature (234)..(234): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacgagggtcctgggcccagtctcgccctgactcagtctgcctcgtgtcgtggtctccgtggacngtcgcaccatctctgcactacggacagcagtgngtagtagtaacttacttaacttcgtcctccgtacgtaaccaactactaccaaacctaaaataacccacccctaactcacttactatttactagactcgacctaacgtacgccgtccgtaggttacgggtttactacgttcctctttccgtcgtacggtcctactacgtcgtaccggacctaaccgcccgtccctacctacgaactaccttcgtcgcggtcctcgacggtcgtaggacggtacggtacgtacgtacgtacgttaaacgttcgtcgtctacgtctactagttacgtcgtacggtacggttacttacgttcgtttacgttacgttccggtttacggttaaccggtacggtaaccggtaaccgtaaccggttacccgtacccgttacggtaccgtaccggaacccgtaacccggtaacccgaccccctaacccgttccgtaccgttcccgttaccccg

SEQ ID NO: 258619 - DNA, 812 bp, Homo sapiens
  misc_feature: GYAE6OF01EMZZ4.19.78.H01.1.454.CMB.1.raw
  modified_base (173)..(173): a, c, t, g, unknown or other
  misc_feature (173)..(173): n is a, c, g, or t
tcagtactctcgtgcacgaccggtgctcgatttagtgtgagtagtttggggttggggggggtcacaagaggcagcgctctcgggacgtctccaccatggcctgggctctgctgctcctcactctcctcactcgaggacacgacgggtcctgggcccagttctcgcctgactcngtctcgcctcgtgtcgtcgggtctcgtggactacggtcggtaccacctactctccgtcgacctacgtaggaccagctaggtgtagttggtacggtaaacttccttaacgttctacctcgtaacgaacctaacgtactaaccaaacctaaaactaaacccgaaccccaactactactacttaagtttactagtacgtaccaacctacgtaaccggtcccgtaccgttacggttaacgggttacttaaacctcgttaccgttactcggttacgtaccttacgtaacggttcccgtaacggtaccgtaaaccggtccccgtaccttaccgtacggtaaccttaagttcccgtacggtccggttacaaccggtcgtacgggtaagaaacggtccgagttaccgtattactaacgtcgtactcgtacgtctaacgtacgttcgtacgggacgttacccgtacgtttaaccgtcttacttttaccgggtacgtttcccggttaaaagggtaaccccggttaacggtaaacccgttaccggggtacccttaacccgggttacgaccgggttaaaccgaccccggttaaaccccgaaacccggtaacccttaaaccccggtcgtttaaccccggctttaacccccgg

SEQ ID NO: 258620 - DNA, 749 bp, Homo sapiens
  misc_feature: GYAE6OF01AGKGM.19.78.H01.1.454.CMB.1.raw
  modified_base (196)..(196): a, c, t, g, unknown or other
  misc_feature (196)..(196): n is a, c, g, or t
  modified_base (224)..(224): a, c, t, g, unknown or other
  misc_feature (224)..(224): n is a, c, g, or t
  modified_base (558)..(558): a, c, t, g, unknown or other
  misc_feature (558)..(558): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctcgtgtctggtctcctggacngtcgtcacatcctcctgcactggaaccngcagtgatagttagtaattctactgtctcgtacgtaccacactaccaacctaaactaaacccgacccctaaactactattacctaatttagtacgtacttaccgaccgtaaaccgtaccgggtacccggtaccccgttacggttaccggggttttacctaacgttccgttcctttaccgtcgttaccggcctaacccgtacgtacggtacgaacctaaccggtaccggtccccttaccgtacgaaccttaactccgttccggtccggtcccgtaccggaccggtagtacggggacggtaacgggacgtcgttaagttaccgttaccgttaaccncgtacctacgtactacgtacgtagttacggcgtacggttacgttaccgtttcgttagtttaccgttcggtttaccgttaaccggacggttaaccggtaacccgtaccggtccgtacccgttccggttaccgtcccggaaccgaacccggtaaacccgaccccttaaacccgcgttaccgtcccttaccccg

SEQ ID NO: 258621 - DNA, 729 bp, Homo sapiens
  misc_feature: GYAE6OF01C3WO9.19.78.H01.1.454.CMB.1.raw
  modified_base (470)..(470): a, c, t, g, unknown or other
  misc_feature (470)..(470): n is a, c, g, or t
tcagtactctcgtgcacgaccggtgctcgatttagtgtgagtagtttgggttgggggggtcacaagaggcagcgctcgtcgggacgtctccacagtggcctgggctctgctgctcctcactctcctcactcacggacacgtggtcctgggcccagtctagccctgactcagtctcgtcctcgtgtctgggtctccgtaggactagtcggcacctattcctactgacctacgtacggaacctgtcgtaggtcgtagttacggtagtaactttccgtaacgttcgtctaccgtacgacctaactactaccaaacctaaagtaaccgacccctaaatctaacgtactactttaatcgtaactacgacctacgtaacggccggtaccctacgggtaacgggttccaacgttccgtacttcgtcgtcgtctacgagtcgtagccaacgccgtacctcagtactagtctagcgtcncgtagcgtagacggacgtagacctagtactaccgtcgtaccgtcgttgtacctactacgtcggtaactccgggttaacggttacttaccgttaccgtttacgttttacggttccggttaacgggttaaacccggttacggaccgggtaaacgggtacccttaacccggtaccccgggttacttcggggtaaacccgtccggaaccccggttaacccgaaaccccctttccccgaaaccgttccgttacccggttacccg

SEQ ID NO: 258622 - DNA, 715 bp, Homo sapiens
  misc_feature: GYAE6OF01EOYVU.19.78.H01.1.454.CMB.1.raw
  modified_base (222)..(222): a, c, t, g, unknown or other
  misc_feature (222)..(222): n is a, c, g, or t
  modified_base (258)..(258): a, c, t, g, unknown or other
  misc_feature (258)..(258): n is a, c, g, or t
tcagtactctcgtgcacgaccggtgctcgatttagtgtgagtagtttggggtttgggggggggtcacaagaggcagcgctctcgggacgtctccaccatggcctgggctctgctgctcctcactctcctcactcaggacacgagggtcctgggcccagtctcgccctgactcagtctgccctcgtgtcgtggtctccgtggacacggtcgtcacatctcctncactagaccagcgagtgatgttagtaacttctactntctcgtacgacacactaccaaccaaactaaccgaccccaactactatactatttactacgtactacgacctaaccgtaccggcccggtacccgttacggttacgggtttactaacgtccgttccttccttcggtcgtcctaaccgtaacggtcgtacggaccgtaaccgaccggtacccctacccgtacgtaactaaccgttccgtcgggtccgtccgtaccggacgtaccggtagggacggtacggacggtacgttagtaactttacgtactcgtccgtactacctactagtacgtcggtacgttacggttacttacgtttaccttacggttacgttacggttaccgtacgggtacggtaccgggtaaccgtaacggtcccgtacccgttacggtacgtacccggaaccgtaccccgtaccgacccctaacccggttcctaccgtcccgtaccccg

SEQ ID NO: 258623 - DNA, 808 bp, Homo sapiens
  misc_feature: GYAE6OF01ASN3A.19.78.H01.1.454.CMB.1.raw
  modified_base (264)..(264): a, c, t, g, unknown or other
  misc_feature (264)..(264): n is a, c, g, or t
  modified_base (466)..(466): a, c, t, g, unknown or other
  misc_feature (466)..(466): n is a, c, g, or t
tcagtactctcgtgcacgaccggtgctcgatttagtgtgagtagtttggggtttggggggggtcacaaggaggcagcgctcgtcgggacgtctccaccatggcctgggctctgctcgctcctcactcctcctcactcgacgacacgcggtccgtcgggcctagtcctcgccctggacctctacgtctcgtcccgttcggtcgtcggttcggtctaccggtgacgtcggtccgtacaccttctcctctcgactacgacggaaccngagtgtagtaggttcggttaacgtaactttccttacgtcggttacccttacggaaccgttaccaactaccaaaccgtaaaacccaaacgtaaacccccgaccccttaaatctaaccttatttagtaacgtaactaccggtcccaaaacggttaacggtacccgcccggttaacggtttacggttacggttaacttcccgttnttcccggtaaggtttccgtccgttaacgtaacggtccggtcgtaaacccgtactaccggtacccctctaccgtaacgtactcgtcccgggtgtacgccgtacgtaccgtacggtacggtcgtaaccggtacgtctaacgtcttacgtcgtccgtcgtacgtatagtacgtacgtaacgggttaccttacgttctttaaccttcggttaacgtttcgtaaccgttacggtacgggtaacccggttaccgaaccggttacccggtaccgtaccgtaccggtaccgttaccccggacgaaccccgtacccgtaaccctacttacccggtccttacccgtaccccg

SEQ ID NO: 258624 - DNA, 804 bp, Homo sapiens
  misc_feature: GYAE6OF01CLNVI.19.78.H01.1.454.CMB.1.raw
tcagtactctcgtgcacgaccggtgctcgatttagtgtgagtagtttggggtttgggggggggtcacaagaggcagcgctctcgggacgtctccaccatggcctgggctctgctgctcctcactctcctcactcaggacacgagggtcctcgggcccagtctgccctgactcagtctcgcctcgtgtcgtgggtcctccgtggactagtcggtcacctatctccgtgcctacgtacggaaccagacgtagtagtattggttaacggtaactttaccttaaccttcgtccttaccgtacggtaaccctaaactaccttaacccaaacctaaaacgtaaaccccgaacccccctaaacttacctaatttaccttaattttagtacgtaactaccgaacctaaccggttaacggccccgtacccgttacgggttaacgggttactaacgtccgttaccttcgtcgtacggtcctaccgtacgtcgtacggaccaaccgtcccgtccctaccgagtaacctacgttccgtcggtaccggtccgtacccgagggtaccgtacgggaacggtaccgacggttacctagttaaccttacgtacgtacgtccgtagtaccctataacgttacgtcggtacggttacgttaccttaacgttcctttacgttaacggttccgttaaccgggttaccggtaaccggtacgggtaacccggttaccgttacccggtacccggttacggtaccggtaccctaaccggaaccccggttacccgaacccccgttacgtacccgtccgtccgttaccccg

SEQ ID NO: 258625 - DNA, 772 bp, Homo sapiens
  misc_feature: GYAE6OF01CEALX.19.78.H01.1.454.CMB.1.raw
  modified_base (240)..(240): a, c, t, g, unknown or other
  misc_feature (240)..(240): n is a, c, g, or t
tcagtactctcgtgcacgaccggtgctcgatttagtgtgagtagtttgggtttgggggggggtcacaaaggaggcagcgctctcgggacgtcctccaccatggcctgggctctgctgctcctcactctcctcactcaggacacagggtcctgggcccagtctgtccctgactcagtctgcctccgtgtctgggtctcgtggacagtcggtcacctatcctccgtgcctacgtcggaaccngtcgagtgagtgtagtaacttcctacttgtcctcgtacgtaaccaagtactacccaaacctaaataaccgaccccctaaaatcgaattacgttaatttacgtacgtactacccggtacctaaccggtaaacgggcccgggtaccccttacgggttaacgggggttttactaaccggttcccgttactttccgtacggttcgggtacctttaaccggtaacggttacgtacggaactaacccggacccggttcccctaccgtagtaacctaacggttccgttccggtaccgggttaccacccggtagggtacgtaacggggaacggaacggtacgggtaccttaagtaccttaacgtagtcgtctacggtacctaagtacgtagtaccgggacttacgggtacttcgttacttacgttcgtacgttacgtaacggtaccggtaggtaacccggtagtcccgtaacggttcccgttaaggccgttaaaccggaccctaacccgggttaccccaaccgtactgtaacccgtaccg

SEQ ID NO: 258626 - DNA, 343 bp, Homo sapiens
  misc_feature: GYAE6OF01AO90U.19.78.H01.1.454.CMB.1.raw
  modified_base (189)..(189): a, c, t, g, unknown or other
  misc_feature (189)..(189): n is a, c, g, or t
  modified_base (229)..(229): a, c, t, g, unknown or other
  misc_feature (229)..(229): n is a, c, g, or t
  modified_base (275)..(275): a, c, t, g, unknown or other
  misc_feature (275)..(275): n is a, c, g, or t
  modified_base (279)..(283): a, c, t, g, unknown or other
  misc_feature (279)..(283): n is a, c, g, or t
  modified_base (285)..(343): a, c, t, g, unknown or other
  misc_feature (285)..(343): n is a, c, g, or t
tcagtactctcgtgcacgaccggtgctcgatttagtgtgagtagtttgggtttggtggtctccactcccgcctttgacgaggctgattactactgctgctcatatgcaggttcttatctcttatgtacttacggaaactgggaccaaggtccaccgtcctaggtcacgccccaaggccccaaacccctntgtaccactctcgttcccccgccccttcctcccaacgganaacggtactggacggtccggggctagggacaaggggccactaatgntagnnnnncnnnnnnnnnnnnnnnnnnnnnnnnnnnnnnnnnnnnnnnnnnnnnnnnnnnnnnnnnnn

SEQ ID NO: 258627 - DNA, 290 bp, Homo sapiens
  misc_feature: GYAE6OF01EVVW5.19.78.H01.1.454.CMB.1.raw
  modified_base (100)..(100): a, c, t, g, unknown or other
  misc_feature (100)..(100): n is a, c, g, or t
  modified_base (247)..(290): a, c, t, g, unknown or other
  misc_feature (247)..(290): n is a, c, g, or t
tcagtactctcgtgcacgaccggtgctcgatttagtgtgagtagtttgggtttggtggtctccactcccgccttgacgaggctgattactactgctgctnatatgcaggtcgtatctcttatgtcttcggaactgggaccaagggtcaccgtctaggtcacgcccaaggccaaccccatgtcactctcgttccccacctcctccagagagttactggacggcgggtctcggacaagggcacagtagnnnnnnnnnnnnnnnnnnnnnnnnnnnnnnnnnnnnnnnnnnnn

SEQ ID NO: 258628 - DNA, 725 bp, Homo sapiens
  misc_feature: GYAE6OF01DDGIS.19.78.H01.1.454.CMB.1.raw
  modified_base (220)..(220): a, c, t, g, unknown or other
  misc_feature (220)..(220): n is a, c, g, or t
  modified_base (554)..(554): a, c, t, g, unknown or other
  misc_feature (554)..(554): n is a, c, g, or t
tcagtactctcgtgcacgaccggtgctcgatttagtgtgagtagtttggggtttgggggggtcacaagaggcagcgctctcgggacgtctccacatggcctgggctctgctgctcctcactctcctcactcaggacacgagggtcctcggccagtctcgccctagactcacgtctcgtcctcgtgttcgtcggtctccgtgactcgtcgcactactctcngcacgtacgaacagctagtgtagttagtaacgtaaactttccgtaacgttcgtccttaccgtcgtaaaacctaacacgttaaacccaaacctaaaactaaaccccaaccctaaactacgtaacttacgtaattttagacgtaactacggaacctaaagtaccggaccgtccgttaggtacgtttaaccaacgtccgttcttcgtactacgtacgtacgtaacggttcgacgaccaaccgtaccggtacctcctaaagtaacctactacgttcgggacgtaccacgggtaagtcgaaggaacggtacgtagtaacgttacgtaaacttcgttaancgtcgtactaactcgtaatacggttacacggttagtacccgttcttagtttacgtaaggtccgttaaccgggtaagtaaccggttaaaccggtaccgtaacgttaccggtacgtacggttaccaacggtacccgacgacccgaaaccttacctgggtaacctggtaaaccc

SEQ ID NO: 258629 - DNA, 709 bp, Homo sapiens
  misc_feature: GYAE6OF01B0YUN.19.78.H01.1.454.CMB.1.raw
  modified_base (161)..(161): a, c, t, g, unknown or other
  misc_feature (161)..(161): n is a, c, g, or t
  modified_base (185)..(185): a, c, t, g, unknown or other
  misc_feature (185)..(185): n is a, c, g, or t
  modified_base (197)..(197): a, c, t, g, unknown or other
  misc_feature (197)..(197): n is a, c, g, or t
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (345)..(345): a, c, t, g, unknown or other
  misc_feature (345)..(345): n is a, c, g, or t
  modified_base (445)..(445): a, c, t, g, unknown or other
  misc_feature (445)..(445): n is a, c, g, or t
tcagtactctcgtgcacgaccggtgctcgatttagtgtgagtagtttgggttggggggggtcacaagaggcagcgctcgtcgggacgtctccacctatggcctgggctctgctgctcctcactctcctcactcaggacacgagggtcctgggacccagtcncgccctgactcagtctgccttcgntcgtggtctcgnggacngtcgtcaccntctcctgccacgtcggaacctgctagtagtattggtaacggtaaacttccgttaaccttcgtacctccgttaggtaacccaacgtacttaccaaaccaaacttaaccgaccccctaaatcaagtctaagtttntacgactcgaacctacgtaacgccgtcccgtaggtacggtttacaacgtctacgtctcgcgtcctacgtacgtcacgaccaacgtaccgtccctacgtanaacctagtcctacggtcgaccgttacgcggtactagggacggacggtcgtagttactagttaaccctcggtacgtaccgttccgtacttacgaattacggtcggtaaccggttacggtttacttacgtttccgttaacggtttacggacctttaccgggtacggtaccggttacggaacccgttaccgggtccttacccggtacgtccggacctaacccggacccgaacccgacccctaacccttcggaaccttcgttaccccg

SEQ ID NO: 258630 - DNA, 723 bp, Homo sapiens
  misc_feature: GYAE6OF01AG9O8.19.78.H01.1.454.CMB.1.raw
  modified_base (182)..(182): a, c, t, g, unknown or other
  misc_feature (182)..(182): n is a, c, g, or t
  modified_base (546)..(546): a, c, t, g, unknown or other
  misc_feature (546)..(546): n is a, c, g, or t
  modified_base (554)..(554): a, c, t, g, unknown or other
  misc_feature (554)..(554): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctcgccctgactcagtctgcctcgtntcgtggtctccgtggacagtcggtacacctactcctcctgcacgtcggaaccagcaggtgtagttggttacgtaaacttccttaaccgttgtaccgtccgtacggtaaccctaacacgtaccaaccaaaactaaccgaaccccctaaactactactactaattatagtactcgacctaacgtaacggccgtaccgtcgttacgggttactaacgtcgtccttccgtcgttcggacctaccgtacgtccgacggtacctaccgtcccgtaccctacccgtagtaactacgtccgttcggcggtccctaccggtaggtacgacgggtacggacggacgtcgtagttaccttactacgtcgtacgtntccgttanacgttaacgtcgtaccgttacggttactacgtttacgttacgttacgttacggtttaccgtaaccgggacggttaccggtaaccgtaaccggttcgtacccggttcggtaccgtaccgacccggaaccgtacccggtacccctaaccctcgtaccgtcccgttaacccg

SEQ ID NO: 258631 - DNA, 905 bp, Homo sapiens
  misc_feature: GYAE6OF01CBJSV.19.78.H01.1.454.CMB.1.raw
  modified_base (236)..(236): a, c, t, g, unknown or other
  misc_feature (236)..(236): n is a, c, g, or t
  modified_base (243)..(243): a, c, t, g, unknown or other
  misc_feature (243)..(243): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacgagggtcctgggcccagtctcgccctgactcagtctgcctccgtgtctgggtccttcgtggactaggtccggtcacctatctcctgtcactgaaccngctagtntagtgttaagaacttccgttaacttcgtcctccgtacggtaaccaactactaccaacctaaactaaaccgaccccctaaactctaactacctaattactacgactacgtaccgtaacgtaacggtccgtacccgtacggttacgggtttactaacgtcgtaccttccgtacgtcgggtaccttacgtaacgtcccgtaggaccctaaccgtacccggtaccctcccgtacgtacctaacgttccgtccggtccgggtccctaccgacggggtacgtacgggaaccggtaacggtacggtaccgtaaggttaaccttaaaccggtcgtaacgtcgttacggtaccttaacgttaaccgttgtaacccggaccgggtttacgggttaccgttaacgtttacccgtttaccggttttaagttacccggttttacccgggttaaacccggggttaaaccgggtaccccgggggtttaaaaccccccgggtaaaagggggttttacccccccggttaaacccgggttaacccccggggtttacgggtaacccccggtaaaacccccgggttaacccccgggaaaacccccccgggttaaacccccccgaaaacccccccggttttacggtttccccggggttaacccccctttaaacccccccgggg

SEQ ID NO: 258632 - DNA, 622 bp, Homo sapiens
  misc_feature: GYAE6OF01D8ULN.19.78.H01.1.454.CMB.1.raw
  modified_base (140)..(140): a, c, t, g, unknown or other
  misc_feature (140)..(140): n is a, c, g, or t
  modified_base (235)..(235): a, c, t, g, unknown or other
  misc_feature (235)..(235): n is a, c, g, or t
  modified_base (284)..(284): a, c, t, g, unknown or other
  misc_feature (284)..(284): n is a, c, g, or t
  modified_base (398)..(398): a, c, t, g, unknown or other
  misc_feature (398)..(398): n is a, c, g, or t
  modified_base (459)..(459): a, c, t, g, unknown or other
  misc_feature (459)..(459): n is a, c, g, or t
  modified_base (501)..(501): a, c, t, g, unknown or other
  misc_feature (501)..(501): n is a, c, g, or t
tcagtactctcgtgcacgaccggtgctcgatttagtgtgagtagtttgggtttggggggggtcacaagaggccagcgctctcgggacgtctccaccatggcctgggctctgctgctcctcactctcctcactcgaggacncagggttcctgggcccagtctgccctgactcagtctgcctcgtgtctgggtctcctggacaggtcggtcaccagtctcctggcacgtggaacccnggcctaggtgatggttgaaacttctaaaccttgtctcctggtaccaacntacaaccaaataacgccccaaatctagtcagtttatgatcgccacaacgcgtcctgtagggttctaagtcgtcttctcgtcgctacctaagtctaggaccaacgcgtcctcctnaacgtaacttcgcgtgggctaccgaaggctagggacgtaggacgtcgtcgtagtaaccgtntcgcttcggcttacaatgtcgacgtaggtcttaacttcgttnttacgtacgttaccgtaccgggtaacttccggggaacctaacggtccgtaaccggttcgtaccggaccgtaccggaccccggtaaccggaccctaacccggttactccgttaccgtacccg

SEQ ID NO: 258633 - DNA, 361 bp, Homo sapiens
  misc_feature: GYAE6OF01A59O2.19.78.H01.1.454.CMB.1.raw
  modified_base (180)..(180): a, c, t, g, unknown or other
  misc_feature (180)..(180): n is a, c, g, or t
  modified_base (270)..(270): a, c, t, g, unknown or other
  misc_feature (270)..(270): n is a, c, g, or t
  modified_base (272)..(272): a, c, t, g, unknown or other
  misc_feature (272)..(272): n is a, c, g, or t
  modified_base (274)..(274): a, c, t, g, unknown or other
  misc_feature (274)..(274): n is a, c, g, or t
  modified_base (276)..(276): a, c, t, g, unknown or other
  misc_feature (276)..(276): n is a, c, g, or t
  modified_base (279)..(279): a, c, t, g, unknown or other
  misc_feature (279)..(279): n is a, c, g, or t
  modified_base (281)..(361): a, c, t, g, unknown or other
  misc_feature (281)..(361): n is a, c, g, or t
tcagtactctcgtgcacgaccggtgctcgattttagtgtgagtagtttgggtttggtggtctccactcccgccttgacgaggctgattactactgatgctcatatgcaggtcgtattctcttatgtcttcggaactgggaccaaggtcaccgtctaggtcagcccaaggccccaaacccntgttcaccttctccgtttcccccgcccttccctaccaacggagtaagtaccgtggacggccgggctggaccgaaacggcgtacataaggntncngntgntnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 258634 - DNA, 626 bp, Homo sapiens
  misc_feature: GYAE6OF01EXRPL.19.78.H01.1.454.CMB.1.raw
  modified_base (92)..(92): a, c, t, g, unknown or other
  misc_feature (92)..(92): n is a, c, g, or t
  modified_base (142)..(142): a, c, t, g, unknown or other
  misc_feature (142)..(142): n is a, c, g, or t
  modified_base (431)..(431): a, c, t, g, unknown or other
  misc_feature (431)..(431): n is a, c, g, or t
  modified_base (497)..(497): a, c, t, g, unknown or other
  misc_feature (497)..(497): n is a, c, g, or t
  modified_base (505)..(505): a, c, t, g, unknown or other
  misc_feature (505)..(505): n is a, c, g, or t
tcagtactctcgtgcacgaccggtgctcgatttagtgtgagtagtttggggtttgggggggggtcacaagaggcagcgctctcgggacgtcnccaccatggcctgggctctgctgctcctcactcctcctcactcaggacanagggtcctgggccagtctgccctgactcagtcttcgccttcgtgtcgtcgggtctccgtggactaggtccgtcaccattcctcctgacaactcgggaaccagcagtgattggttagaaactttccttaacttcgttctaccgtaggtaaccaacgactaccaaacctaaaactaaaccgtaccccaaaatctatactaattatacggactgaccaactacggccgtcctacggtagggttactaactcgtcttcgacgtcgactacgatcgcgacacgacgcctactanactatcgtacgtggactacggtgcgtagacggacgtagctagtacttacgtactcgtctgccttanagttacgngtacgtaggtactcttacttcttaacgtcgttacgtaacggacgttaccggaacgtaccggtacgtccgtaccgtgtacccgaacgaccccgaaaccgacctaacccgtctcggtacctcg

SEQ ID NO: 258635 - DNA, 768 bp, Homo sapiens
  misc_feature: GYAE6OF01EG8SE.19.78.H01.1.454.CMB.1.raw
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctctggacagtcgtcacatctctgctacgtgaaccagctaagtgtagttacggttaaggtaaacttcctaaccttcgtcctccgtacggtaccaaactactaaccgaaaccaaaaactaaaaccgaaccccctaaaactacctaacttactaatttaagtacgtacgtacgacccgtaacgtaaaccggtcccggtacccgtacggttaacgggttttaacgttaaactccggttaacccttccggtacgttaccggtacctaacccgtaaacgttccggtaacgggaaccctaaaccgtacccggtacccctaccgtacgtaaacctaacggttacccttacggtacgggtccctaccggtacggtaccgttacgggtaaccgggaacgtaacggtacccgtaaggtttaacttaccgttaaacgtcggtacttcgacttactaacgtaggtcgtacgtaacggttctaacttcttagttacgtcgtacgtaagggtacctggaacctaacgggtcctaacggttaccgacgacgaaccgaccctaaacgacccccgtaaacctgtcccgtactaccg

SEQ ID NO: 258636 - DNA, 746 bp, Homo sapiens
  misc_feature: GYAE6OF01DUSE5.19.78.H01.1.454.CMB.1.raw
  modified_base (239)..(239): a, c, t, g, unknown or other
  misc_feature (239)..(239): n is a, c, g, or t
  modified_base (257)..(257): a, c, t, g, unknown or other
  misc_feature (257)..(257): n is a, c, g, or t
  modified_base (371)..(371): a, c, t, g, unknown or other
  misc_feature (371)..(371): n is a, c, g, or t
  modified_base (531)..(531): a, c, t, g, unknown or other
  misc_feature (531)..(531): n is a, c, g, or t
  modified_base (728)..(728): a, c, t, g, unknown or other
  misc_feature (728)..(728): n is a, c, g, or t
tcagtactctcgtgcacgaccggtgctcgatttagtgtgagtagtttggggtttggggggggtcacaagaggcagcgtctcgtcgggacgtctccaccatggcctgggctctgctgctccctcactctcctcactcgaggacacgacgggtcctcgggacccagtctcggccctgactcagtctcgcctccgtgtctgggtcttccgtggactagtccgggtaccaccacttccgtccngacctaccgtaggaaccngtcgtagtgtacgtttggtaacggtaaactttctaactttcgtacctcgtacgtaaccactacctaaccaacctaaactaaccccgaccctaactcgtacttacgtactttagngtacactacctaacgtacggcccggtacctttacggttacggtttacaccgttctcctctcgtcgtctacgagttccgagacctacgtacccggccctacgactactaacgttcgtacgtaccggtcctacggacgggtcgtacggaaccgggtaccggnggttacctaagtttacgttcctaaggcgttacgtacgtcttagaacttcggacgttaccggtacgtttacttaaccttgtttaacccgttgttacggttaccggtaaccggtaggtacccggaggttacccgtaccgttaccgggttccgttaaaccgacccgcccttaaacccggaccccgttaacccgtaccccncgttaccgtcttcccccg

SEQ ID NO: 258637 - DNA, 719 bp, Homo sapiens
  misc_feature: GYAE6OF01DD9RO.19.78.H01.1.454.CMB.1.raw
  modified_base (144)..(144): a, c, t, g, unknown or other
  misc_feature (144)..(144): n is a, c, g, or t
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
  modified_base (352)..(352): a, c, t, g, unknown or other
  misc_feature (352)..(352): n is a, c, g, or t
  modified_base (405)..(405): a, c, t, g, unknown or other
  misc_feature (405)..(405): n is a, c, g, or t
  modified_base (692)..(692): a, c, t, g, unknown or other
  misc_feature (692)..(692): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcacctctcctcactcgaggacacgngggtcctcgggcccagtcctcgccctgactcagtctcgtccctccgtgtcgtggtcctccgtggcagtcggtcacctctctccngacactacggaaccngtacagtagtagtgttaacggtaactttaccgtaacctttcgtcctcgttaccggaactaacaactaccaaaccaaactaaaccgacccctaaatctatactaattacngatacgacctacgtagccgtacccgtggtacgggttactaactcgtctctcgngtccgtacctagtcgtacgaccaccgtcccgccctaccgtacgtaaccgtacttccggttccggttccgggaccctccgggttaacggacggtaaccgggtaacggtaccggggtacggttacttacgttaaccgttacgtacgtccggtactcggtaacctactaagtacggtccgtaacggttaccggttaactttcttccgttactttaccgggtccttacggttaacccggtaacgtacggtaccgtaaccggtaccgtacggtcggacacgcccgtaacccnccgtaccctacctacgcgttacctccg

SEQ ID NO: 258638 - DNA, 804 bp, Homo sapiens
  misc_feature: GYAE6OF01AL683.19.78.H01.1.454.CMB.1.raw
  modified_base (177)..(177): a, c, t, g, unknown or other
  misc_feature (177)..(177): n is a, c, g, or t
  modified_base (641)..(641): a, c, t, g, unknown or other
  misc_feature (641)..(641): n is a, c, g, or t
tcagtactctcgtgcacgaccggtgctcgatttagtgtgagtagtttggggtttgggggggggtcacaagaggcagcgctctcgggacgtctccaccatggcctgggctctgctgctcctcactctcctcactcaggacacgagggtcctgggcccagtctcgccctgactcagtcncgcctccgtgtcgtgggtctctggacagtcggtcaccatctctcgcacgtgaaccagcagtgtagttgttaagtaactttctaaccttcgtctccgtacggtaccaactactaaccaaacctaaaactaaaccgacccctaaaactctaacgttaccttaacttttatacgtactaccgaaccctaaccggttaacggcccggttacccgtttaacgggttaaccggggtttttaccttaaaaccggtttccggttacccttttccgttaccggttaccgggtacccgttaaacccggttaacggtcccggttaacgggtaccgaaacccggtacccggtcccttaccccggtaggaaacccttcgttaccgtcggtccgggtcctaccgggtggtaccggcgggtaacggaacgggtacggtacttacggtaacttaacggttacctggtcctagttctaacnggttacgcgtacggtagtacttactactttcgtacgttacgttaccggtacggacgtaccgggtaaacctcggtaccccgtaggttaaccgtacgggtacccgaacccgtaccccgggttaaccggaaccccctaacccgtccttacgttaccccgttacccg

SEQ ID NO: 258639 - DNA, 739 bp, Homo sapiens
  misc_feature: GYAE6OF01A28JJ.19.78.H01.1.454.CMB.1.raw
  modified_base (234)..(234): a, c, t, g, unknown or other
  misc_feature (234)..(234): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcggtcaccatctctgcacgtcggaaccagcaggtntattggttaggtaaacttccttaaccttgtcctcctcggtaaccaacataccaacccaaataaacgacccccaaactcaatctatttatgatcgaccaacgtaacggccggtacccttacggtacggggttttacctaacgttccgtacctttctcgtacggtacctaccaaacgtcgtacggaccaacgtaccggccctccctacgaacaactcgtcgtaggtccctaccgacgggtactacgggaacgggaacggtacgggtaccttaggtaactttaacgtaaccgttcgtccgtacgtccgttacaagttacgttacggtaccgttacgggttaccgtttacttacgttactttacggttacgttacggttaccgggtaaccgtaccggggtaaccgtaacgggttcccgtaaccggttcccggttaacggtaaccccgacggtaaccccgtaaaccgggtaccccctaaaccccgtacgttaccgttcccgttaaccccg

SEQ ID NO: 258640 - DNA, 822 bp, Homo sapiens
  misc_feature: GYAE6OF01CEG1G.19.78.H01.1.454.CMB.1.raw
tcagtactctcgtgcacgaccggtgctcgatttagtgtgagtagtttggggtttgggggggggtcacaagaggcagcgctctcgggacgtctccaccatggcctgggctctgctgctcctcactctcctcactcaggacacgagggtcctcgggccagtctcgccctgactcagtctcgcctcgtgtcgtgggtcctccgtggactaggtccggtacacctatccgtcctcgccaacgtaacggaaccacgctaggtgtagttggttaagtaacttaccttaaccgttctacctccgtacggtaaccaactaacctaccaaaccctaaaactaaaccccgtaaccccctaaactactaacttacttaatttagagtacgtaccgaacctaaccggtaacggtccccggtacccggttacgggtttaacgggtttaccttaacgttcccgttacctttacgtccggttacggtacccgttaaccgtacggtttcgtaaccggtaacccgaaaccggttacccccgggtacccttacccgtacgtaaacccttaccgtttcccggtaccggttccggggtacccctacgggtaaccggggttcgtaacgggggtaacgggtaaccgggtaacgttcgttaaccggttacttaaccgtaccgttcggtaccgtcttcgttaactacgttacgtcggtacgttacgttacttccgtttacctttgttacgtcggttaaccgtacgggacggttacggacgttaccgtccgttacgtaacggtcaccggtaccgacccgtacccgtaccaccctggtctacctcccg

SEQ ID NO: 258641 - DNA, 663 bp, Homo sapiens
  misc_feature: GYAE6OF01CI0XF.19.78.H01.1.454.CMB.1.raw
  modified_base (199)..(199): a, c, t, g, unknown or other
  misc_feature (199)..(199): n is a, c, g, or t
tcagtactctcgtgcacgaccggtgctcgatttagtgtgagtagtttgggtttggggggggtcacaagaggcagcgctctcgggacgtctccgaccatggcctgggctctgctgctcctcactctcctcactcaggacacagggtcctgggcccagtctgccctgactcagtctagcctcgtgtctggtctcctggacngtcgtcaccatcctctgcactggaacagcagtgatgtaggaaattctaacttgtctactacgtacaacactaccaacctaaactaaccacccaactactactactattatacgactcgacctaacgtacgccgtaccgtacggttacggtttactaacgtcgtccttccgtcgtcgtacctacgtaacgtcgtcggtaccgaaccgacccgtccctacccgtacgtacctaacgttcgtccgtacggtcctaccggtacggtacgtacggtaacggtacggtcggtacgttagtacgttaacctacgtcgtcgtcgcttacacgttgtcgaccgtacgttcttacttcttacgtttcgttacggttacgttaccggaccgtacggtaaccgtaccggtacccgtaccggttacgtacgtaccgaccgtacccgaaccgtaccctaacccgtctccgtccgtacc

SEQ ID NO: 258642 - DNA, 780 bp, Homo sapiens
  misc_feature: GYAE6OF01BWSQH.19.78.H01.1.454.CMB.1.raw
  modified_base (205)..(205): a, c, t, g, unknown or other
  misc_feature (205)..(205): n is a, c, g, or t
  modified_base (225)..(225): a, c, t, g, unknown or other
  misc_feature (225)..(225): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacgagggtcctcgggcccagtctcgccctgactcagtctcgcctccgtgtcgtggtcctccgtggacncggtcgtccaccatcctccngcacgtaggaaccagcagtagtagttagttaggtaacttacctaacctttcgtacctccgtacggtaaccaacactaccaaacccaaaacgtaaacccgaccccctaaaactcctaacttactaactttagtacgtactacgaacctaactaacggccgtacccgttacggtacgggttttacctaacgtcgtcctttccgtacgtacggtaccttaacccggtaacgttccgtacggtaaccgaaccgtacccggtccctacccgtaagtaacctactccgtacgtcggacctccgagggtcgaggaacggaggtacgtcgttaagtacgttacctacgtcgtactacgtactacgttaatacggtcgtacggtacggtttaccgtactttcctttacgttacggttcgttaccggttaaccggtaaccggttacggggaaacccgttaccgggtacccgtttacccggttacccgttaacgggtaccctaaaccccgaacccgggtaacccctaacccccaacccgtttcctccggttacccttaacccccgg

SEQ ID NO: 258643 - DNA, 240 bp, Homo sapiens
  misc_feature: GYAE6OF02I51XT.19.78.H01.1.454.CMB.1.raw
  modified_base (237)..(240): a, c, t, g, unknown or other
  misc_feature (237)..(240): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaacccactgtcactctgttcccaccctcctccacgagagtactgagcgggctggcaaggcgcatagnnnn

SEQ ID NO: 258644 - DNA, 237 bp, Homo sapiens
  misc_feature: GYAE6OF02GX5QB.19.78.H01.1.454.CMB.1.raw
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccactgtcactctgttcccgccctcctccacgagagtactgagcgggctggcaaggcgcatag

SEQ ID NO: 258645 - DNA, 238 bp, Homo sapiens
  misc_feature: GYAE6OF02GOS1R.19.78.H01.1.454.CMB.1.raw
  modified_base (238)..(238): a, c, t, g, unknown or other
  misc_feature (238)..(238): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccactgtcactctgttcccgccctcctccacgagagtactgagcgggctggcaaggcgcatagn

SEQ ID NO: 258646 - DNA, 239 bp, Homo sapiens; identical to SEQ ID NO: 258395
  misc_feature: GYAE6OF02JCT3P.19.78.H01.1.454.CMB.1.raw
  modified_base (237)..(239): a, c, t, g, unknown or other
  misc_feature (237)..(239): n is a, c, g, or t

SEQ ID NO: 258647 - DNA, 239 bp, Homo sapiens; identical to SEQ ID NO: 258411
  misc_feature: GYAE6OF02I5G65.19.78.H01.1.454.CMB.1.raw
  modified_base (238)..(239): a, c, t, g, unknown or other
  misc_feature (238)..(239): n is a, c, g, or t

SEQ ID NO: 258648 - DNA, 241 bp, Homo sapiens; identical to SEQ ID NO: 258417
  misc_feature: GYAE6OF02GLK52.19.78.H01.1.454.CMB.1.raw
  modified_base (238)..(241): a, c, t, g, unknown or other
  misc_feature (238)..(241): n is a, c, g, or t

SEQ ID NO: 258649 - DNA, 252 bp, Homo sapiens
  misc_feature: GYAE6OF02JIEHY.19.78.H01.1.454.CMB.1.raw
  modified_base (233)..(233): a, c, t, g, unknown or other
  misc_feature (233)..(233): n is a, c, g, or t
  modified_base (239)..(252): a, c, t, g, unknown or other
  misc_feature (239)..(252): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtctaggtcagcccaaggccaaccccactgtccactctcgttcccaccctcctccacgagagtactgagcgggctggcaaggcncatagnnnnnnnnnnnnnn

SEQ ID NO: 258650 - DNA, 239 bp, Homo sapiens
  misc_feature: GYAE6OF02F62E7.19.78.H01.1.454.CMB.1.raw
  modified_base (238)..(239): a, c, t, g, unknown or other
  misc_feature (238)..(239): n is a, c, g, or t
tcagtactctcgtgcacgaccggtgctcgatttagtgtgagtagtttgggtttggtgttctccactcccgccttgacgaggctgattactactgctgctcatatgcaggtcgtatctcttatgtcttcggaactgggaccaaggtcaccgtcctaggtcagcccaaggccaaccccactgtcactctgttcccaccctcctccacgagagtactgagcgggctggcaaggcgcatagnn

SEQ ID NO: 258651 - DNA, 500 bp, Homo sapiens
  misc_feature: GYAE6OF02GUUO2.19.78.H01.1.454.CMB.1.raw
  modified_base (494)..(494): a, c, t, g, unknown or other
  misc_feature (494)..(494): n is a, c, g, or t
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcagggtttctaatcgcttctctggctcaagtctggcaacacgcctccctgacaatctctgggctccaggctgaggacgaggctgattactactgctgctcatatgcaggtctatctcttatgtcttcggactgggaccaggtcaccgtctaggtcagcccaggcccaacccntcgcac

SEQ ID NO: 258652 - DNA, 262 bp, Homo sapiens
  misc_feature: GYAE6OF02IIJHZ.19.78.H01.1.454.CMB.1.raw
  modified_base (238)..(262): a, c, t, g, unknown or other
  misc_feature (238)..(262): n is a, c, g, or t
tcagtactctcgtgcacgaccggtgctcgatttagtgtgagtagtttgggtttgggtggtctccactcccgccttgacgaggctgattactactgctgctcatatgcaggtcgtatctcttatgtcttcggaactgggaccaaggtcaccgtcctaggtcagcccaaggccaaccccatgtcactctgttcccgccctcctccacgagagtactgagcgggctggcaaggcgcatagnnnnnnnnnnnnnnnnnnnnnnnnn

SEQ ID NO: 258653 - DNA, 242 bp, Homo sapiens; identical to SEQ ID NO: 258436
  misc_feature: GYAE6OF02H78K0.19.78.H01.1.454.CMB.1.raw
  modified_base (238)..(242): a, c, t, g, unknown or other
  misc_feature (238)..(242): n is a, c, g, or t

SEQ ID NO: 258654 - DNA, 265 bp, Homo sapiens
  misc_feature: GYAE6OF02GDQ15.19.78.H01.1.454.CMB.1.raw
  modified_base (185)..(185): a, c, t, g, unknown or other
  misc_feature (185)..(185): n is a, c, g, or t
  modified_base (208)..(208): a, c, t, g, unknown or other
  misc_feature (208)..(208): n is a, c, g, or t
  modified_base (257)..(257): a, c, t, g, unknown or other
  misc_feature (257)..(257): n is a, c, g, or t
  modified_base (261)..(265): a, c, t, g, unknown or other
  misc_feature (261)..(265): n is a, c, g, or t
tcagtactctcgtgcacgaccggtgctcgatttagtgtgagtagtttgggtttggtggtctccactcccgccttgacgaggctgattactactgctgctcatatgcaggtctatctcttatgtcgttacggaactgggaccaaggtccaccgtccgtaggtccacgacccaacggcccaaccctntgtccaccttcctccgttccccncctcctacgacgtagacgtacgtggacggcggtctggaccgaaggccanatgnnnnn

SEQ ID NO: 258655 - DNA, 502 bp, Homo sapiens
  misc_feature: GYAE6OF02FVXG2.19.78.H01.1.454.CMB.1.raw
  modified_base (370)..(370): a, c, t, g, unknown or other
  misc_feature (370)..(370): n is a, c, g, or t
  modified_base (496)..(496): a, c, t, g, unknown or other
  misc_feature (496)..(496): n is a, c, g, or t
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggcctcagggtttctaatcgcttctctggctccaagtctggcaacacggcctccngacaatctctgggctccaggctgaggacgaggctgattactactgctgctcatatgcaggtctatcttcttatgtcttcggaactgggaccaaggtcaccgtctagtcagcccaaggcccaacccnctgcac

SEQ ID NO: 258656 - DNA, 239 bp, Homo sapiens; identical to SEQ ID NO: 258418
  misc_feature: GYAE6OF02IYRTX.19.78.H01.1.454.CMB.1.raw
  modified_base (238)..(239): a, c, t, g, unknown or other
  misc_feature (238)..(239): n is a, c, g, or t

SEQ ID NO: 258657 - DNA, 250 bp, Homo sapiens
  misc_feature: GYAE6OF02IBEXN.19.78.H01.1.454.CMB.1.raw
  modified_base (239)..(250): a, c, t, g, unknown or other
  misc_feature (239)..(250): n is a, c, g, or t
tcagtactctcgtgcacgaccggtgctcgatttagtgtgagtagtttgggtttgggtggtctccactcccgccttgacgaggctgattactactgctgctcatatgcaggtcgtatctcttatgtcttcggaactgggaccaaggtcaccgtcctaggtcagcccaaggccaaccccactgtcactctgttcccaccctctccacgagagtactgagcgggctggcaaggcgacatagnnnnnnnnnnnn

SEQ ID NO: 258658 - DNA, 241 bp, Homo sapiens
  misc_feature: GYAE6OF02I9MHH.19.78.H01.1.454.CMB.1.raw
  modified_base (237)..(241): a, c, t, g, unknown or other
  misc_feature (237)..(241): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaacccactgtcactctgttcccgccctcctccacgagagtactgagcgggctggcaaggcgcatagnnnnn

SEQ ID NO: 258659 - DNA, 243 bp, Homo sapiens
  misc_feature: GYAE6OF02IW4AD.19.78.H01.1.454.CMB.1.raw
  modified_base (237)..(243): a, c, t, g, unknown or other
  misc_feature (237)..(243): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaaggccaaccccactgtcactctgttcccaccctcctccacgagtactgagcgggctggcaaggcgcatagnnnnnnn

SEQ ID NO: 258660 - DNA, 240 bp, Homo sapiens; identical to SEQ ID NO: 258409
  misc_feature: GYAE6OF02G3DAI.19.78.H01.1.454.CMB.1.raw
  modified_base (238)..(240): a, c, t, g, unknown or other
  misc_feature (238)..(240): n is a, c, g, or t

SEQ ID NO: 258661 - DNA, 266 bp, Homo sapiens
  misc_feature: GYAE6OF02IC0ZY.19.78.H01.1.454.CMB.1.raw
  modified_base (240)..(266): a, c, t, g, unknown or other
  misc_feature (240)..(266): n is a, c, g, or t
tcagtactctcgtgcacgaccggtgctcgatttagtgtgagtagtttgggtttggtggtctccacctcccgcttgacgaggctgattactactgctgctcatatgcaggtcgtatctcttatgtcttcggaactgggaccaaggtcaccgtcctaggtctagcccaaggccaacccctatgtcacctctgttcccacctcctccacgagagtactgaggcgggctggcaaggcgcatagnnnnnnnnnnnnnnnnnnnnnnnnnnn

SEQ ID NO: 258662 - DNA, 240 bp, Homo sapiens
  misc_feature: GYAE6OF02GG14K.19.78.H01.1.454.CMB.1.raw
  modified_base (238)..(240): a, c, t, g, unknown or other
  misc_feature (238)..(240): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccactgtcactctgttcccgccctcctccacgagagtactgagcgggctggcaaggcgcatagnnn

SEQ ID NO: 258663 - DNA, 502 bp, Homo sapiens
  misc_feature: GYAE6OF02GBIAQ.19.78.H01.1.454.CMB.1.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggtggttataactatgtctcctggtaccaacaacacccaggcaaggcccccaaagtcatgatttatgatgtcagtgagcggccctcaggggtccctgatcgcttctctggctccaagtctggcaacacggcctccctaaccatctctgggctccaggctgaggatgaggctgatttattactgctgctcatatgcaggcaggtacacgtttggtattcggcggaggaccaagctgaccgtctaggtcagcccaggctcgccccg

SEQ ID NO: 258664 - DNA, 506 bp, Homo sapiens
  misc_feature: GYAE6OF02HMESW.19.78.H01.1.454.CMB.1.raw
  modified_base (429)..(429): a, c, t, g, unknown or other
  misc_feature (429)..(429): n is a, c, g, or t
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctcctggtaccaacatcacccaaataaagcccccaaaactcatcatttatgatgccactaagcggcctcaggggtttctaatcgcttctctggctcaagtctggcaacacggcctccctgacaatcctctgggctcccaggctgaggacgaggctgattactactgctgctcatangcaggtcgtatctcttatgtcttgactgggacctaaggtcaccgtctaggcagccaacggccaaccccatcgtcacc

SEQ ID NO: 258665 - DNA, 243 bp, Homo sapiens
  misc_feature: GYAE6OF02HB95N.19.78.H01.1.454.CMB.1.raw
  modified_base (235)..(243): a, c, t, g, unknown or other
  misc_feature (235)..(243): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtctaggtcagcccaaggccaacccactgtcactctgttcccacctcctccacgagagtactgagcgggctggcaaggcgcatagnnnnnnnnn

SEQ ID NO: 258666 - DNA, 502 bp, Homo sapiens
  misc_feature: GYAE6OF02GRW4Q.19.78.H01.1.454.CMB.1.raw
  modified_base (297)..(297): a, c, t, g, unknown or other
  misc_feature (297)..(297): n is a, c, g, or t
  modified_base (370)..(370): a, c, t, g, unknown or other
  misc_feature (370)..(370): n is a, c, g, or t
  modified_base (415)..(415): a, c, t, g, unknown or other
  misc_feature (415)..(415): n is a, c, g, or t
  modified_base (493)..(493): a, c, t, g, unknown or other
  misc_feature (493)..(493): n is a, c, g, or t
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggtgttataactatgtctctgtaccaacaacaccagcaaggccccaaagtcatgatttangatgtcagtgagcggccctcgaggggtccctgatcgcttctctggctcaagtctgcaacacggcctcctaacntctctcggctcaggctgaggatggagctgattattactgctgctntatatgacaggcaggtactagtttggattcgggcggagggaccaagcgtgaccgtcgtaggtccagcccgaaggtccncgtcccccg

SEQ ID NO: 258667 - DNA, 241 bp, Homo sapiens; identical to SEQ ID NO: 258415
  misc_feature: GYAE6OF02IPZY0.19.78.H01.1.454.CMB.1.raw
  modified_base (238)..(241): a, c, t, g, unknown or other
  misc_feature (238)..(241): n is a, c, g, or t

SEQ ID NO: 258668 - DNA, 509 bp, Homo sapiens
  misc_feature: GYAE6OF02IFWNN.19.78.H01.1.454.CMB.1.raw
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaccagcagtgatgtgaattctaacttgtctctggtaccaacatcacccaaataaagcccccaaaactcatcatttatgatgccactaagcggccctcaggggtttctaatcgcttctctggctccaagtctggcaacacgcctcctgacaatctctgggctccaggctgaggacgagctgattactactgctgctcatatgcaggtctattcttcttatgtcttcggaactgggacctaaggtcaccggtctacggtcacgcccaaggcccaacccgctcgctac

SEQ ID NO: 258669 - DNA, 243 bp, Homo sapiens
  misc_feature: GYAE6OF02HY4WI.19.78.H01.1.454.CMB.1.raw
  modified_base (238)..(243): a, c, t, g, unknown or other
  misc_feature (238)..(243): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccactgtcactctgttcccgccctcctccacgagagtactgagcgggctggcaaggcgcatagnnnnnn

SEQ ID NO: 258670 - DNA, 240 bp, Homo sapiens; identical to SEQ ID NO: 258409
  misc_feature: GYAE6OF02G4LMH.19.78.H01.1.454.CMB.1.raw
  modified_base (238)..(240): a, c, t, g, unknown or other
  misc_feature (238)..(240): n is a, c, g, or t

SEQ ID NO: 258671 - DNA, 242 bp, Homo sapiens
  misc_feature: GYAE6OF02I1JOB.19.78.H01.1.454.CMB.1.raw
  modified_base (236)..(242): a, c, t, g, unknown or other
  misc_feature (236)..(242): n is a, c, g, or t
tcagtactctcgtgcacgaccggtgctcgatttagtgtgagtagttggtttggtggtcgtccactcccgccttgacgaggctgattactactgctgctcatatgcaggtcgtatctcttatgtcttcggaactgggaccaaggtcaccgtcctaggtcagcccaaggccaacccactgtcactctgttcccgccctcctccacgagagtactgagcgggctggcaaggcgcatagnnnnnnn

SEQ ID NO: 258672 - DNA, 503 bp, Homo sapiens
  misc_feature: GYAE6OF02HFFXO.19.78.H01.1.454.CMB.1.raw
  modified_base (438)..(438): a, c, t, g, unknown or other
  misc_feature (438)..(438): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagcggccctcagggtttctaatcgcttctctggctcaagtctggcaacacgcctcctgacatctctggctcaggctgagacgaggctgattactactgctgctcatatgcaggtctatcttnttatgtcttcgactggaccaggtccaccgtctaggtcacgcccaacggcccaacccatcgctacc

SEQ ID NO: 258673 - DNA, 533 bp, Homo sapiens
  misc_feature: GYAE6OF02GUDL4.19.78.H01.1.454.CMB.1.raw
  modified_base (306)..(306): a, c, t, g, unknown or other
  misc_feature (306)..(306): n is a, c, g, or t
  modified_base (424)..(424): a, c, t, g, unknown or other
  misc_feature (424)..(424): n is a, c, g, or t
  modified_base (522)..(522): a, c, t, g, unknown or other
  misc_feature (522)..(522): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaacccaaataaagccccccaaatcatcatttangatgccactaagcggcctcagggtttctaatcgcttctctggctccaagtctggcaacacggcctccctgacatctctggctcaggctgaggacgagctgattacactgctgctcatntgctaggtcttatctctttagtcgttcgttacggaacgttcgggaacctaaggtcctaaccgttccgtaggtccacgacccgaacggcccaaccccgntacgtcctacc

SEQ ID NO: 258674 - DNA, 282 bp, Homo sapiens
  misc_feature: GYAE6OF02JT9E1.19.78.H01.1.454.CMB.1.raw
  modified_base (241)..(242): a, c, t, g, unknown or other
  misc_feature (241)..(242): n is a, c, g, or t
  modified_base (244)..(255): a, c, t, g, unknown or other
  misc_feature (244)..(255): n is a, c, g, or t
  modified_base (257)..(282): a, c, t, g, unknown or other
  misc_feature (257)..(282): n is a, c, g, or t
tcagtactctcgtgcacgaccggtgctcgatttagtgtgagtagttggtttggtggtcgtccactcccgccttgacgaggctgattacctactgctgtctcatatgcaggtctatctcttatgtcttcgggaactgggaccaaggtcaccgtcctaggtccagcccaaggccaacccactgtcactctgttcccgcctccgtccacgagtagtactgagcgggctggcaaggcgctatagnnannnnnnnnnnnnannnnnnnnnnnnnnnnnnnnnnnnnn

SEQ ID NO: 258675 - DNA, 505 bp, Homo sapiens
  misc_feature: GYAE6OF02F7FS6.19.78.H01.1.454.CMB.1.raw
  modified_base (500)..(500): a, c, t, g, unknown or other
  misc_feature (500)..(500): n is a, c, g, or t
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggactgggaccaaggtcaccgtcctaggtcagcccaaggcccaacccntgcac

SEQ ID NO: 258676 - DNA, 545 bp, Homo sapiens
  misc_feature: GYAE6OF02IKJWQ.19.78.H01.1.454.CMB.1.raw
  modified_base (374)..(374): a, c, t, g, unknown or other
  misc_feature (374)..(374): n is a, c, g, or t
  modified_base (382)..(382): a, c, t, g, unknown or other
  misc_feature (382)..(382): n is a, c, g, or t
  modified_base (437)..(437): a, c, t, g, unknown or other
  misc_feature (437)..(437): n is a, c, g, or t
  modified_base (533)..(533): a, c, t, g, unknown or other
  misc_feature (533)..(533): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctctggtaccaacatcaaccaaataacgcccccaaactcatctatttatgatcgccaactaacgccgtcctcgtagggtttactaatcgtacttctctggctcaagtctggacaacncgcctccngacaatctctggcctacgaggctgaggacgaggctagattacatgactgctcatncgctaggtctatcttcttagtcgttccgttacggactcgggaacctacggtcctaccggttctaggtcaccggtacccgaacggacccaacccgtntcgtacctaccg

SEQ ID NO: 258677 - DNA, 244 bp, Homo sapiens
  misc_feature: GYAE6OF02JT9HW.19.78.H01.1.454.CMB.1.raw
  modified_base (237)..(244): a, c, t, g, unknown or other
  misc_feature (237)..(244): n is a, c, g, or t
tcagtactctcgtgcacgaccggtgctcgatttagtgtgagtagttgggtttggtggtctccactcccgccttgacgaggctgattactactgctgctcatatgcaggtcgtatctcttatgtcttcggaactgggaccaaggtcaccgtcctaggtcagcccaaggccaacccactgtcactctgttcccgccctcctccacgagacgtactgagcgggctggcaaggcgcatagnnnnnnnn

SEQ ID NO: 258678 - DNA, 240 bp, Homo sapiens; identical to SEQ ID NO: 258409
  misc_feature: GYAE6OF02GNT8D.19.78.H01.1.454.CMB.1.raw
  modified_base (238)..(240): a, c, t, g, unknown or other
  misc_feature (238)..(240): n is a, c, g, or t

SEQ ID NO: 258679 - DNA, 243 bp, Homo sapiens; identical to SEQ ID NO: 258669
  misc_feature: GYAE6OF02HD5NM.19.78.H01.1.454.CMB.1.raw
  modified_base (238)..(243): a, c, t, g, unknown or other
  misc_feature (238)..(243): n is a, c, g, or t

SEQ ID NO: 258680 - DNA, 253 bp, Homo sapiens
  misc_feature: GYAE6OF02H781U.19.78.H01.1.454.CMB.1.raw
  modified_base (232)..(232): a, c, t, g, unknown or other
  misc_feature (232)..(232): n is a, c, g, or t
  modified_base (238)..(253): a, c, t, g, unknown or other
  misc_feature (238)..(253): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccactgtcactctgttcccaccctcctccacgagagtactgagcgggctggcaaggcncatagnnnnnnnnnnnnnnnn

SEQ ID NO: 258681 - DNA, 622 bp, Homo sapiens
  misc_feature: GYAE6OF02JPU5O.19.78.H01.1.454.CMB.1.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactcggaaccagcagtgatagttgaattctaaccttgtctcctgtaccaacactacaacccaaactaaacgaccccaaactacactactattatagatacgaccactaacgccggtacccgtacgtacgggttactaactcgtcttcgtctcgtactacctaacgtcgtacgacgaacaccgtcctcctacgtactaactcgtcgtcggtcgtccgtacggcgtacggaggacggacggtacgtacgtacgttacgtacgtcgtcgtcgtctactatactacgtcgtacgttacgttacttcttacttacgttcgttacgttacggtacgtacggtaccgtaacggtaccgtaccgtaccgtacgtacgacgacccgaaccgacccgaaccctaccgtacgtacc

SEQ ID NO: 258682 - DNA, 239 bp, Homo sapiens; identical to SEQ ID NO: 258418
  misc_feature: GYAE6OF02FV26I.19.78.H01.1.454.CMB.1.raw
  modified_base (238)..(239): a, c, t, g, unknown or other
  misc_feature (238)..(239): n is a, c, g, or t

SEQ ID NO: 258683 - DNA, 247 bp, Homo sapiens
  misc_feature: GYAE6OF02IX49O.19.78.H01.1.454.CMB.1.raw
  modified_base (239)..(247): a, c, t, g, unknown or other
  misc_feature (239)..(247): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccactgtcactctcgttccccaccctcctccacgagagtactgagcggctggcaaggcgcatagnnnnnnnnn

SEQ ID NO: 258684 - DNA, 501 bp, Homo sapiens
  misc_feature: GYAE6OF02GFV90.19.78.H01.1.454.CMB.1.raw
  modified_base (371)..(371): a, c, t, g, unknown or other
  misc_feature (371)..(371): n is a, c, g, or t
  modified_base (491)..(491): a, c, t, g, unknown or other
  misc_feature (491)..(491): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctcctggtaccaacatcaccaaataaacgcccccaaactcatcatttatgatgccactaagcggcctcgagggtttctaatcgcttctctgctcaagtctggcaacacggcctccngacaatctctggctcgagctgagacgagctgattactactgctgctcatatgcaggtctatcttcttatgtcttcgacgtggaccaaggtcaccgtctaggtcacgccaacgcccacccnctcgctaccg

SEQ ID NO: 258685 - DNA, 277 bp, Homo sapiens
  misc_feature: GYAE6OF02IZI6O.19.78.H01.1.454.CMB.1.raw
  modified_base (215)..(215): a, c, t, g, unknown or other
  misc_feature (215)..(215): n is a, c, g, or t
  modified_base (250)..(277): a, c, t, g, unknown or other
  misc_feature (250)..(277): n is a, c, g, or t
tcagtactctcgtgcacgaccggtgctcgatttagtgtgagtagttggtttggtggtctccgactacccgccttcgacgaggctgacttactactgctgctcatatgcaggtcgtatctcttatgttcttcgggaactgggaccaaggtcaccgtcctaggtcagcccaaggcctaaccccactggtcactctcgttcccaccctcctccacganagtacctgagcgggtctggacaaggcgtcatagcnnnnnnnnnnnnnnnnnnnnnnnnnnnn

SEQ ID NO: 258686 - DNA, 257 bp, Homo sapiens
  misc_feature: GYAE6OF02GD2HK.19.78.H01.1.454.CMB.1.raw
  modified_base (240)..(257): a, c, t, g, unknown or other
  misc_feature (240)..(257): n is a, c, g, or t
tcagtactctcgtgcacgaccggtgctcgatttagtgtgagtagtttgggtttggtggtctccactacccgccttgacgaggctgattactactgctgctcatatgcaggtcgtatctcttatgtcttcggaactgggaccaaggtcaccgtcctaggtcagcccaaggccaaccccactgtcactctgttccccgccctcctccacgagagtactgagcgggctggcaaggcgcatagnnnnnnnnnnnnnnnnnn

SEQ ID NO: 258687 - DNA, 241 bp, Homo sapiens; identical to SEQ ID NO: 258417
  misc_feature: GYAE6OF02GG1VK.19.78.H01.1.454.CMB.1.raw
  modified_base (238)..(241): a, c, t, g, unknown or other
  misc_feature (238)..(241): n is a, c, g, or t

SEQ ID NO: 258688 - DNA, 239 bp, Homo sapiens; identical to SEQ ID NO: 258411
  misc_feature: GYAE6OF02FS1C4.19.78.H01.1.454.CMB.1.raw
  modified_base (238)..(239): a, c, t, g, unknown or other
  misc_feature (238)..(239): n is a, c, g, or t

SEQ ID NO: 258689 - DNA, 243 bp, Homo sapiens; identical to SEQ ID NO: 258462
  misc_feature: GYAE6OF02HAPTV.19.78.H01.1.454.CMB.1.raw
  modified_base (238)..(243): a, c, t, g, unknown or other
  misc_feature (238)..(243): n is a, c, g, or t

SEQ ID NO: 258690 - DNA, 241 bp, Homo sapiens; identical to SEQ ID NO: 258417
  misc_feature: GYAE6OF02F078O.19.78.H01.1.454.CMB.1.raw
  modified_base (238)..(241): a, c, t, g, unknown or other
  misc_feature (238)..(241): n is a, c, g, or t

SEQ ID NO: 258691 - DNA, 547 bp, Homo sapiens
  misc_feature: GYAE6OF02H3DG7.19.78.H01.1.454.CMB.1.raw
  modified_base (378)..(378): a, c, t, g, unknown or other
  misc_feature (378)..(378): n is a, c, g, or t
  modified_base (429)..(429): a, c, t, g, unknown or other
  misc_feature (429)..(429): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaaataaacgccccccaaactcatcatttatgatgccactaagcggccctcgagggtttctaatcgcttctctggctccaagtctggcaacacgcctccngacaatctctggctccaggctggagacgaggctgtattactactgctgctnatntcganaggtcttatcttctttagtcgttcgttacggaactgggaacccaagggtccacccggttcctaaggtccaacggcccgaacggaccccaacccctactcggtacctaccg

SEQ ID NO: 258692 - DNA, 254 bp, Homo sapiens
  misc_feature: GYAE6OF02H3K0V.19.78.H01.1.454.CMB.1.raw
  modified_base (238)..(254): a, c, t, g, unknown or other
  misc_feature (238)..(254): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcgtaactgggaccaaggtcaccgtcctaggtcagcccaaggccaacccactgtcactctgttcccgccctcctccacgacgagtactgagcgggctggcaaggcgcatagnnnnnnnnnnnnnnnnn

SEQ ID NO: 258693 - DNA, 691 bp, Homo sapiens
  misc_feature: GYAE6OF02IPSH6.19.78.H01.1.454.CMB.1.raw
  modified_base (268)..(268): a, c, t, g, unknown or other
  misc_feature (268)..(268): n is a, c, g, or t
  modified_base (301)..(301): a, c, t, g, unknown or other
  misc_feature (301)..(301): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctctgtaccaanactcaccaaataacgccccaaatcatcatttangatcaccactaacgccgcctcgtagggtttctaatcgtcttctctggcctcaagtctcggacaacgacgcctccctagacctaactctcgtcgggctaccgaggctaggacggaacggacgggtctacggtaactttacctacgtcgtccgttacgccttacaagttactcgggtaaccgttacgggttacgtttactttaccgtttactttaacgtttccgttaccggttttaacccggggtaaacgttacccgggggtaaccccgttaaaccggggtttccccgtaacccccgggtttaccgttaaccggggttacccaaccggtaaccccccggtaaacgggtacccccctaaacccccgtacgtttacccggtaccccttaacccg

SEQ ID NO: 258694 - DNA, 521 bp, Homo sapiens
  misc_feature: GYAE6OF02IURWA.19.78.H01.1.454.CMB.1.raw
  modified_base (394)..(394): a, c, t, g, unknown or other
  misc_feature (394)..(394): n is a, c, g, or t
  modified_base (423)..(423): a, c, t, g, unknown or other
  misc_feature (423)..(423): n is a, c, g, or t
  modified_base (511)..(511): a, c, t, g, unknown or other
  misc_feature (511)..(511): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcagggtttctaatcgcttctctggctccaagtctggcaacacgcctccctgacatctctgggctcagcngaggacgaggctgattactactgctgctnatatgctaggtctattctcttagtcgttctacggaactgggaacctaggtcctaccgtccgtagtccacgcccgaaggcccaaccccnctcgtctacc

SEQ ID NO: 258695 - DNA, 238 bp, Homo sapiens; identical to SEQ ID NO: 258443
  misc_feature: GYAE6OF02F7VNZ.19.78.H01.1.454.CMB.1.raw
  modified_base (238)..(238): a, c, t, g, unknown or other
  misc_feature (238)..(238): n is a, c, g, or t

SEQ ID NO: 258696 - DNA, 240 bp, Homo sapiens; identical to SEQ ID NO: 258409
  misc_feature: GYAE6OF02GAWX9.19.78.H01.1.454.CMB.1.raw
  modified_base (238)..(240): a, c, t, g, unknown or other
  misc_feature (238)..(240): n is a, c, g, or t

SEQ ID NO: 258697 - DNA, 240 bp, Homo sapiens; identical to SEQ ID NO: 258662
  misc_feature: GYAE6OF02G86CG.19.78.H01.1.454.CMB.1.raw
  modified_base (238)..(240): a, c, t, g, unknown or other
  misc_feature (238)..(240): n is a, c, g, or t

SEQ ID NO: 258698 - DNA, 242 bp, Homo sapiens
  misc_feature: GYAE6OF02HD209.19.78.H01.1.454.CMB.1.raw
  modified_base (239)..(242): a, c, t, g, unknown or other
  misc_feature (239)..(242): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccactgtcactctgttcccacccctcctccacgagagtactgagcgggctggcaaggcgcatagnnnn

SEQ ID NO: 258699 - DNA, 517 bp, Homo sapiens
  misc_feature: GYAE6OF02JHWTZ.19.78.H01.1.454.CMB.1.raw
  modified_base (442)..(442): a, c, t, g, unknown or other
  misc_feature (442)..(442): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtacaacatcaccaaataaacgcccccaaactcatcattatgatgccactaagcgccctcagggtttctaatcgtcttctctggctccaagtctggcaacacggcctccctgacaatctctggctccaggctgagacgaggctgattacactgctgctcatatgcaggtctatcttcttancgttcttacggaacttggaccaaggtcaaccgtcgtacggtcacgcccaacggcccaaccccgtactcgctaccg

SEQ ID NO: 258700 - DNA, 241 bp, Homo sapiens; identical to SEQ ID NO: 258417
  misc_feature: GYAE6OF02GIT19.19.78.H01.1.454.CMB.1.raw
  modified_base (238)..(241): a, c, t, g, unknown or other
  misc_feature (238)..(241): n is a, c, g, or t

SEQ ID NO: 258701 - DNA, 538 bp, Homo sapiens
  misc_feature: GYAE6OF02IOHDN.19.78.H01.1.454.CMB.1.raw
  modified_base (302)..(302): a, c, t, g, unknown or other
  misc_feature (302)..(302): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaccagcagtgatgttggaaattctaacttgtctctgtaccaacatcaccaaataaacgcccccaaactcatcatttanagatgccaactaagccggccctacgtagggtttactaatcgcttctctgctcaagtctggcaacgacgcctcctgactaatctacgtggcctccgaggctggacggacgaggctgacttactacgtgctgctcatatgctaggtctactcttacttagtgtccttaggaactgggaacctaggtctaccgtcgtaggtccaacgacccaacggccccaacccgtactcgactaccg

SEQ ID NO: 258702 - DNA, 559 bp, Homo sapiens
  misc_feature: GYAE6OF02ISSLN.19.78.H01.1.454.CMB.1.raw
  modified_base (431)..(431): a, c, t, g, unknown or other
  misc_feature (431)..(431): n is a, c, g, or t
  modified_base (436)..(436): a, c, t, g, unknown or other
  misc_feature (436)..(436): n is a, c, g, or t
  modified_base (439)..(439): a, c, t, g, unknown or other
  misc_feature (439)..(439): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttgaaattctaaccttgtctctggtaccaacatcaacccaaataaacgcccccaaactcatcatttatgatgccactaacgcggccctcgtagggtttctaagtcgtcttctctgctccaagtctagcaacacgcctccctgacaactctcgtcggctccgaggtctggaggacgagctgacttactactgctncgtanatntgacgtagttcgtacttcttacttagttcgttccgttacgtaacgtcgggaacctaacggtcctacccggtcgtacgtcgaccgacccgaacggaccccaacccgtctacgtcctacccg

SEQ ID NO: 258703 - DNA, 512 bp, Homo sapiens
  misc_feature: GYAE6OF02HNKPD.19.78.H01.1.454.CMB.1.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctcctggtaccaacatcacccaaataaagcccccaaactcatcatttatgatgccactaagcgccctcagggtttctaatcgcttctctggctcaagtctggcaacaggcctcctgacaatctctgggctccaggttgaggacgagctgattactactgctgctcatatgcaggtctatctcttgtgttcttcggaatcgggacaaggtccaccgtcctaggtcacgcccaaggcccaaccccgctgtcctacttccg

SEQ ID NO: 258704 - DNA, 520 bp, Homo sapiens
  misc_feature: GYAE6OF02FMA8C.19.78.H01.1.454.CMB.1.raw
  modified_base (443)..(443): a, c, t, g, unknown or other
  misc_feature (443)..(443): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaatttctaaccttgtctcctggtaccaacatcacccaaataaacgacccccaaactcatcatttatgatgaccactaagcggccctcgaggggtttctaatcgcttctctgctcatctgcacacgcctcctgacatctctgggctccgagcgtgaggacgaggctgattactactgctgctcatatgcagtcgtattctnttatgttctggactggacctaggtccaccgtcctaggtccacgacccgacggtaccccaacccactcgtacctaccg

SEQ ID NO: 258705 - DNA, 563 bp, Homo sapiens
  misc_feature: GYAE6OF02GNRDU.19.78.H01.1.454.CMB.1.raw
  modified_base (487)..(487): a, c, t, g, unknown or other
  misc_feature (487)..(487): n is a, c, g, or t
  modified_base (552)..(552): a, c, t, g, unknown or other
  misc_feature (552)..(552): n is a, c, g, or t
tcagtactctcgtgcacgaccggtgctcgatttagtgtgagtagtttggggtttgggggggggtcacaagaggcagcgctctcgggacgtctccaccatccgggggggggggggggggggggggggggggggtctctgctgctcctcactctcctcactcaggacacagggtcctgggcccagtctgccctgactcagtctgcctccgtgtctgggtctcctggacagtcggtcaccatctcctgcactggaaccagcagtgattgttaggtaaattactaaccttgtctcctggtaccaacatcaacccaaaataaacgccccccaaactcatcatttatgatgccactaagccggccctcaggggtttctaatcgcttctctggctcaagtctggcaacacgcctccctgacaatctctgggctccgaggctggaggacgaggctagattacttactgctgctcatatgcgtaggtctattcttntttatgttcgttacgaacgtgggaccaggtccaccgttcaggtcacggacccaggccccaacccnctcgtactacc

SEQ ID NO: 258706 - DNA, 574 bp, Homo sapiens
  misc_feature: GYAE6OF02G8RSI.19.78.H01.1.454.CMB.1.raw
  modified_base (306)..(306): a, c, t, g, unknown or other
  misc_feature (306)..(306): n is a, c, g, or t
  modified_base (374)..(374): a, c, t, g, unknown or other
  misc_feature (374)..(374): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaaccttgtctcctggtaccaacatcaaccaaataaacgcccccaaatcatcatttangatgaccactaacgccggccctgtagggtttctaatcgcttctctgctcagtctgcaacacgcctccngacatctcgtggcctcgaggctaggaggacgagctagtattactactgctgcctacatacgtgacgtaggtcttattcttcttagttcgttaccgttacgggaacttacggggaaccctaagggttccctaccggttaccgttaacggtaccgaccgaccccgaacggtaccccaaccccgtacgttccgtaccctaccg

SEQ ID NO: 258707 - DNA, 554 bp, Homo sapiens
  misc_feature: GYAE6OF02GANH4.19.78.H01.1.454.CMB.1.raw
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctcctgtaccaacatcaccaaataaacgcccccaaactcatcattatgatgccactaagccgccctcgaggggtttctaatcgtcttctctggctccagtctgcaacacgcctccctgacaactctctgggctccgaggctgaggacgaggctgattactactgctgctcatatgcgaggtctatcttacttagtcgttcgttacggaacgtcgggacctaagggtccctaaccggttaccgtacgggttaccaacggaccccgaacggaccccaaccccgtcgttcgtacctacccg

SEQ ID NO: 258708 - DNA, 241 bp, Homo sapiens
  misc_feature: GYAE6OF02IAV3V.19.78.H01.1.454.CMB.1.raw
  modified_base (193)..(193): a, c, t, g, unknown or other
  misc_feature (193)..(193): n is a, c, g, or t
  modified_base (236)..(241): a, c, t, g, unknown or other
  misc_feature (236)..(241): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccatgtcactctgttcccnccctctccacgagagtactgagcgggctggcaaggcgcatagnnnnnn

SEQ ID NO: 258709 - DNA, 518 bp, Homo sapiens
  misc_feature: GYAE6OF02HVD0J.19.78.H01.1.454.CMB.1.raw
  modified_base (199)..(199): a, c, t, g, unknown or other
  misc_feature (199)..(199): n is a, c, g, or t
  modified_base (354)..(354): a, c, t, g, unknown or other
  misc_feature (354)..(354): n is a, c, g, or t
  modified_base (360)..(360): a, c, t, g, unknown or other
  misc_feature (360)..(360): n is a, c, g, or t
  modified_base (376)..(376): a, c, t, g, unknown or other
  misc_feature (376)..(376): n is a, c, g, or t
  modified_base (386)..(386): a, c, t, g, unknown or other
  misc_feature (386)..(386): n is a, c, g, or t
  modified_base (411)..(411): a, c, t, g, unknown or other
  misc_feature (411)..(411): n is a, c, g, or t
  modified_base (414)..(414): a, c, t, g, unknown or other
  misc_feature (414)..(414): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
  modified_base (432)..(432): a, c, t, g, unknown or other
  misc_feature (432)..(432): n is a, c, g, or t
  modified_base (435)..(435): a, c, t, g, unknown or other
  misc_feature (435)..(435): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacngtcggtcaccatctcctgcactggaaccagcagtgattgttggaaattctaaccttgtcctctggtaccaacatcaccaaataaacgcccccaaactcactcactttatgatgccactaagcgcctcagggtttcaatcgctctctgctcagtcngcaacncgcctcctgacatctntggctcagcngagacgaggctgattactactgctnctnatngacngtctactcttnttntgtccttcggagtacgggactaacggtctaacccgtcgtacggtcacgacccgaacggcccaaccccgcttcgtaccctaccg

SEQ ID NO: 258710 - DNA, 691 bp, Homo sapiens
  misc_feature: GYAE6OF02H6L8M.19.78.H01.1.454.CMB.1.raw
  modified_base (232)..(232): a, c, t, g, unknown or other
  misc_feature (232)..(232): n is a, c, g, or t
  modified_base (269)..(269): a, c, t, g, unknown or other
  misc_feature (269)..(269): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctccgtggacaggtcggtcaccatctcctgcacgtggaaccngcagtgatgttgaattctaacttgtctctgtaccaanatcaccaaataacgccccaaatcatctatttatgatcgaccactaacgccggccctcgtacgggtttctaatcgtcttctcgtcggtctaccaagtctcggacaacgccggtccctcctagaacctaacttcctcgtcggccttaccgacggtcgtacggacgggacgacgggtcttggtaactttaaccgttaccgttacgccgttcggtccttacgtaacttacgttacggtaccggttaacgggtttaccgttacgttccgttttactttacggttccgtttaacccggtttaccgggtaaccgttacggggtaacccttaacggggtccctaaccccgggtttaccgtacgggtacccgtaccggaaccccgtaaacgggacccccctaaaccccggtacttaccggtaccttacccg

SEQ ID NO: 258711 - DNA, 243 bp, Homo sapiens; identical to SEQ ID NO: 258669
  misc_feature: GYAE6OF02FGXN9.19.78.H01.1.454.CMB.1.raw
  modified_base (238)..(243): a, c, t, g, unknown or other
  misc_feature (238)..(243): n is a, c, g, or t

SEQ ID NO: 258712 - DNA, 595 bp, Homo sapiens
  misc_feature: GYAE6OF02I4F8J.19.78.H01.1.454.CMB.1.raw
  modified_base (199)..(199): a, c, t, g, unknown or other
  misc_feature (199)..(199): n is a, c, g, or t
  modified_base (228)..(228): a, c, t, g, unknown or other
  misc_feature (228)..(228): n is a, c, g, or t
  modified_base (265)..(265): a, c, t, g, unknown or other
  misc_feature (265)..(265): n is a, c, g, or t
  modified_base (374)..(374): a, c, t, g, unknown or other
  misc_feature (374)..(374): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacngtcggtcaccatctcctgcactggaaccngcagtgatgtagaaattctaacttgtctctgtacaanatcaaccaaataaacgccccaaactcatcaatttatgatcgacctactaagccggaccctcgtagggtttctaatcgcttctctgctcaagtctgacacacgcctcctnacatctctgggctcgagctgacggacgaggtctagtatttacctactggtctcgctacgacttagcgtacgtacggttcgttattcctttacttagtttacgtcgttaacgggtaccgtacggggtaacctaagggttcctaacccggttaccgttaccggtaccgtacgtaacccccgaacggtaccccaaacccccggtacttacggtacccttacccg

SEQ ID NO: 258713 - DNA, 505 bp, Homo sapiens
  misc_feature: GYAE6OF02FYQMS.19.78.H01.1.454.CMB.1.raw
  modified_base (417)..(417): a, c, t, g, unknown or other
  misc_feature (417)..(417): n is a, c, g, or t
  modified_base (496)..(496): a, c, t, g, unknown or other
  misc_feature (496)..(496): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttggaaattctaaccttgtctcctggtaccaacatcacccaaataaagcccccaaactcatcatttatgatgccactaagcgcctcagggtttctaatcgcttctctggctccaagtctgcaacacggcctccctgacaatctctgggctccgaggctgaggacgaggctgattactactnctgctcatatgctagtctatcttcttatgtcttcggaactggaccaggtccaccgtctagtcagcccaagcccaacccnctcgctacc

SEQ ID NO: 258714 - DNA, 523 bp, Homo sapiens
  misc_feature: GYAE6OF02HEYDN.19.78.H01.1.454.CMB.1.raw
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctggtaccaacatcacccaaataaacgccccccaaactcatcatttatgatgccactaagcggccctcaggggtttctaatcgcttctctgctcaagtctggcaacacgcctcctgacaatctcgtggctccaggctggaggacgaggctgattactactgctgctcattatgcaggtcgtattcgttctttatcgttcttcgaacgtggaccaggtccaccgtctagcgacgcccaacggacccaaccccatcgtctaccg

SEQ ID NO: 258715 - DNA, 506 bp, Homo sapiens
  misc_feature: GYAE6OF02G6PKL.19.78.H01.1.454.CMB.1.raw
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctcaagtctggcaacacgcctccctgacaatctctgggctccaggctgaggacgaggctgattactactgctgctcatatgcaggtcgtatctcttatgtcttcggactggaccaggtcaccgtctagtcagcccgaggcccaacccactgtctacc

SEQ ID NO: 258716 - DNA, 613 bp, Homo sapiens
  misc_feature: GYAE6OF02I0OWF.19.78.H01.1.454.CMB.1.raw
  modified_base (245)..(245): a, c, t, g, unknown or other
  misc_feature (245)..(245): n is a, c, g, or t
  modified_base (326)..(326): a, c, t, g, unknown or other
  misc_feature (326)..(326): n is a, c, g, or t
tcagtactctcgtgcacgaccggtgctcgatttagtgtgagtagtttgggttgggggggggtcacgaacgaggcagcgctctcgggacgtctccacccatggcctgggcgtcctggctgcgtcctcactctcctcactcagggacacacgggtcctagggcccaggtctgccctgactcagtctcgcctccgtgtctggtctcctggaccagtccgtcacctattctcctgacactcggaacccngcgagtgactgttgaaattctaaccttgtactcctggtaccaacatcaccccaaataaacgcccccaaactcatcatttangatgcactagcgcctcagggtttctaactcgcttctctggctaccaagtctcggactaacgacggtcccttccctagtacctaacttcgtcgtacgggcctaccgagggtcctacggacggacgacggctacgacttaacctactgtcctgtcctctaactactcgactacggtcgttacttccgttactttagtacgttccgttacggaaccgtacgggtaaccgtaaggtcctaccggttctaacggtccacgcccaacggcccaacccgtactcgtacctaccg

SEQ ID NO: 258717 - DNA, 754 bp, Homo sapiens
  misc_feature: GYAE6OF02F6YOS.19.78.H01.1.454.CMB.1.raw
  modified_base (207)..(207): a, c, t, g, unknown or other
  misc_feature (207)..(207): n is a, c, g, or t
  modified_base (237)..(237): a, c, t, g, unknown or other
  misc_feature (237)..(237): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctggggccccagtcctcgccctgactcagtctcgccctccgtgtcgtggtcctcgtggacngtcgtcactctcctctgcacgtacgaaccngctagtgtagttggttaagtaactttaccttaacgtttcgttccttccgttacggtaacccaaactacttacccaaaaccctaaaaacgtaaaccccgaacccccctaaacctactacttaccttaagttttagtagtactaccgacctaaacgtaacgggcccggtcccttacgggttacggggttttactaacgtccgttccttcctcgtcggtcctactaacgtcgtacgacaaccgaccgtccctccgtagaactactcgtcgtcggtcctacgcggtctaggacggacggaggtctagtaacttactacgtcgtcgtcgtccttacgtaagttagtcggtacgttacgggttaccgttattaccgttactttacgttcggtttaccggttacgggtaaccggtaccgggtaaccgtaaccgggttcccgtaacccggttaccggtacggtaccgaacccggtaccccggaaaccggtaccccctaaacccgtcgttccgtacccttacccgg

SEQ ID NO: 258718 - DNA, 578 bp, Homo sapiens
  misc_feature: GYAE6OF02IC6NX.19.78.H01.1.454.CMB.1.raw
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctggtaccaacatcaccaaataaacgcccccaaatcatcatttatgatgccactaagcggaccctcgagggtttctaatcgcttctctggctccaagtctgacaacgacggcctccctgacaatcctcgtgggcctccaggctaggaggacgaggctaggattactactgctgctcatagtgacgtaggtcgttatcgttacttagtcgttccgttacggaaccgttcgggaacccttaagggtccaacccggttcctacgggttacccacggtaccccgaacgggtaccccaaacccccgtacgttaccgtacctacccg

SEQ ID NO: 258719 - DNA, 517 bp, Homo sapiens
  misc_feature: GYAE6OF02G538P.19.78.H01.1.454.CMB.1.raw
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcagggtttctaatcgcttctctggctccaagtctggcaacacggcctccctgacaatctctgggcctccgaggctgaggacgaggctgattactactgctgctcatatgcaggtcgtatctcttatcgtcttcggaactgggacctaggtcaccgtcctaggtcagcccacggcccaacccactcgtctacc

SEQ ID NO: 258720 - DNA, 517 bp, Homo sapiens
  misc_feature: GYAE6OF02HEWRC.19.78.H01.1.454.CMB.1.raw
  modified_base (431)..(431): a, c, t, g, unknown or other
  misc_feature (431)..(431): n is a, c, g, or t
  modified_base (506)..(506): a, c, t, g, unknown or other
  misc_feature (506)..(506): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctcctggtaccaacatcaacccaaataaacgcccccaaactcatcatttatgatgccactaagcgcctcagggtttctaatcgcttctctggctcaagtctggcaacacgcctcctagacaatctctcggctccgagctgaggacgaggcctgattactactgctgctacatacngactagtctatctcttatgtctacggatcggaactacggtcaccgttctacggtcacgcccaacggcccaacccnttcgactaccg

SEQ ID NO: 258721 - DNA, 568 bp, Homo sapiens
  misc_feature: GYAE6OF02HMW1N.19.78.H01.1.454.CMB.1.raw
  modified_base (301)..(301): a, c, t, g, unknown or other
  misc_feature (301)..(301): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaattctaacttgtctctggtaccaacatcaccaaataaacgcccccaaatcatcatttangatgccactaagcggccctcgtagggtttctaatcgcttctctggctccaagtctggcaacncggcctccngacatctctggctccgaggctggacggacgaggctgattactactgctcgctcatactgacgtaggtcttattccttctttagtcgttcgttacggtaacgtacggggtaaccctaacgggttccacccggttccgttaacggtaccgaaccggaccccgaacgggccccaaacccctcgttcgtacccttacccg

SEQ ID NO: 258722 - DNA, 531 bp, Homo sapiens
  misc_feature: GYAE6OF02IAUPD.19.78.H01.1.454.CMB.1.raw
  modified_base (320)..(320): a, c, t, g, unknown or other
  misc_feature (320)..(320): n is a, c, g, or t
  modified_base (517)..(517): a, c, t, g, unknown or other
  misc_feature (517)..(517): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttggaaattctaaccttgtctcctggtaccaacatcacccaaataagcccccaaatcatcattatgatgccataagcggccctnagggtttctaatcgcttctctggctccaagtctgcaacacggcctccctgacatctctcgggcctccaggctgagggacgaggctgactttactatcgctgctcatatgcaggtctatcttccttatcggttccttacggaactggggaacctaagggtccaccgttcctaggtccagaccccaaggccccaacccncttacgtctacccg

SEQ ID NO: 258723 - DNA, 535 bp, Homo sapiens
  misc_feature: GYAE6OF02GPG4O.19.78.H01.1.454.CMB.1.raw
  modified_base (229)..(229): a, c, t, g, unknown or other
  misc_feature (229)..(229): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtgatgtagaaattctaacttgtctcctggtaccaacatcaccaaataaacgcccccaaactcatcatttatgatgccactaagcgcctcgagggttccatcgcttctctgctcaagtctgcaacacgcctcctgacaatctctggctccaggctggaggacgaggctagattactactgctgctcatactgacgtaggtcgttatcttcttatcgttcgttacgaacgtcgggactaacggtctaaccgttccgtaaggtccacgtaccccgaaggcccctaacccgcttacgtcctacccg

SEQ ID NO: 258724 - DNA, 589 bp, Homo sapiens
  misc_feature: GYAE6OF02H4CMB.19.78.H01.1.454.CMB.1.raw
  modified_base (364)..(364): a, c, t, g, unknown or other
  misc_feature (364)..(364): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctcgtgtctggtctctggacagtcggtcacatctcctgcactggaaccagcagtgatgtagaattctaaccttgtctcctggtaccaacatcaacccaaataaacgcccccaaactcatactatttatgatgccactaacgcggccctcgagggtttacaatcgtcttctctggctcagtctggcacncgcctcctgacatctctgggcctccgaggctggaggacgaggctgtacttactactgctagctacatagtgacgtacggtcgttattccttcttacgtcgttaccgttacgggtaacgttcggggaacccgttaacgggtcccgtaacccggtttccgtaacgggttcctaaccggaccccgtaacggacccccgtaacccccgtacgttaccgtaccctacccg

SEQ ID NO: 258725 - DNA, 699 bp, Homo sapiens
  misc_feature: GYAE6OF02J0XKR.19.78.H01.1.454.CMB.1.raw
  modified_base (310)..(310): a, c, t, g, unknown or other
  misc_feature (310)..(310): n is a, c, g, or t
  modified_base (420)..(420): a, c, t, g, unknown or other
  misc_feature (420)..(420): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatcctcctgcactggaaccagcagtgatgttaggaaattctaaccttgtcctcctggtaccaacatccaaccaaataaacgcccccaaatcactcatttangatcgaccaactaagccgccctgtacgggtttactaatcgcttctcgtgcctccaagtctacggactaaccgacggccctacccgtagaccaactctcgtcggcctacgngctgaggacgtggactgaacttacgtactcgtctacgtccgtacagttacgtacgtaccgtacggtttaaccgttactttacccgtttacgtttaatttaccggtttaccggtttacgggttaaacccgggttcggggtaaacccgttaaaccgggttaacccgttaaccccggtttcccgggttaaaacggttccccgtaaacccggtacccccggtaaaacccggacccccgttaaaaccccccgtacggtttacccggttaaccctttaaccccgg

SEQ ID NO: 258726 - DNA, 619 bp, Homo sapiens
  misc_feature: GYAE6OF02H6OAA.19.78.H01.1.454.CMB.1.raw
  modified_base (456)..(456): a, c, t, g, unknown or other
  misc_feature (456)..(456): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctggtaccaacatcaacccaaataaacgcccccaaactcatcctaatttatgatgccactaagccgccctgagggtttctaatcgcttctctggtctccaagtctggcaacgaccggcctccctgacctaatccttacgtcgggcctccgagggctaggacggtacgaggctagtattacctatcgtctgcctanaacttagtcgtaccgtaggttaccgttattccgttactttacgttgttaccgtttacgggaaccgttcgggtaaccctaacgggttccaacccggttcgtaacggtaccaaccgtcccgtaaacggaccccctaaaccccgacgtttccgtaccctaacccgg

SEQ ID NO: 258727 - DNA, 589 bp, Homo sapiens
  misc_feature: GYAE6OF02HX3SV.19.78.H01.1.454.CMB.1.raw
  modified_base (200)..(200): a, c, t, g, unknown or other
  misc_feature (200)..(200): n is a, c, g, or t
  modified_base (389)..(389): a, c, t, g, unknown or other
  misc_feature (389)..(389): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacngtcggtcaccatctcctgcactggaaccagcagtgatgttgaaacttctaaccttgtctctgtaccaacatcaccaaataaacgcccccaaactcactcatttatgatcgaccactaacgccggacccttcgtaacgggtttctaatcgcttctctgctccaagtctgcaacacgcctcctgacatctntcggctccagctgaggacgagctgattactatgctgctcatatcgacgaggttacttatccgttatttacgtcgttaccgttacggacgttacggggaaccgtaggttaccctacccggttaccgttaacgggtacccgaaccggtaccccggtaacggaccccccgttaaacccccacgtttccgttaacccttacccg

SEQ ID NO: 258728 - DNA, 558 bp, Homo sapiens
  misc_feature: GYAE6OF02F5WEK.19.78.H01.1.454.CMB.1.raw
  modified_base (270)..(270): a, c, t, g, unknown or other
  misc_feature (270)..(270): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctcctggtaccaanatcacccaaataaacgcccccaaactcatcatttatgatcgccactaagccgcctcgtagggttctaatcgcttctctcggctcaagtctggcaacacgcctcctgacaatctcgtcgggctccgaggctaggacggacgacggctacggatttaccgactcgtactggcctactattacgtgacgtagggtcttaacttcttctttatcgttcttacggaacgttggaaccaggtccaccgttccgtacggtacacgacccaacggcccaacccgctcgtcctaccg

SEQ ID NO: 258729 - DNA, 769 bp, Homo sapiens
  misc_feature: GYAE6OF02GSFKX.19.78.H01.1.454.CMB.1.raw
tcagtactctcgtgcacgaccggtgctcgatttagtgtgagtagtttgggtttggggggggtcgacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaaccttgtctcctggtaccaactatccaacccaaaagtaaacgaccccccaaaactcaactctaattttacgtgaatcgacccaactaagccggtccctacggtaaggggttttcctaaacttccgtctttacctcgtaggcccttacccgaaagttccttcgggacctaaacgacccgggcccttacccctaggaaacctaaacttccgttccgtacggggcccttcccggaagggtcttacgggaacgggacgtaaacggggtccttaagggaacttttaacgaccgtggtaccttcgccttacaatttacgtcggtacacggggtttccttacttacgtttccttaagttcggttacccgttaacgggaacccggtttacgggggaaacccgaacggggtttccctaaaccccgggtttcccgttaaaccggggtacccgtaacccggggaacccccccgttaaacgggaccccccctaaaacccccccgtgtttacccggacccttttaaccccgg

SEQ ID NO: 258730 - DNA, 635 bp, Homo sapiens
  misc_feature: GYAE6OF02IN6ZA.19.78.H01.1.454.CMB.1.raw
  modified_base (366)..(366): a, c, t, g, unknown or other
  misc_feature (366)..(366): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattcctaaccttgtctcctggtaccaacatcaacccaaataacgcccccaaatcatcatttatgatcgccactaacgccggtaccctcgagggttttcaatcgtcttctctgctcaagtcngacaacgcgtcctcctagacatctcgtcgggcctcgaggctaggacggacgaggctagtaacttactactgccgttcgcctacgtaattacgtcgaccgtaagggttccgttaactttccttacgttttagtccggtttaacgtttacccggggaaacgttacggggaaccgttaacgggtcccggtaacccgttacccgttaccgggtaccgaacccggtaccccgaaaccggacccctaaccccgtacgttccgtaccgttaacccg

SEQ ID NO: 258731 - DNA, 320 bp, Homo sapiens
  misc_feature: GYAE6OF02H8OTM.19.78.H01.1.454.CMB.1.raw
  modified_base (264)..(320): a, c, t, g, unknown or other
  misc_feature (264)..(320): n is a, c, g, or t
tcagtactctcgtgcacgaccggtgctcgattttagtgtgagtagtttgggtttggtagggtctccacctcccgccttgacgaggctgattactactggcgtgctcatatgcaggtctatctcttatgtcttacggaactgggaccaaggtccaccgtcctaggtcacgcccaaggctcgcccccctcggtccactctcgttccccacccctcctcccacgagagttactgacggcggggctgggcaacgggccgtacagtagnnnnnnnnnnnnnnnnnnnnnnnnnnnnnnnnnnnnnnnnnnnnnnnnnnnnnnnnn

SEQ ID NO: 258732 - DNA, 556 bp, Homo sapiens
  misc_feature: GYAE6OF02GBYVK.19.78.H01.1.454.CMB.1.raw
  modified_base (228)..(228): a, c, t, g, unknown or other
  misc_feature (228)..(228): n is a, c, g, or t
  modified_base (445)..(445): a, c, t, g, unknown or other
  misc_feature (445)..(445): n is a, c, g, or t
  modified_base (463)..(463): a, c, t, g, unknown or other
  misc_feature (463)..(463): n is a, c, g, or t
  modified_base (543)..(543): a, c, t, g, unknown or other
  misc_feature (543)..(543): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtgatgttaggaaattctaaccttgtctcctggtaccaacatcaccaaataaacgcccccaaactcatcatttatgatgccactaagccggccctcgacgggtttctaatcgtcttctctggctccaagtctggcaacacggcctccctgactaactctcgtgggcctccgaggctaggaggacgaggctagtacttactactgctgctcatangacgaggtcgtatccttnttatcgtacgttacggaactgggacctaagggtccaccggttcctaacggtccgacggtacccaagggaccccaaccccncgttacgctaccg

SEQ ID NO: 258733 - DNA, 555 bp, Homo sapiens
  misc_feature: GYAE6OF02HN441.19.78.H01.1.454.CMB.1.raw
  modified_base (453)..(453): a, c, t, g, unknown or other
  misc_feature (453)..(453): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcacatctcctgcacgtggaaccagcagtgatgttagaattctaacttgtctctgtaccaacatcaaccaaataaacgccccaaactcatcattatgatcgaccacgtaagccggccctcgtacgggttaccaatcgtcttctctcggctacacgtctggacaacgaccggtcctccctagaacactctcgtggcctccgaggctggacggacgacggctgtaacttactacgtacgcttcgctacatancgacgagtctagttcttcttatcgttcttacgtacgtcggaactaaggtccaccgttccgtagtccgacgacccgaacggacccaacccgactctactaccg

SEQ ID NO: 258734 - DNA, 561 bp, Homo sapiens
  misc_feature: GYAE6OF02IT36R.19.78.H01.1.454.CMB.1.raw
  modified_base (284)..(284): a, c, t, g, unknown or other
  misc_feature (284)..(284): n is a, c, g, or t
  modified_base (307)..(307): a, c, t, g, unknown or other
  misc_feature (307)..(307): n is a, c, g, or t
  modified_base (321)..(321): a, c, t, g, unknown or other
  misc_feature (321)..(321): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctgtaccaacatcaaccaaataaacncccccaaactcatcattatgatnccactaagcgcctnagggtttcaatcgctctctgctccaagtctaggacaacacggcctccctgacaactctctggctcagctgaggacgagctagatactactgctagtctcatagtcgacgtaggtacgtatccttacttagttcgttcgttacgggtaacgtacgggtaaccgtaaacggttcccaaccgttcgtaacggtccaacggtaccccaacggtaccccaaaccccgtacgttcgtacctaaccg

SEQ ID NO: 258735 - DNA, 509 bp, Homo sapiens
  misc_feature: GYAE6OF02GA2ZT.19.78.H01.1.454.CMB.1.raw
  modified_base (424)..(424): a, c, t, g, unknown or other
  misc_feature (424)..(424): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcgccctcagggtttcaatcgcttctctggctccaagtctggcaacacggcctccctgacaactctctgggctcgaggctgagacgaggctgattactatgctgctnatatgactaggtctatcttcttatgtctcggaactgggaccaggtcaccgtctaggtcagacccaggcccaacccactcgtctac

SEQ ID NO: 258736 - DNA, 244 bp, Homo sapiens
  misc_feature: GYAE6OF02FMC2Q.19.78.H01.1.454.CMB.1.raw
  modified_base (239)..(244): a, c, t, g, unknown or other
  misc_feature (239)..(244): n is a, c, g, or t
tcagtactctcgtgcacgaccggtgctcgatttagtgtgagtagtttgggtttgggtggtctccactcccgccttgacgaggctgattactactgctgctcatatgcaggtcgtatctcttatgtcttcggaactgggaccaaggtcaccgtcctaggtcagcccaaggccaaccccactgtcactctgttcccgccctcctccacgagagtactgagcgggctggcaaggcgcatagnnnnnn

SEQ ID NO: 258737 - DNA, 599 bp, Homo sapiens
  misc_feature: GYAE6OF02IB41Z.19.78.H01.1.454.CMB.1.raw
  modified_base (281)..(281): a, c, t, g, unknown or other
  misc_feature (281)..(281): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaccagcagtgatgttgaattctaacttgtctctgtacaacatacaaccaaataaacncccccaaactcatcaattttatgatcgccactaagccggccctgagggtttctaatcgcttctctggctacagtctggacaacaccggcctccctgacaactctcgtggcctccgaggctgaggacgagctagtattacctactgactgacttcattagtcgacgtaggttcgtattaccttactttaacgttcgttaccgtttacgggaaccgttacggggaaccctaagggtcccgtaacccgttccggtacggttacccaaccggtacccgaaccgggaccccctaaacccccggtacttaccggtacctacccg

SEQ ID NO: 258738 - DNA, 552 bp, Homo sapiens
  misc_feature: GYAE6OF02HO124.19.78.H01.1.454.CMB.1.raw
  modified_base (228)..(228): a, c, t, g, unknown or other
  misc_feature (228)..(228): n is a, c, g, or t
  modified_base (262)..(262): a, c, t, g, unknown or other
  misc_feature (262)..(262): n is a, c, g, or t
  modified_base (436)..(436): a, c, t, g, unknown or other
  misc_feature (436)..(436): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcggtcaccatctcctgcactggaaccngcagtgatgtgaattctaacttgtctctgtacanatcaccaaataacgccccaactcatcatttatgatcgccactaacgcgccctgagggtttctaatcgcttctctggctacaagtctgacacacgcctcctagacatctcgtcggctccgaggtctaggacggacgacggctagacttactactcgcttcgctacatagtcgacngggttactaacttcttacttacgttcgttccgttacggaacgtcggaaccgtaaggtccaccgttccgtacgtaccgacgtacccgaacgaccctaacccacgttcgtacctaccg

SEQ ID NO: 258739 - DNA, 544 bp, Homo sapiens
  misc_feature: GYAE6OF02H5TEN.19.78.H01.1.454.CMB.1.raw
  modified_base (370)..(370): a, c, t, g, unknown or other
  misc_feature (370)..(370): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccattctcctgcacgtggaaccagcagtgatgttagaaattctaacttgtctctggtaccaacatcaaccaaataacgccccaaactcatcatttatgatgccactaacgccggcctcgagggtttctaatcgcttctctcggctccaagtcgtggacaacncggcctcctgacaatctacgtggcctcaggctggaggacgagctgattacactagctgctacattatgactaggtctatcttcttatcgttacgttcggaactcgggaaccgaggtccacccgtcgtaaggttccacgacccgaacggaccccaacccctagtcgtctaacccg

SEQ ID NO: 258740 - DNA, 585 bp, Homo sapiens
  misc_feature: GYAE6OF02F0ZD6.19.78.H01.1.454.CMB.1.raw
  modified_base (198)..(198): a, c, t, g, unknown or other
  misc_feature (198)..(198): n is a, c, g, or t
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctggtctcctggacngtcgtcaccatctctgcactggaaccngcagtnattgtagaaattctaacttgtctctgtacaacatcaaccaaataacgccccaaactcactctattatgactcgaccactaacgccgaccctcgtagggtttcctaatcgtcttctctgctacaagttctgacaacgacgcctcctagacatcgtcgtggcctccgacggtctacggacggaccgagcgtagacttacgtactacgtcttcgactctaacttagtcgcgtacggttacgttatccgttcttagttcgttccgtttacgggtaagttcgggaacctacgggtctaccggttacccgtaggtacgaccggtacccgaacggaccctaccccgtacttcgacctcccg

SEQ ID NO: 258741 - DNA, 635 bp, Homo sapiens
  misc_feature: GYAE6OF02IRPDC.19.78.H01.1.454.CMB.1.raw
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctggtaccaacatacaacccaaataaacgcccccaaactcatcatttatgatgccacgtaacgccggcccctacgtacggggtttctaagtaccgtcttcctcgtcggcctacctaagtccgttggacctaaaccgaccggtccctcccgtaggaacctaacttctcgtcgggcctccagggtccgtggaacgggacgagggcctagtacttactacgtgtctagcttacatagtcgacgtacgtcgttatcttacttagttcgttaccgttacggtaaccgttgggaaccctaagggtccctaccggttaccgtaacggtacctacgaccccgtaacggtacccctaaccccctacgttccgtaccgtacccg

SEQ ID NO: 258742 - DNA, 624 bp, Homo sapiens
  misc_feature: GYAE6OF02HM6QF.19.78.H01.1.454.CMB.1.raw
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaccagcagtgatgttagaattctaacttgtctctggtaccaacatcaaccaaataaacgcccccaaactcatcatttatgatgccactaacgccggccctcgtaggggtttctaatcgtcttctctggctccaagtctgacaacacgcctcctgacaatctcgtgggcctccgaggctggacggacggaggtctagtattacctacgtgccttgctctatatcggtacgtaggttacgttattccttacgtttacttcggtttaccgttaccgggtaaccggttacggggtaacccttaacggggtcccctaacccggttaccggttacgggtaccgtaacccggaccccgtaaccggtacccctaaaccccccgtacgttccgttacccttaaccccgg

SEQ ID NO: 258743 - DNA, 548 bp, Homo sapiens
  misc_feature: GYAE6OF02F6WHW.19.78.H01.1.454.CMB.1.raw
  modified_base (307)..(307): a, c, t, g, unknown or other
  misc_feature (307)..(307): n is a, c, g, or t
  modified_base (536)..(536): a, c, t, g, unknown or other
  misc_feature (536)..(536): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctggtaccaacatcaccaaataaacgcccccaaactcatcatttangatgccactaagccggccctcgagggtttctaatcgcttctctggctacaagtctggacaacacggtcctccctgacaatctctgggctccgagtctggaggacgaggctgaacttactactgactgctcattatgcgtaggttctaattcttactttatcgttcgttacggaactcgggaaccaaggtccaccgttcgtagtcacgtacccgaggacccctaaccccnttacgtctaccg

SEQ ID NO: 258744 - DNA, 242 bp, Homo sapiens; identical to SEQ ID NO: 258416
  misc_feature: GYAE6OF02FQ0FC.19.78.H01.1.454.CMB.1.raw
  modified_base (238)..(242): a, c, t, g, unknown or other
  misc_feature (238)..(242): n is a, c, g, or t

SEQ ID NO: 258745 - DNA, 250 bp, Homo sapiens
  misc_feature: GYAE6OF02FFDKG.19.78.H01.1.454.CMB.1.raw
  modified_base (239)..(250): a, c, t, g, unknown or other
  misc_feature (239)..(250): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccactgtcactctgttcccaccctcctccacgagagtactgagcgggctggccaaggcgcatagnnnnnnnnnnnn

SEQ ID NO: 258746 - DNA, 560 bp, Homo sapiens
  misc_feature: GYAE6OF02JCNDV.19.78.H01.1.454.CMB.1.raw
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (372)..(372): a, c, t, g, unknown or other
  misc_feature (372)..(372): n is a, c, g, or t
  modified_base (381)..(381): a, c, t, g, unknown or other
  misc_feature (381)..(381): n is a, c, g, or t
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctacctggacagtcggtcaccatcgtcctgccactggaaccngcagtnattgttgaaattctaaccttgtctcctggtaccacatcaccaaataacgcccccaaatcatcatttatgatgccataagcgcctcagggtttctaagtcgcttctctcggctccaagtcgtgcacgacgcctccgngacatctcnggctcgagctgagacgaggctgattacacgtgactgctacgagttacgtaggacgtaggtaccgtacttccttactttagtcgttcgttacggtaccgtcgggaacctacggtcctacccgttccgttaggtaccctacgtccccgaacggtaccccaaccctacgtacgtcctaaccc

SEQ ID NO: 258747 - DNA, 241 bp, Homo sapiens
  misc_feature: GYAE6OF02HHQVW.19.78.H01.1.454.CMB.1.raw
  modified_base (239)..(241): a, c, t, g, unknown or other
  misc_feature (239)..(241): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccactgtcactctgttccccaccctcctccacgagagtactgagcgggctggcaaggcgcatagnnn

SEQ ID NO: 258748 - DNA, 680 bp, Homo sapiens
  misc_feature: GYAE6OF02J3B92.19.78.H01.1.454.CMB.1.raw
  modified_base (231)..(231): a, c, t, g, unknown or other
  misc_feature (231)..(231): n is a, c, g, or t
  modified_base (386)..(386): a, c, t, g, unknown or other
  misc_feature (386)..(386): n is a, c, g, or t
tcagtactctcgtgcacgaccggtgctcgatttagtgtgagtagtttgggtttgggggggtcgacaagaggcagcgctctcgggacgtctccaccatggcctgggctctgctgctcctcactctcctcactcaggacacagggtcctgggcccagtctgccctgactcagtctgcctcgtgtctgggtctcctggactagtcggtcaccatcctcctgcacgtcggaaccngcagtgtatgttaggaaacttccttaaccttgtcctccgtcggtaccaactactacccaaccaaactaaccgaccccctaaactccatactatttacagtatcgacctactaacgccggcccttaggtacgggtttactaacgtccgtctttccncgttcgtacctaccgtaacgtccgtacggtaccaacctcccgggtacccttcccgtacgaacctacgttcctccgtacgggtcctccggtaggtccgaggtacggacgtacggtctacgtacttaactcgtacgctccgtactcgaattacgtcgaccgttggtaccttacttccgtttacttcgttacgtccggttacggaaccgtacggtaccgtacgtacccgtacggtcgtaaccggtccgaccgaacccgttaccgaccccgtaaccctcgttaccgtacccgttaccc

SEQ ID NO: 258749 - DNA, 643 bp, Homo sapiens
  misc_feature: GYAE6OF02IE81X.19.78.H01.1.454.CMB.1.raw
  modified_base (236)..(236): a, c, t, g, unknown or other
  misc_feature (236)..(236): n is a, c, g, or t
  modified_base (300)..(300): a, c, t, g, unknown or other
  misc_feature (300)..(300): n is a, c, g, or t
  modified_base (308)..(308): a, c, t, g, unknown or other
  misc_feature (308)..(308): n is a, c, g, or t
tcagtactctcgtgcacgaccggtgctcgatttagtgtgagtagtttgggtttgggggggggtcgacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtnatgttaggaattctaacttgtctctcgtacacatcaccaaataacacccaaactacatctattntagatacnccactaagccgcctcgtagggttctaagtcgtacttctcgtgctcaagtcgtgacaaccacgacctccacacaactctcgtggcctaccgacggtcgtacggacgggacgaacggtcgtagtaacttacctacgtacgtcgtacgtacctactacgttaagtcggtacgtacggttaccgttaactttccgtttactttacgttacgttcccgttaacgggtaaccgttacggggaaacccgttaacgggtaccttaccccggtacggttaaccggttccgaaccggacccgaaacccgggtaccccaaccccggtactccggttacctaacccg

SEQ ID NO: 258750 - DNA, 594 bp, Homo sapiens
  misc_feature: GYAE6OF02GGPQY.19.78.H01.1.454.CMB.1.raw
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctggtaccaacatcaaccaaataacgcccccaaactcatcatttatgatcgaccactaagccggcctcgtagggtttctaatcgtcttctctcgctcaagtctggacaacgacggcctcctagacactctcgtcggctcgaggctaggacggacgaggctagtacttactacgtgctgctacattagtgacgtagggttcttattccttagtttacgttcgttacgttacggaacgtcggggaacctaacgggtcccgtaaccggttccgtaacggtacccaacggaccccgaacgggtacccccaaaccccgtcgttaccgtaccctacccg

SEQ ID NO: 258751 - DNA, 805 bp, Homo sapiens
  misc_feature: GYAE6OF02H57ZH.19.78.H01.1.454.CMB.1.raw
  modified_base (290)..(290): a, c, t, g, unknown or other
  misc_feature (290)..(290): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctggtctctgacagtcgtcaccatctcctgccactcggaaccagcagtgattggttagaaacttctaaccttgtccttcgtggtaaccaactataccaacctaaaanaaccgacccccaaactcatctatttatgactacgaccaacgtacggccggtcccgtacggtaacggggttttactaacgtccgtcctttaccgtccgtcgggtaccttaccgaaacgttccgtacggaccgtaaacccgtccgggtccccttacccggtacgtaaccctaagtcccttaccggtcgggtaccgttaccccgtaacgggtcgtacgggaaacgggtacggaacggttcgtagtaactttaaccgttacgtcgtaccgtacgtctactaagttacgttcggtaccgttacgggttacgttacgtttaccgtttacgtttaacgttaccgttaccgggtttaaccggtaaacccggttaccggggtaaccgttaaacccgggttccgttaaaccccgggtttccggtaaaccgggtttaccccggaaccggttaacccccggtaaaacccgggtaaccccccgttaaaacccccgtaccggtttacccggtaaccgtttaacccccgg

SEQ ID NO: 258752 - DNA, 587 bp, Homo sapiens
  misc_feature: GYAE6OF02HFH8W.19.78.H01.1.454.CMB.1.raw
  modified_base (229)..(229): a, c, t, g, unknown or other
  misc_feature (229)..(229): n is a, c, g, or t
  modified_base (361)..(361): a, c, t, g, unknown or other
  misc_feature (361)..(361): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtgatgtagaattctaacttgtctctgtaccacatcaccaataaacgccccaaactcatcatttatgatgccactaagcggccctgtacgggttctaagtcgtcttctctgctaccgagtctggcaacncggccctccgtgacaatctcgtcggcctcaggctggacggacgacggctagacttacgtacgtcgtctcgcttacatcgtgaccgtagggttcctagttctttcgttaatcgttacgttaccggtaacgtcgggaaccgtaacgggttcccgtacccggtttactaccggtaccgacggtacccccgaacgggtaccccaacccccgtacttcggtaccctacccg

SEQ ID NO: 258753 - DNA, 551 bp, Homo sapiens
  misc_feature: GYAE6OF02GREL5.19.78.H01.1.454.CMB.1.raw
  modified_base (267)..(267): a, c, t, g, unknown or other
  misc_feature (267)..(267): n is a, c, g, or t
  modified_base (304)..(304): a, c, t, g, unknown or other
  misc_feature (304)..(304): n is a, c, g, or t
  modified_base (440)..(440): a, c, t, g, unknown or other
  misc_feature (440)..(440): n is a, c, g, or t
  modified_base (444)..(444): a, c, t, g, unknown or other
  misc_feature (444)..(444): n is a, c, g, or t
  modified_base (462)..(462): a, c, t, g, unknown or other
  misc_feature (462)..(462): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtagaaattctaacttgtctctgtaccaanactacaaccaaataaccgaccccaactcatcatttanagatcgaccactaacgccgcctcgtagggttactaatcgtcttctctgctacagtctcgacacgcgcctcctgacactctcgtcggcctacgacgtcgtggacggacgagtctagtacttacgactcggctcgctnattntcgcgtagtactctcttnttagtcgttacgttacgacgtacgggtacgtacggtctaccgtcgtacgaccacggacccgacggaccccaacccgtctaccgtactcc

SEQ ID NO: 258754 - DNA, 559 bp, Homo sapiens
  misc_feature: GYAE6OF02GKZIL.19.78.H01.1.454.CMB.1.raw
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (437)..(437): a, c, t, g, unknown or other
  misc_feature (437)..(437): n is a, c, g, or t
  modified_base (455)..(455): a, c, t, g, unknown or other
  misc_feature (455)..(455): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctggtaccaacatcaaccaaataacgcccccaaactcatcatttatgatgccactaagccgcctcgtagggtttctaatcgcttctctgctcagtctggacacncgcctccngacatctctggctcaggctaggacggacgaggctagtacttactacgtgtctcgctacattacncgactaggttctatcttnttatcgttacgttacggaacgtcggaaccgtaacggtccgaacccgttcgtaacggtccgaacgaccccgaaccggaccccaacccctacgtcgtcctaacccg

SEQ ID NO: 258755 - DNA, 636 bp, Homo sapiens
  misc_feature: GYAE6OF02JZUE7.19.78.H01.1.454.CMB.1.raw
  modified_base (171)..(171): a, c, t, g, unknown or other
  misc_feature (171)..(171): n is a, c, g, or t
  modified_base (205)..(205): a, c, t, g, unknown or other
  misc_feature (205)..(205): n is a, c, g, or t
  modified_base (240)..(240): a, c, t, g, unknown or other
  misc_feature (240)..(240): n is a, c, g, or t
  modified_base (303)..(303): a, c, t, g, unknown or other
  misc_feature (303)..(303): n is a, c, g, or t
  modified_base (310)..(310): a, c, t, g, unknown or other
  misc_feature (310)..(310): n is a, c, g, or t
  modified_base (469)..(469): a, c, t, g, unknown or other
  misc_feature (469)..(469): n is a, c, g, or t
  modified_base (490)..(490): a, c, t, g, unknown or other
  misc_feature (490)..(490): n is a, c, g, or t
  modified_base (546)..(546): a, c, t, g, unknown or other
  misc_feature (546)..(546): n is a, c, g, or t
  modified_base (587)..(587): a, c, t, g, unknown or other
  misc_feature (587)..(587): n is a, c, g, or t
tcagtactctcgtgcacgaccggtgctcgatttagtgtgagtagtttggtttggggggttcggacgaagaggcgagcgctctcggacgtctccaccatggcctggctctgctgctcctcactctcctcactcgaggacacaggttcctggcccagtctcgccctgacctcngtctcgcctccgtgtctgggtcctcctcggaacngtcggtcaccatctcctgcactggaaccagcagtntactgtttagaaattctaaccttgtctcctgtaccacatcaccaataagccccaactacatcntttaacngatcgcctacgtaacgccggtccctacgagggtttctaacgtcgcctttcgtctcggactcctaagtctcgacacgacgccctcctgaccatcctcgtggacctcctagggcttcggacggacgtagggtcctagggtaacttacttaccgtgccgttntacctttccgaattacccgtncgtaaccgggtttctttaactcgtttcctttaagttccgttacgtttacgaccggngttaaccggccggttaacctaccggttacgttccggtaacnccgggaccctaaaccgggccccctaacccgcgtttaacgcccttaaccg

SEQ ID NO: 258756 - DNA, 681 bp, Homo sapiens
  misc_feature: GYAE6OF02HCP5Q.19.78.H01.1.454.CMB.1.raw
tcagtactctcgtgcacgaccggtgctcgatttagtgtgagtagtttgggtttggggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcacatctctgcacgtcggaaccagcagtgatggttaggaaattctaaccttgtcctccgtaggtaccaacactaccaacccaaaataaaccgaccccccaaactccaatctaattttatgatcgaccaactaacgccgtccctacgtagggtttcaatccgtcttctctcggctaccgtagtcgtcggacaacgccgtccctacctcgaacctaactccgtcgtcgggcctaccgaagggtctacgggaacgggtacggaggtctaagtacttaacgttaccgttggtacctcggccttactaagtacgttcggaccgtaagggtttccttacgttacctttactttaacggttcgtttaccgttaccgggtaacgtcggggaaccttaacgggtcccgtaaccgttaccgtaacggtccaaccggtacccgaaccggtaccccaaaccccgtcgtaccgtaccttaaccccgg

SEQ ID NO: 258757 - DNA, 633 bp, Homo sapiens
  misc_feature: GYAE6OF02IFTD9.19.78.H01.1.454.CMB.1.raw
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcaagtgatgtaggaaattctaacttgtctctgtacacatcaccaaataaacgcccaaactcatcatttatgatcgaccactaagcggccctcgagggtttctaatcgtcttctctcggactccaagtctggacaacgcggtcctcctagactaactctactcgggctcccgagctggaggtacgaggcctgtaattacgtactcgtctcgactcaatagttcgacgtaggtcgttaacttcgttacttaacgttacgtttccgttacgggtaaaccctacggggaaacccgttaaacgggtcccgtaacccggttcccggttaaacgggttcccaacccggtacccggtaaaccggtaacccccgtaaaccccccgtaaccgttccggttacccttaaccccgg

SEQ ID NO: 258758 - DNA, 622 bp, Homo sapiens
  misc_feature: GYAE6OF02GSAMS.19.78.H01.1.454.CMB.1.raw
  modified_base (209)..(209): a, c, t, g, unknown or other
  misc_feature (209)..(209): n is a, c, g, or t
  modified_base (215)..(215): a, c, t, g, unknown or other
  misc_feature (215)..(215): n is a, c, g, or t
  modified_base (228)..(228): a, c, t, g, unknown or other
  misc_feature (228)..(228): n is a, c, g, or t
  modified_base (235)..(235): a, c, t, g, unknown or other
  misc_feature (235)..(235): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgccctcgtgtcgtggtctcgtggactggtcgcacntcctcngctacgtagaacngctagtnatgtagaacttctacttgtctctgtaaccatatccaaccaaataaccaccccctaaactctactacttaacttagacgtatccgacctaacgtacggcccgtaccgtacgggttacggttactaagtccgttcttcgtcgtcgtcctacgtacgtcgtacgaaccacgtccgtccctctacgaactactcgttcggcgtcctacggtacgtcggtacggtacggacgtacgtacgttagtaaccttactacgtcgtactctctactagtactcggacgtcggttctcgttcttagttctcgttcgtacgacgtacggacgtacggtcctaccgttcgacgtaccgaccgaacccgtacccaaccctacctcgttaccgtctacccgg

SEQ ID NO: 258759 - DNA, 249 bp, Homo sapiens
  misc_feature: GYAE6OF02JBZ8O.19.78.H01.1.454.CMB.1.raw
  modified_base (237)..(249): a, c, t, g, unknown or other
  misc_feature (237)..(249): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtctaggtcagcccaaggccaaccccactgtcactctgttccccgccctcctccacgagagtactgagcggctggcaaggcgcatagnnnnnnnnnnnnn

SEQ ID NO: 258760 - DNA, 539 bp, Homo sapiens
  misc_feature: GYAE6OF02FGPAJ.19.78.H01.1.454.CMB.1.raw
  modified_base (307)..(307): a, c, t, g, unknown or other
  misc_feature (307)..(307): n is a, c, g, or t
  modified_base (526)..(526): a, c, t, g, unknown or other
  misc_feature (526)..(526): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctggtaccaacatccaccaaataaacgcccccaaactcatcatttangatgccatagccggcctcgtagggtttctaatcgcttctctgctacaagtctggcaacacggccctcctgacaatcctcgtggctccaggtctggaggacgaggctgtacgttactactgtctgacttcatagtcgacgaggtcttaatcttacttatcgttacttacggacgttcggaccaaggtccaccgtcgtagtcacgcccgaggaccccaccnctcgtactacccg

SEQ ID NO: 258761 - DNA, 606 bp, Homo sapiens
  misc_feature: GYAE6OF02GGVVH.19.78.H01.1.454.CMB.1.raw
  modified_base (307)..(308): a, c, t, g, unknown or other
  misc_feature (307)..(308): n is a, c, g, or t
  modified_base (402)..(402): a, c, t, g, unknown or other
  misc_feature (402)..(402): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctctggacagtcggtcaccatctcctgcactggaaccagcagtgatgttaggaaattctaaccttgtctcctggtaccaacatcaaccaaataaacgcccccaaactcatcatttannatgaccactaagccgccctgtacgggtttctaactcgtcttctcgtggcctacctaagtctggacaacgaccggtccctcctgactaatctcgnggcctcacggctaggacgacgacgggtctaggaacttactacgtgtctgccttcaagttattgaccgtaggttccgtaattcttacttagtcgttacttacgggaacgttcgggaaccctacgggttccaaccggtttccgtaacggtaccaaccggacccgaaccggtaacccctaacccgtacttaccggtcttaaccccgg

SEQ ID NO: 258762 - DNA, 585 bp, Homo sapiens
  misc_feature: GYAE6OF02IQQNQ.19.78.H01.1.454.CMB.1.raw
  modified_base (360)..(360): a, c, t, g, unknown or other
  misc_feature (360)..(360): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtggaaattctaaccttgtctcctggtaccaacatcaccaaataacgacccccaaactcatctattatgatgccactaagccgtccctcgtaggggtttctaatcgcttctctgctcaagtcngacacacgcctcctgactactctcgtcgggcctccgaggctggacggacgacggtctagacttacgtactgtctcgactcatagtgcgaggttcgtattccttacgttatcgttaccgttacggtaaccgtcgggtacccgacgggttccctaaccggttccgttaacggtccgtaaccggaccccgtaacggacccctaaccccgtcgttaccgtacctacccg

SEQ ID NO: 258763 - DNA, 241 bp, Homo sapiens; identical to SEQ ID NO: 258417
  misc_feature: GYAE6OF02GE5G9.19.78.H01.1.454.CMB.1.raw
  modified_base (238)..(241): a, c, t, g, unknown or other
  misc_feature (238)..(241): n is a, c, g, or t

SEQ ID NO: 258764 - DNA, 742 bp, Homo sapiens
  misc_feature: GYAE6OF02H8YE0.19.78.H01.1.454.CMB.1.raw
tcagtactctcgtgcacgaccggtgctcgatttagtgtgagtagtttggggtttgggggggggtcacaagaggcagcgctctcgggacgtctccacctatggccctggggcctctgctgctcctcactctcctcactcaggacacagggtcctgggcccagttctgccctgactcagtctgcctcgtgtctgggtctccgtggacaggtcggtcaccatctcctgcacgtaggaccagcagtgtattggttaggaatttcgtaacctttgtaccttccgtcggtaccgaacaacttaccgaacccctaaaacgtaaaccgaccccccaaaacgttaccaatcctaagtttacttgaactcgacctacgtaacggccgtcctacgagggtttactaactacgcttcctcgtcggtactaccgaagtcgtacgacaaccgtccggtccctacccgtagaacctaacttccttcgtacggtccttcccggaacggtcgtacggacggaggaccggtcgtaggtacttaccttaacgtcgacgtccgtacgtaccaacgttacgtagtaccggttagttaccggttacgttcgtttacctttaggttcggttaccggtttaccgggtaacgtaccgggtaaccgtaacggtccggttaacccgttaccggtaaccggttaaccgacccggttacccggaaccggtacccccgtaacccgtacggttacccgttacgttacccccgg

SEQ ID NO: 258765 - DNA, 680 bp, Homo sapiens
  misc_feature: GYAE6OF02I0B2F.19.78.H01.1.454.CMB.1.raw
tcagtactctcgtgcacgaccggtgctcgatttagtgtgagtagtttgggtttggggggggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcggtcaccatctcctgcactggaaccagcagtgattgttaggaattctaacttgtctcctagtaccaacataccaacctaaataaaccgaccccctaaactctaatactattatgatcgaccacgtaacgccgtcctacgtacgggtttctaactcgtacttctcgtcgtactacctaagtccgtaggactaaccgaccggtcccttacccgtacgaacctaacttccgtaccgggtcgggccctaccggacgggtacgttacgggaacgggtaacgtacgggtacgtacgtaactttaccgttacgttcgcgtcgtacctatacttacgtcggtacgtacgggtttacgtactttccttactttacgttcgttaccgttacgggaccgtaccgggtaacgtacggtaccgtacccgttcggtaccgtaccgaccgacccgaaccggacccaacccgtacgttccgacccttacccgg

SEQ ID NO: 258766 - DNA, 625 bp, Homo sapiens
  misc_feature: GYAE6OF02HUWM9.19.78.H01.1.454.CMB.1.raw
  modified_base (262)..(262): a, c, t, g, unknown or other
  misc_feature (262)..(262): n is a, c, g, or t
  modified_base (277)..(277): a, c, t, g, unknown or other
  misc_feature (277)..(277): n is a, c, g, or t
  modified_base (294)..(294): a, c, t, g, unknown or other
  misc_feature (294)..(294): n is a, c, g, or t
  modified_base (361)..(361): a, c, t, g, unknown or other
  misc_feature (361)..(361): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcggtcaccatctcctgcactggaccagcagtgatgtgaattctaacttgtctctgtacaanatcaaccaaataacnccccaaatcatcattangatcgcactaacgcgcctgagggtttcaatcgcttctctgctacaagtctaggcaacgcgcctcctnaccaatctcgtcgggcctacgacggtctacggaacggacgacggtccttaggtaactttaacgtaccgttagccgttagacctaccgtaattacgtccggacgttaacgggttcgttaacttcgtttactttagtacgttaccgttacgggaacggttaccgggaacccttaacggggtcctacccggttacgttaccgggtaccgaacccggaccccgtaaacggaccccctaaacccccggtagttcccggtaacctacccg

SEQ ID NO: 258767 - DNA, 569 bp, Homo sapiens
  misc_feature: GYAE6OF02GVMFY.19.78.H01.1.454.CMB.1.raw
  modified_base (432)..(432): a, c, t, g, unknown or other
  misc_feature (432)..(432): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctccgtggacagtcggtcaccatcctctgcactggaaccagcagtgattgttaggaattctaaccttgtctcctgtacacatcaccaaataacgccccaaactcatcattatgactgccactaagccggacctcgtagggtttctaatcgtcttctctgctcaagtctgcacacgcctccctagacactctctcggctccgaggtctggaggacgaggctgattactactacgtctgacctnacttagtcgcgtaggtcgttacttcttactttagtcgttaccgttacggtaaccgtcgggaaccttaacgggtcctaacccgttcgtacgtaccgaccggacccgaacgtcccaaacccctctacgtaccttacccg

SEQ ID NO: 258768 - DNA, 691 bp, Homo sapiens
  misc_feature: GYAE6OF02HWIW9.19.78.H01.1.454.CMB.1.raw
  modified_base (229)..(229): a, c, t, g, unknown or other
  misc_feature (229)..(229): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtgatgtagaaattctaacttgtctcctggtaccaacactcaacccaaataaacgcccccaaactcatctatttatgatcgcctaactaagccggaccctcgtagggtttactaatccgtcttctctggtcctacctaagtctaggaccaaaccgaccggtcccttacccgtgaacctaacttccgtcgtcgggccttccgagggtcctagggaacgggacggaggtctacggtaactttaacctacgttcgcttgccttacgaattagtcggacgttagggttccgtttaagttcctttactttacgttacgttccgtttaccgggtaacggttaccggggtaaaccctaacggggttaccctaaccccggtttaccggttaacggttaccccgaaccggacccccgtaaacgggaacccccctaaacccccgtacgtttaccgtacccttaaccccg

SEQ ID NO: 258769 - DNA, 839 bp, Homo sapiens
  misc_feature: GYAE6OF02I0RS5.19.78.H01.1.454.CMB.1.raw
  modified_base (315)..(315): a, c, t, g, unknown or other
  misc_feature (315)..(315): n is a, c, g, or t
tcagtactctcgtgcacgaccggtgctcgatttagtgtgagtagtttgggtttgggggggggttcgacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatggttggaaatttctaaccttgtctcctggtaccaacatccaaccgaaataaacgcccccaaactcactctatttangtatgaccaactaacgccggcccttacgaggggttttacctaagtccggcttttacctcgttacggtcctttaccctaaacggttcctttaacggggaccctaaaaccgacccggggtcccctaccccgtttacggtaacctaaaccgttccttccgggtttaccggggtccctttaccccgaaggggttccgtacggggtacggggtaaaaccggaggggtacccgtttaggtaaacttttaacccggttaacgttacgggttcgttccgttacctaccgttaaacgttcggttacggtccgttaaaggggttcccttttaaacgttcctttacgttttaacgttcggttttaccgtttaccgggaaaccgtttccgggggtaacccgttaaccggggttaacctaccccggtttaacccgggttaacgggttaccccggtaaacggtcccccccggtaaaaccgggttcccccccaaaaacccccggtttccgtttaccccgggtttaaccctaacccccgg

SEQ ID NO: 258770 - DNA, 244 bp, Homo sapiens
  misc_feature: GYAE6OF02G8LLP.19.78.H01.1.454.CMB.1.raw
  modified_base (239)..(244): a, c, t, g, unknown or other
  misc_feature (239)..(244): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggccaaccccactgtcactctgttccccaccctcctccacgagagtactgagcgggctggcaaggcgcatagnnnnnn

SEQ ID NO: 258771 - DNA, 663 bp, Homo sapiens
  misc_feature: GYAE6OF02F9VAP.19.78.H01.1.454.CMB.1.raw
  modified_base (228)..(228): a, c, t, g, unknown or other
  misc_feature (228)..(228): n is a, c, g, or t
  modified_base (262)..(262): a, c, t, g, unknown or other
  misc_feature (262)..(262): n is a, c, g, or t
  modified_base (274)..(274): a, c, t, g, unknown or other
  misc_feature (274)..(274): n is a, c, g, or t
  modified_base (291)..(291): a, c, t, g, unknown or other
  misc_feature (291)..(291): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccngcagtgatgtagaattctaccttgtctctgacantcaccaataacnccccaactcatcattangatcgccactacgccgcctgtagggttactatcgcttctctgcctcaagttcgtaggacaaccgaccggtccctacccgtcgaacctaacttccgtaccggttcgggcccttcccggagggtccgttacgggaacgggtaccggacggggtccttaacggtaacctttaaccgtacgttcggacttcgtacctacgtaacgtacgtcggtacgtacgggttccgttacttccgtttactttaacgttcgttaccgttaccggtaacgttcgggtaaccgtacgggttaccctaacccggttccgtaacggtccgaacccggtacccgaaccgggtacccccaaccccgtacgttaccgtacccgttaacccg

SEQ ID NO: 258772 - DNA, 601 bp, Homo sapiens
  misc_feature: GYAE6OF02FJO88.19.78.H01.1.454.CMB.1.raw
tcagtactctcgtgcacgaccggtgctcgatttagtgtgagtagtttgggtttggggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaacccagcagtgatgttggaaattctaaccttgtctcctggtaccaacatcacccaaataacgcccccaaactcatcatttactgatgccataacgcggccctcaggggtttctaatcgcttctctggctcagtctgacaacacgcctccctgaccaatctcgtgggcctcgaggctgacgggaccggaggtctggaactttactacgtgctgctctattagtgactgggtacttattcctttacttatcgtttaccgttccggaacgttcggggtaaccgaacggttacccgaccccggttccgttacgggtaccaaccggtaccccgaaccgggtacccccaaaccccgtcccgttacgtacccgttaaccccg

SEQ ID NO: 258773 - DNA, 651 bp, Homo sapiens
  misc_feature: GYAE6OF02ITANJ.19.78.H01.1.454.CMB.1.raw
  modified_base (259)..(259): a, c, t, g, unknown or other
  misc_feature (259)..(259): n is a, c, g, or t
  modified_base (311)..(311): a, c, t, g, unknown or other
  misc_feature (311)..(311): n is a, c, g, or t
  modified_base (350)..(350): a, c, t, g, unknown or other
  misc_feature (350)..(350): n is a, c, g, or t
  modified_base (532)..(532): a, c, t, g, unknown or other
  misc_feature (532)..(532): n is a, c, g, or t
tcagtactctcgtgcacgaccggtgctcgatttagtgtgagtagtttgggtttgggggggggtcgacaagaggcagcgctctcgggacgtctccaccatggcctgggctctgctgctcctcactctcctcactcaggacacagggtcctgggcccagtctgccctgactcagtctgcctcgtgtctggtctcctggacagtcggtcaccatcctcctgacactggaaccagcagtgattgttggtacggttaataactntcgtctccgtagtaaccaacaacaccgagcaacgccccaaagcatgatttangatgtcagtgacgccggtcctgacggggtcctgactccncgttctcgtcgtactacgaagtcgtagaccaacgtccggccctacctaaactatccgttcgtcggcctacgaggtcgagtacggattcggacgtgttagtaactttacgtacctggtctacgtctacctaagttacgcgtacgaacggtcgtaacgttaacggttaaccgtttagggttacncccggggttaaggtaaccggaacaaaccgtccgttaaacccggtacccggtttaccgtaacggggtacccaaaccgggttaccccggaaacggtttcccggtaccccgttacccccggg

SEQ ID NO: 258774 - DNA, 608 bp, Homo sapiens
  misc_feature: GYAE6OF02JQHFQ.19.78.H01.1.454.CMB.1.raw
  modified_base (199)..(199): a, c, t, g, unknown or other
  misc_feature (199)..(199): n is a, c, g, or t
  modified_base (275)..(275): a, c, t, g, unknown or other
  misc_feature (275)..(275): n is a, c, g, or t
  modified_base (451)..(451): a, c, t, g, unknown or other
  misc_feature (451)..(451): n is a, c, g, or t
  modified_base (577)..(577): a, c, t, g, unknown or other
  misc_feature (577)..(577): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctggcccagtctgccctgactcagtctgcctccgtgtctgggtctcctggacngtcggtcaccatctcctgacactcggaaccagcagtgattggttagtaaacttctaacttgtcctcctcgtaccanactacaaccaaataaccgacccctaaactctatacctattatgatcgacactaacgccgcctacgtagggtttactaacgtcgtcttctcgtcgtcctacctaagtctcggacaccgaccgtcctacctacgactaacgtctacgtcggcctacgacgtcgtacggacggtacggngtctacgtacttaacgtcgtagtaccgtgtcctactagtacgtgtaccgtcggtactaccgtttcttacgttcgttcgttacgttacggtacggtcggtactaccggtctaccgtcgtacgtaccncgacctacgacccgacctaccctgtctaccg

SEQ ID NO: 258775 - DNA, 640 bp, Homo sapiens
  misc_feature: GYAE6OF02HPPP0.19.78.H01.1.454.CMB.1.raw
tcagtactctcgtgcacgaccggtgctcgatttagtgtgagtagtttggggtttgggggggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcgtcaccatctctgcactggaccagcagtgatggttagtaaacttctaaccttgtctctaggtaaccaacataccaaccaaataaacgacccccaaactcatactatttatgatcgaccactacgccgtcccgtcgtacgggtttactaacttccgtcttctcgtcgtacctcctaagtcgtcggacaacgaccgtcctacctacgactaactctcgtcggcctacgaggtctaggaggacgaggtctacgtattacctacgtcgctcgtactacattagtcgtacgtacggtcgttacttccgtttacttagttacgttcgttaccgggtaacggttaccgggaaccgtaaccgggttccctacccggttaccgtaacggttacccgaaccgtacccgaaccggtacccctaaccccggtacttccgtacctacccg

SEQ ID NO: 258776 - DNA, 636 bp, Homo sapiens
  misc_feature: GYAE6OF02I2MHK.19.78.H01.1.454.CMB.1.raw
  modified_base (226)..(226): a, c, t, g, unknown or other
  misc_feature (226)..(226): n is a, c, g, or t
  modified_base (265)..(265): a, c, t, g, unknown or other
  misc_feature (265)..(265): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcacatctcctgcactggaaccngcagtgatgttgaacttctaacttgtctctggtaccaanactcaacccaaataaacgcccccaaactcatactatttactgatcgccaactaaggccgtccctacgtaggggttttactaacgtccgtacctttcgtcgttacggccttacctaaacgtccgttcgggacctaaaccgaaccgggtccctacccgttcggaaacctaacgttccttacgtcgggtacctaccgacggcttaggacggacgagtctaggtactacgttatgactgctcattacgcgacgtacggtcttgttcttcgtttaagtcgttaccgtttcgaacgttcgggaaccgtacggtccgtacccgttacgtacggtacacgacccgtaacggaccccaacccacgttaccgtcccgtacc

SEQ ID NO: 258777 - DNA, 248 bp, Homo sapiens
  misc_feature: GYAE6OF02I0AJ8.19.78.H01.1.454.CMB.1.raw
  modified_base (240)..(248): a, c, t, g, unknown or other
  misc_feature (240)..(248): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtctaggtcagcccaaggccaaccccactgtcactctcgttccccaccctcctccacgagagtactgaggcgggctggcaaggcgcatagnnnnnnnnn

SEQ ID NO: 258778 - DNA, 806 bp, Homo sapiens
  misc_feature: GYAE6OF02F2IAG.19.78.H01.1.454.CMB.1.raw
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctctggacagtcgtcaccntctcctgcactggaaccngcagtgattgttaggaaattcctaacttgtctcctgtaccacatcaaccaaataacgccccaaactcatactactttatacgtatcgccaactaacgccggtccctcgtaacggggtttactaacgtccgtacttcctcgtcggtcctaccgtaacgttcgttacggacgaaaccgtaccggtccctaccccgtacgtaacctaaacgttccgttaccggttcggggtacccgttaccccgaagggggttacccgttaggggaacgggtaaacccgggtacgggtaccctttacgggtaaccttttaaaccgttaacccttcgggtacctttaccgggtaccttaccgtaacgttaaccgttcgtacccgggtaaccgggtttaccggttaacgtttcccgtttaacgttttacggtaccggttttaccggtttacccgggtaacccggttacggggtaaaccccggttaaccgggttaccccgttaaccccgggtttaccgtaaccgggttaccgtaacccggaccccgtaaccgggtacccctaaccccgtacgttaccgttacccgttaaccccgg

SEQ ID NO: 258779 - DNA, 778 bp, Homo sapiens
  misc_feature: GYAE6OF02FG25I.19.78.H01.1.454.CMB.1.raw
  modified_base (331)..(331): a, c, t, g, unknown or other
  misc_feature (331)..(331): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctggcccagtctgaccctgactcagtctgcctcgtgtctggtctctggacacgtcggtacacctatcctcctcgacacgtcggaacccaggctacgtgtattgttacggtaaacttcctaacttcgtcctcctcgtaaccacacctaccaaccgaaactaaccaccccaactctatctaacttanacactccaccaacgtaaccggcccgttacccgtacggttaaccgggtttacctaaccgttccgtccgtttccgtccgttacgggtacccttaccgaaaccgtttccgacggtaaccacccggtaccgtacccgttacctaacggtaccctaacgttccctacgggtaccggtaccgtaccggtacggtaccgtaacgggtaaccggtaaccggtacggttaccttaacgttaaccgttaccgttaccgcggttaccctcgtactacgtacttacggtaccgacgtttacggttaccttattaccgtttcgtaacgttccggttaacgtaccgggtaacgttccgaaccggtacccgtaacccggttaccgaacccggttaacggtcccgtaaacccgacccggtaaccctaaccccgttcccaacggttccgtaacccttaccccgg

SEQ ID NO: 258780 - DNA, 500 bp, Homo sapiens
  misc_feature: GYAE6OF02G7VD2.19.78.H01.1.454.CMB.1.raw
  modified_base (378)..(378): a, c, t, g, unknown or other
  misc_feature (378)..(378): n is a, c, g, or t
  modified_base (437)..(437): a, c, t, g, unknown or other
  misc_feature (437)..(437): n is a, c, g, or t
  modified_base (491)..(491): a, c, t, g, unknown or other
  misc_feature (491)..(491): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctctgtaccaacatcaccaaataagcccccaaactcatcatttatgatgccactaagcggccctcgagggtttctaatcgcttctctggctccaagtctgcaacacgcctcctgacatctntggctcagctgagcgagctgattacactgctgctcatatgctaggtacgtatctcttangtcttacgactgggaccaaggtccaccgtctaggctacgcccaggcccaacccnctcgctacc

SEQ ID NO: 258781 - DNA, 748 bp, Homo sapiens
  misc_feature: GYAE6OF02GMQYG.19.78.H01.1.454.CMB.1.raw
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctggtaccaacatcaaccaaataacgccccaaactcatctatttatgatcgaccaagtaacgccggtccctacgtaggggtttcctaaagtcgtaccttcgtctcggtccttaccgaacgtcgttacggaccaaacgtacccgggtcccttaccccgtacggaaacctaactcccgttccgtacgggtccgtacccgacggtcgttacgggacgggtaaccggaaggtcgttaacggtactttaaccttacgtacgtcgttacctcggggttactattaacgtacgtaccgttacgggttaccgtttacgttacgtttacgtttacgttacggtttaccgtttaccgggtaaccggttacgggtaaccggttaaccggttacccggttaacccggttacccggttaaccggtacccgtaaccgtaaccccggtaaacccggtacccccgtaaaccccgtaccgttacccggtaccctttaaccccgg

SEQ ID NO: 258782 - DNA, 889 bp, Homo sapiens
  misc_feature: GYAE6OF02IIOWD.19.78.H01.1.454.CMB.1.raw
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctccgtggacagtcgtcacatctcctgcactggaaccagcagtgatgttagaacttctaaccttgtctctggtaccaacatcaaccaaataaaccgacccccaaactccatctaattttatgacttcgaccaacgttaacgccggtaccccttacgtaagggggtttttacctaaacgttccggtccttttacgttccgttacgggcccttaccgtaaacgttccgtacggtaccaaaccggtaaccccgggtcccctttaccccgttacggtaacccctaaacgtttcccgttacgggttaccggggtacccgttccccggtaacgggtacccgttacggggtaaacggggtaaaccggggtaacggggtaccgtttaaccgggttaacttttaaacccgtttaaccggtttaccgtaaccgggtttccgttcccgtttaaccgaacgttttaaaccggttacggtaccgttaaaccggggtttacccgggtttaactttacccggttttaaccgttttaacgtttaccgggtttaaccgttttaaccggggttaaaccggtttaccgggggtaaacccgttaacggggttaacccgttaacccgggttacccgttaaccgggttaccgtaaccggtaccccggaaaccgggtacccccctaaacccccggtacgttacccgttacccgttaacccgg

SEQ ID NO: 258783 - DNA, 812 bp, Homo sapiens
  misc_feature: GYAE6OF02HMK7H.19.78.H01.1.454.CMB.1.raw
  modified_base (612)..(612): a, c, t, g, unknown or other
  misc_feature (612)..(612): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacaggggtcccgtcgggcctagtctcgccctgactctagtctcgtccctcgtgtcgtcggtcctccgtaggactaggtccgtaccacctactcctcctgactacgtacggaaccacgactagtgtacgttggttaaggtaaactttaccttaaccgtttcgttccttaccgttaccggtaaaccaacctaactaacccaaaaccgtaaaaactaaaccccgaccccctaaaactctaactacttaatttactacgtactaccgacctaacgtaacggccgtaccgtacggttaacgggttactaacgtcgttccttcgtacgtccgtacgtaccgtagtaccggtaggaacctaacgtaccgtacccttaccgtacgtaacctaacgtttccgtacggtccggtacccgtacgacggtcgtacgggacggacggtacgtacgttacggtaaccttaacgtacgtccgtacgttntactactaagtacgtcgtaacggtacgtttcgtactttacctttacgttaacgttcggttaaccgttaaccggaaccgggttaccggaaaccggttaaccggttacccttaacccggttacggttaaccgaaccggtaaccccgtaacccggtaacccggtaaccccctaaaccccgtgttacccggtacccttacccgg

SEQ ID NO: 258784 - DNA, 711 bp, Homo sapiens
  misc_feature: GYAE6OF02GPOML.19.78.H01.1.454.CMB.1.raw
  modified_base (310)..(310): a, c, t, g, unknown or other
  misc_feature (310)..(310): n is a, c, g, or t
  modified_base (317)..(317): a, c, t, g, unknown or other
  misc_feature (317)..(317): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaattctaacttgtctcctggtaccaacatccaaccaaataaacgacccccaaactcactctatttangtactcnccaactaacgccggtccctacgtagggtttactaatccgtcttacctcgtcggtacctaccgtaacgttcgacggtacaaaccgtccggtaccctcctacgaacctaacgttcgtaccgtcgggtcctacgaacgggtcttaacgggacgggtacgacgggtacgtacgtaacgttaaccgttacgtcgtacgttacggtaccttacgtaacgttacgttacggtacggttaacgggttaccgtttacgttacccttttacgttacgttcggttaaccgtttaccggtaacggttacgggtaaccgttacggtaccgttacccggtaccgttaaggtacccgtaccggacccgtaaccggacccctaacccgtacgttaccgtaccttacccgg

SEQ ID NO: 258785 - DNA, 651 bp, Homo sapiens
  misc_feature: GYAE6OF02HL27Z.19.78.H01.1.454.CMB.1.raw
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcacgtacggaaccagcagtgtatgttaggaattctaacttgtcctccgtacggtaaccaacactaccaacccaaaactaaaccgacccccaaactaccatactatttatgactcgaccacgtaacgccggtccctacgtacgggttactaactcgtcttcgtcgtcgtcctactaacgtcgtacgacaacgaccgtccctaccgtcaactactccgtcgtcggtcctacgtacgggtctagggacggacgacggtactacgttaacttacgttacgtcgtcttacgcctactaattacgtcgacgtacggttctaacgttctttacgttagtcgttacgtacggtactacgggaacctaacggtcctaacccggttcgtaacggtccgaaccgacccgtaaccggacccctaaccctacgttaccgtacctacg

SEQ ID NO: 258786 - DNA, 667 bp, Homo sapiens
  misc_feature: GYAE6OF02FQCQ4.19.78.H01.1.454.CMB.1.raw
  modified_base (230)..(230): a, c, t, g, unknown or other
  misc_feature (230)..(230): n is a, c, g, or t
  modified_base (347)..(347): a, c, t, g, unknown or other
  misc_feature (347)..(347): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatcctcctgcactggaaccngcagtgatgttaggaaattctaaccttgtctcctggtaccaacactcaacccaaataacgcccccaaactcatacatttatgatcgccactaagccgcctctagggtttctaagtcncttctctggctctaagtctgaccaacacggtcctccctagactaactctcgtcgggtctccgacggctaggacgggtacgtaacggtcgtagactttaccgtacgttcgcttacggccttacgtaagttacgtcggtacgtaacggggttacctttagttaccgtttaccttttaacggtggtttaccgtttaaccgggtaaccgttccggggtaaccctaacgggttcccaacccgggtttacccttaacgggttaccgtaacgtaccccggtaaccgggtaaccctaaccccccgtagtttccgtaacccttaccccg

SEQ ID NO: 258787 - DNA, 675 bp, Homo sapiens
  misc_feature: GYAE6OF02JK1QL.19.78.H01.1.454.CMB.1.raw
  modified_base (229)..(229): a, c, t, g, unknown or other
  misc_feature (229)..(229): n is a, c, g, or t
tcagtactctcgtgcacgaccggtgctcgatttagtgtgagtagtttgggtttgggggggggtcaacaaaaggcagcgctctcgggacgtctccaccatggcctgggctctgctgctcctcactctcctcactcaggacacagggtcctgggcccagtctgccctgactcagtctgcctccgtgtctgggtctcctggacagtcgtcacatcctcctgcactcggaacncgcagtgattggttagtaaacttcctaacttgtacctcgtacgtaaccaactactaccaaacctaaacgtaacccgaccccctaaaactctaacttactaatttactacgtactacgaccaacgtaccggccggtacccgttacggttacgggtttactaccgttcgtcttcgtcctcggtctaccgtagtcgtacgtaccacgtccgtacctaccgtacgtaactactccgtacggtcggtacctacggtacgcgtaaggacggtacggaggtactgttaactacgtactcgctagtcctagtatacgtcgtactacggttacttacttccgttattacttacgttcgtaacggacgtacggtacgtacgttccgccgttacgtacggtaccgaccgaaccgtaacccgacccgttacctacgtacccgttctcccgttacccgg

SEQ ID NO: 258788 - DNA, 674 bp, Homo sapiens
  misc_feature: GYAE6OF02F9LZV.19.78.H01.1.454.CMB.1.raw
  modified_base (226)..(226): a, c, t, g, unknown or other
  misc_feature (226)..(226): n is a, c, g, or t
  modified_base (266)..(266): a, c, t, g, unknown or other
  misc_feature (266)..(266): n is a, c, g, or t
  modified_base (302)..(302): a, c, t, g, unknown or other
  misc_feature (302)..(302): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctggtctcctgacagtcgtcaccatctctgcacgtggaaccngcagtgatgtagtaaattctaacttgtctcctgtaccaanatccaaccaaataacgcccccaaactcatcatttangactgccagtaacgccggacctgtacgggtttactaactcgtcttctcgtcgctactagtctgacacgacgtcctcctagaactactctcgtcgggcctaccgagtcgtaggacgggacgtacggtactagtaactttaactacgtgtaccttcgacttaccagttacgtcgacggttaacggtttccgttaacttttccgttcgttttaactcgggtttacccgtttaacggggtaaccgttcggggtaaacccgtacccgggtttaccctaaccccgggtttaaccgttaccggggtaacccaaccgggtaccccgtaaacccggaaccccgttaaccccctacggtttaccgtaacccgtttaccccgg

SEQ ID NO: 258789 - DNA, 599 bp, Homo sapiens
  misc_feature: GYAE6OF02FTPX5.19.78.H01.1.454.CMB.1.raw
  modified_base (359)..(359): a, c, t, g, unknown or other
  misc_feature (359)..(359): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatcctcctgcacgtggaaccagcagtgatgttagaattctaacttgtctctgtaccacatcaccaaataacgaccccaactcatcattatgatcgaccacgtaagccgcctacgtagggttctaagtcgtcttctcgtgctacagtcgngacacgcgtcctcctgacctatctcgtcggcctcgaggcgtaggacgtacggaggtactagtacttaacgtacgtcgtactcgtactctaagtacgtcgtacgtaggttcttaacttcgttactttagtcgttacgttaccgggtacgttacgggaacctacggtccctaccggttccgtaacggtcctaaccggacccgtaaccggaacccctaccccgtagttcccgtacttaccccg

SEQ ID NO: 258790 - DNA, 681 bp, Homo sapiens
  misc_feature: GYAE6OF02JR8UF.19.78.H01.1.454.CMB.1.raw
  modified_base (225)..(225): a, c, t, g, unknown or other
  misc_feature (225)..(225): n is a, c, g, or t
  modified_base (283)..(283): a, c, t, g, unknown or other
  misc_feature (283)..(283): n is a, c, g, or t
  modified_base (304)..(304): a, c, t, g, unknown or other
  misc_feature (304)..(304): n is a, c, g, or t
tcagtactctcgtgcacgaccggtgctcgatttagtgtgagtagtttgggtttggggggggggtcacaagaggcagcgctctcgggacgtctccaccatggcctgggctctgctgctcctcactctcctcactcaggacacagggtcctgggcccagtctgccctgactcagtctgcctccgtgtctggtctctggacagtcgtcacatctctgcacgtgaaccngctagtgattgtagaattctacttgtctctcggtaacaactactccaaccaataaccnccccaaactcactctattacngtactcacctacgacggtcccgtccgtacggtacgggtttactaagtccgtccttcgtcgtcgtcctacctaacgtcgtacggactaaccgtaccggtcctacccgtcgtaacgttaacttccgtccggttacggtcccttacggacggtacgtaacggggaccggtaccgacgggttacctacgttaacgttaaccgttcgtacgttcgtcgtaacttcgaacttcgtacgcggttaagttccgttaattcttacgttacttcggttacccggttacgaaccggtacggtacccgttaacggtccgtaccgttccgtacggtaccgtaaccgtacccggtaccgaccccgtaaccgtacgttccgttacctaccgg

SEQ ID NO: 258791 - DNA, 584 bp, Homo sapiens
  misc_feature: GYAE6OF02G8MT7.19.78.H01.1.454.CMB.1.raw
  modified_base (407)..(407): a, c, t, g, unknown or other
  misc_feature (407)..(407): n is a, c, g, or t
  modified_base (486)..(486): a, c, t, g, unknown or other
  misc_feature (486)..(486): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctctggacagtcgtcaccatcctctgcacgtggaaccagcagtgattgttggtgttaataactatcgtctccgtacggtaccaaacaaccacccgaggaccaacggacccccaaagtcatgtatttatgtatgtcgtagtgagccggccgtcgacgggtccctgactcgtcttctcgtgtcctacgagtcgtagacacgaccgtccctaccctaacnctcctcgtcggcctcgacgtcgtagagtagtggaggtcgttagtattacgttacgtcgtctcgtctgtatcgtagacgngacgtagtacgttacgtttgtacgtcgggtacggacggaacgagtcgtacgtaccgttacgtacggtacgaccgtaccgacggtcctcccgtccccgg

SEQ ID NO: 258792 - DNA, 677 bp, Homo sapiens
  misc_feature: GYAE6OF02JT20G.19.78.H01.1.454.CMB.1.raw
  modified_base (215)..(215): a, c, t, g, unknown or other
  misc_feature (215)..(215): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtcgtggtctcctggacagtcgtcaccatctcngcactcggacagcagtgattgttaggaaacttctaacttgtctcctaggtaaccaacactaccaaccaaataaaccgacccctaaactctatactaatttatgatcgaccacgtaacgcgtccctacgtagggtttactactccgtcttctcgtcgtactacagttcgtagaccaacgaccgtccctccctagaactacttccgtcgtcggtaccctaccgacggtcgtaggacgggacgacggtctacgtaacgttactacgttgcgttcgacttacgagttacgtcggacgttacggttacttaactttccgtttagttacgttacggttaccgttaacgggtaaccgtacgggtaacccgttaaccggttccggtaaccgtttaccgtaacggcccgtaacccggaccccgtaaacgggaaccccctaacccgtaaccgttccgttaacccgttacccg

SEQ ID NO: 258793 - DNA, 692 bp, Homo sapiens
  misc_feature: GYAE6OF02FTAAG.19.78.H01.1.454.CMB.1.raw
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtcgtgggtctccgtggacagtcggtcacctatcctcctgccacgtacggaaccagctagtgattggttagaaattcctaacttgtctcctggtaccaacactacaaccaaaataaccgacccctaaactcatactattatagatcgacctacgtaacgtcccggacccgtacggttaaggggtttaccttaacgttccgtctttcctcgttcggtcctaccgtaagtccgtacggtaccgaaccgtacccggtacccttcccgtacggtaacctaacgtccttccggtcgggtccctcccggaaggtccgtagggaaccgggacgtacgggtactaagtactttaccgttacgtcgtctcggtacctacttatacgtcggacgttaggtcttacttactttcgttattcgttccgttacggtacgtacggaaccgacgtaccggtaccgttaccggtacgtcgtaaccgacccgaaccgtacccaccctacgttaccgtaccttacccg

SEQ ID NO: 258794 - DNA, 637 bp, Homo sapiens
  misc_feature: GYAE6OF02GWECV.19.78.H01.1.454.CMB.1.raw
  modified_base (412)..(412): a, c, t, g, unknown or other
  misc_feature (412)..(412): n is a, c, g, or t
  modified_base (435)..(435): a, c, t, g, unknown or other
  misc_feature (435)..(435): n is a, c, g, or t
tcagtactctcgtgcacgaccggtgctcgatttagtgtgagtagtttgggtttggggggggggtcacaagaggcagcgctctcgggacgtctccaccatggcctgggctctgctgctcctcactctcctcactcaggacacgagggtcctgggcccagtctgccctgactcagtctgcctcgtgtctggtctcgtgacagtcggtcacatctcctgcacgtaggaaccagcagtgattggttaggtaacttcctaaccgttgtcctaccgtcggtaaccaactactaccaaccaaataaacccgaccccaactcatactatttatacgactacgacctacgtacggccgtacctcggtaggttctaacgtctcttactcgtgtactcagtcgtacgacaccgcgcctcgtanactactcgtcgtcgcctacgagngtaggacggtacgagtctaagtactacgtatcgtactcaccttacagttacgtcgtacgttacggttacgtactttcgttaacctttagttccgttacggtaccgggtacgtacgggtaacctacggtcccgtaccggttacggacgaccgtaacccgacccggtaaccggtaccccctaccgtgttacccgtacctcccgg

SEQ ID NO: 258795 - DNA, 892 bp, Homo sapiens
  misc_feature: GYAE6OF02JFUHV.19.78.H01.1.454.CMB.1.raw
  modified_base (254)..(254): a, c, t, g, unknown or other
  misc_feature (254)..(254): n is a, c, g, or t
  modified_base (357)..(357): a, c, t, g, unknown or other
  misc_feature (357)..(357): n is a, c, g, or t
tcagtactctcgtgcacgaccggtgctcgatttagtgtgagtagtttgggtttgggggggggtcgacaagaggcagcgctctcgggacgtctccaccatggcctgggctctgctgctcctcactctcctcactcacggacacagggtcctgggcccagtctgccctgactcgagtctcgtcccgttccggtgttcgtgggtcttcccttgggaccaggttcggtccaccacttctcctgccatcgggaaccgancgagtgattcggttaggaactttctaacctttcgtcctaccgttcggacctaacaactccaacccaaaactaaaccgacccccaaacttcactctaactttanagtactcggacctaacgtaaccggtcccggtaccccgttacggttacggggtttttacctaacgttacccgttacgtttcccgttaccgttccggggtaccctttaacctaaccggtttaccgttacgggaacctaaacccggtacccgggtcccctttaccccgaaggtaccctaaaactccgttaccggtccggggtaccctacccggagggtcccgtacgggtacggtaaccgggacggtccgtaagttacgtttaaccgttaccggtacgttccgtagtcccgttaacacgttaacgttacgtccgggttaccgggtttatttaaccccgttcgttttaaccctttgggtttaaacgtttcccgggttttaacgggttaaccggttacccgggggaaacccgttaacccgggtaacccggggtttaccccggttaaccgttaacccggggttacccgaaacccgggttacccccgggtaaccctaaccccccggttaaacccccgtttcgtaccccgttaccgttaccccg

SEQ ID NO: 258796 - DNA, 835 bp, Homo sapiens
  misc_feature: GYAE6OF02JR2F9.19.78.H01.1.454.CMB.1.raw
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctccgtggacagtcggtcaccatcctcctgcactcggaaccagcagtgactggttaggaaacttctaaccttgtcctccgtaggtaaccaactactaccaaccctaaataaaccgaccccctaaatacctaacttactaatttactagactacgacctaacgtaacggccgtacccttcggttacgggtttactaacgtcgtacttcgtcgtcggtcctacgtaacgtcgtacggacgaaccgtaccggtaccctcccgtagtaacctaaacgttccgttaccggtcgggtacccgtaccggtacgggtaccgtaacgggtaaccgggtaccggtaacgggttaccgtaacggttaaaccgtttaaccggttaacccgttacggtcccgtttaaccggtaccgttaaacttaacggttaacggttccggtaacggttaccggtttaaccggttacttaaccgttttccgtttaaccgttcggttacccgggtttaacgggtaaaccggttaccggggaaacccgtttaacgggtcccccggttaaaccggtttacccggttaaccgggtacccggaacccggttaccccggtaaacccggtacccccgtaaaccccgtaccggttacccgtcccgttaaccccgg

SEQ ID NO: 258797 - DNA, 654 bp, Homo sapiens
  misc_feature: GYAE6OF02GWEHE.19.78.H01.1.454.CMB.1.raw
  modified_base (209)..(209): a, c, t, g, unknown or other
  misc_feature (209)..(209): n is a, c, g, or t
  modified_base (447)..(447): a, c, t, g, unknown or other
  misc_feature (447)..(447): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctctggacagtcggtcacntctcctgcactcggaaccagcagtgattcgttagtaattcctaactgtctcctgtaccaacatacaaccaataacgccccaactcatcactttatgatcgcactaacgccggcctcggtacgggtttctaacgtcgtcttcctcgtcgcctcctaacgtccgtagacaaccgtaccggtccctaccctacgtaacctacttccgtcgtacggtcctccgtaggtcgtaggacggacgnggtactcggtacttacgttactcgtctcgctactagtactcggacttaggtccgttagttacctttcgtttagttccggttacgtttacggacggtaccggtaaccgtaccggtaccggttacccgtaccggttaacggtacccgaaccggtaaccccggaacccgtaacccccgaaccccgttcgtacccggtacctttaccccgg

SEQ ID NO: 258798 - DNA, 323 bp, Homo sapiens
  misc_feature: GYAE6OF02FUZCB.19.78.H01.1.454.CMB.1.raw
  modified_base (177)..(177): a, c, t, g, unknown or other
  misc_feature (177)..(177): n is a, c, g, or t
  modified_base (194)..(194): a, c, t, g, unknown or other
  misc_feature (194)..(194): n is a, c, g, or t
  modified_base (201)..(201): a, c, t, g, unknown or other
  misc_feature (201)..(201): n is a, c, g, or t
  modified_base (209)..(209): a, c, t, g, unknown or other
  misc_feature (209)..(209): n is a, c, g, or t
  modified_base (242)..(248): a, c, t, g, unknown or other
  misc_feature (242)..(248): n is a, c, g, or t
  modified_base (250)..(250): a, c, t, g, unknown or other
  misc_feature (250)..(250): n is a, c, g, or t
  modified_base (257)..(257): a, c, t, g, unknown or other
  misc_feature (257)..(257): n is a, c, g, or t
  modified_base (261)..(261): a, c, t, g, unknown or other
  misc_feature (261)..(261): n is a, c, g, or t
  modified_base (271)..(271): a, c, t, g, unknown or other
  misc_feature (271)..(271): n is a, c, g, or t
  modified_base (273)..(323): a, c, t, g, unknown or other
  misc_feature (273)..(323): n is a, c, g, or t
tcagtactctcgtgcacgaccggtgctcgatttagtgtgagtagtttggggtttgggtggtctccactcccgccttgacgaggctgaattactactgctgctcatatgcaggtctatctcttatgtcttcggaatgggaccaaggtcaccgtctaggtcagcccaaggcccaacccntgtcactctcgttcccnccttccncacgaganagactactgaggcgggctggcaaggcacaatgnnnnnnnanactcatngtanctaagcctanannnnnnnnnnnnnnnnnnnnnnnnnnnnnnnnnnnnnnnnnnnnnnnnnnn

SEQ ID NO: 258799 - DNA, 264 bp, Homo sapiens
  misc_feature: GYAE6OF02IQWH1.19.78.H01.1.454.CMB.1.raw
  modified_base (245)..(264): a, c, t, g, unknown or other
  misc_feature (245)..(264): n is a, c, g, or t
tcagtactctcgtgcacgaccggtgctcgatttagtgtgagtagtttgggttggtgtctccactccgccttgacgaggctgattactactgctgctcatatgcaggtcgtatctcttatgtcttcggaactgggaccaaggtcaccgtcctaggtcgagcccaaaggccaaacccccagtgtcactcgtgttccccgccctcctccacgagtacgtacctgagccgggctggcaaggcgcatagnnnnnnnnnnnnnnnnnnnn

SEQ ID NO: 258800 - DNA, 686 bp, Homo sapiens
  misc_feature: GYAE6OF02JKW0V.19.78.H01.1.454.CMB.1.raw
  modified_base (133)..(133): a, c, t, g, unknown or other
  misc_feature (133)..(133): n is a, c, g, or t
  modified_base (231)..(231): a, c, t, g, unknown or other
  misc_feature (231)..(231): n is a, c, g, or t
  modified_base (237)..(237): a, c, t, g, unknown or other
  misc_feature (237)..(237): n is a, c, g, or t
  modified_base (269)..(269): a, c, t, g, unknown or other
  misc_feature (269)..(269): n is a, c, g, or t
  modified_base (672)..(672): a, c, t, g, unknown or other
  misc_feature (672)..(672): n is a, c, g, or t
tcagtactctcgtgcacgaccggtgctcgatttagtgtgagtagtttgggtttggggggggtcgacaagaggcagcgctctcgggacgtctccaccatggcctgggctctgctgctcctcactctcctcactnaggacacagggtcctgggcccagtctagccctgactcagtctgcctccgtgtctgggtctcctggacaggtcggtcaccatctcctgcactggaaccngcagtnatgtagaattctaacctgtctcctggtaccanactcaaccaaataaacgacccccaactacatactaactttagtcgattcgaccaacgtaacgcccggtcctcgttaacggggtttactaaacgttccgtacttccgtcgttcgtaccgtacctaacggttcgtacggtaccaaaccgaccgggtcctacccctggaacctaactccttacggtcgggacccttacccggaggtccgtggaaacgggacggtacggcttagtacgtttaaaccgtacctggtccctcgtactactacctagtccgagttaccgttaggttaacttctttcttaaggttccttacgggttaacccgaggttaccgacgggtaaccgtccgttaaacctccgtaacggacctaccggaccgtaaaccggtacccaaacccccggtnttccgacccgtacc

SEQ ID NO: 258801 - DNA, 804 bp, Homo sapiens
  misc_feature: GYAE6OF02IGLFR.19.78.H01.1.454.CMB.1.raw
  modified_base (173)..(173): a, c, t, g, unknown or other
  misc_feature (173)..(173): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacgacgggtcctgggcccagtctcgccctgactcngtactgcctccgtgtcgttcgggtctccgtggactggttccggcaccatcctcgtgactaccgtaggaaccagcagtgatcgtagaacttctaacttgtctctagtaaccacactaccaaaccaaaataaccgaacccctaaactctaactacttaatttaactagtactacgaccaaactacgccggtaccgttacgttagggtttactaaccgtcgtacctttctccgtacgtcctaccgtaacgtcgtaacggaaccgtaaaccgtacccggtacccttacccggtaactaccgttaaacgttccgtacggttcggaacccgtttaccggacgggtttaccgagggtaaccgggaacggacggtttaccgtaagttaaccgttaacgttaaccgttcgtacgttaccgtaccgttatacgtaacgttacggaacggtttaccggtaacgtttacgtttaccttttacggttaacgttaccgttaccggtttaacgggtaacccgggttaccgggtaaacccgttaccgggtttaaccctacccggttaccggttaacgggtaacccgtaacccggacccgtaaacccgggtacccctaaacccggtaccttacggtaccttaccccgg

SEQ ID NO: 258802 - DNA, 888 bp, Homo sapiens
  misc_feature: GYAE6OF02FN3O4.19.78.H01.1.454.CMB.1.raw
tcagtactctcgtgcacgaccggtgctcgatttagtgtgagtagtttggggtttgggggggggtcaacaagaggcagcgctctcgggacgtctccaccatggcctgggctctgctgctcctcactctcctcactcaggacacagggtcctgggcccagtctcgccctgactcagtctcgcctccgtgtcgtgggtctctggacagtcggtcacatctcctgcactcggaaccagcagtgtattggtaggtaaaatttcctaaccttgtctcctaggtaaccaacactaccaaaccctaaaataaacgcctacccaaaactccaacttctaattttatagtactcgtacctaacgtaacggccggtcccttacggtaacggggttttacttaacgtcgtcctttcgtacgttcggtaccttacctaacggttccgtacggacctaaaccggtacccgtaccccttcccgtaacgtaacccgtaactttaccgtttccggtaccgggtaccttacccggtaacgggtccgttaagggaacgggggtaaccggagggttacccgtaggtttaaactttaaacccgttaagttccggttacgttaccggtacctttacgtaagtttaccggttacggtacccggtttaacggggtttaccgtttaccgttttacccgttttaccgttttaaacggtttaccgggtttaacccgggttttaaccgggttaaacccgggttaacggggtaaaccccgggtaaaccgggtttaccccggtaaaccccgggtttaccccggttaacggggttaacccctaacccggggtaaccccccggtaaacccgggtaaacccccctaaaccccccggtttaccgtacccggtttaacccccg

SEQ ID NO: 258803 - DNA, 788 bp, Homo sapiens
  misc_feature: GYAE6OF02HR13W.19.78.H01.1.454.CMB.1.raw
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctcgtgtctggtctctggacagtccggtcaaccatctcctgactacgtacggaaccagtcagtagattaggttagaaattcctaacttcgtctccgtaggtaccaacatccaacctaaaataaaccgaccccaaactcaactctaactttatacgatacgaccaacgtaacggccggtcctacggttaacgggttcttaactcgtacctttctacgttcgggtacctacctaacggtcgttacgggaccgtaaaccgacggtccctttacccgacggaaaccttaaacgttccttccgtacgggtaccttaccggtacggggtacccgtagggtaacgggtaacggggtaacggtcttaacgggtaaacttttaaaccgttaacgttcggtccgttaccgtaactcgtaaacttacggttacggtaccgttaacggttcccggtaatttcccgtttatttacgtcggtttacccgtaacgggttaaaccgttacggggaacccgttaaccgggtcccgttaacccggttaccggtaacggttacccgaaccgtaacccggaaaccggttaccccccaaacccggtttaccgttaccgtaccctttaccccgg

SEQ ID NO: 258804 - DNA, 766 bp, Homo sapiens
  misc_feature: GYAE6OF02JGSE3.19.78.H01.1.454.CMB.1.raw
tcagtactctcgtgcacgaccggtgctcgatttagtgtgagtagtttgggtttggggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcacgtggaaccagcagtcgattggttaggtaaacttctaaccgttggtcctccgttacggtaaccaacaactaccaaccctaaaactaaaaccgacccccccaaaactccaacttactaattttatgaatcggacccaacgttaacggcccggtccctacggtacggggttttactaacgttcgtcctttactccgtcggtacctaccgtacgttcgtacggacctaaccggaacccggtccctacccgtagtaacctaacgttccttccggtcggggtacccttaccgacgggtccggtagggacgggtacgtacgggtcctaaggtactttaaccttacgtcggtcgttaccgcttacgtaacgttacgtcggtaccggttacggttacgttacgttctttacgttacgttcgttaacccgggtttacgggaaccggttcgggtaaacctacgggttcccgtaaccggttacgtaaccggtccgaacccggtaaccccgaacccgggaccccctaaccccgtcgttacccgtacccgttaacccg

SEQ ID NO: 258805 - DNA, 712 bp, Homo sapiens
  misc_feature: GYAE6OF02JEDDV.19.78.H01.1.454.CMB.1.raw
  modified_base (307)..(307): a, c, t, g, unknown or other
  misc_feature (307)..(307): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacgagggtcctgggcccagtctgccctgactcagtctgcctccgtgtctggtctctggacagtcgtcaccatctctgcactggaaccagcagtgatgtagaaattctaacttgtctcgtgtaccaacataccaaccaaataaacgcccccaaatctaatactaatttanagactcgacctaacgtaacgccgtaccctaggtacgggtttacctaaagttccgtctttacgtcgtcggtacctaccgtaagttccgttacggacccaaacggtcccggtaccccttaccccgtaaggaaacctaactttcccgttccgggttacgggtacccttaccggaacggtccgtaagggaccgggtaacgtaacggggtccttaacggtaacttttaaccgtaacggttcgactcggtaccctactaaacgtcgttaccgacgttacgggtaccgttaacttccttaagttcgttacgttaccgttacgggaacgttcgggaacctaacgggtcctaaccggtcgtaaccgtacgtaccgacccgtaaccgcccctaaaccctcgttcgtacctacccg

SEQ ID NO: 258806 - DNA, 647 bp, Homo sapiens
  misc_feature: GYAE6OF02GL0IR.19.78.H01.1.454.CMB.1.raw
tcagtactctcgtgcacgaccggtgctcgatttagtgtgagtagtttgggtttggggggggggtcacaagaggcagcgctctcgggacgtctccaccatggcctgggctctgctgctcctcactctcctcactcaggacacagggtcctggcccagtctgccctgactcagtctgcctccgtgtctgggtctccgtggacagtcggtcaccgatcctcctggccacgtcggaaccagcagttgagttggttacggaaatttcctaacttgtctcctggtaccaacatccaacccaaaataaacgacccccaaactccattcctatttatgtatcgaccacgtaacgccggaccctcgtacgggtttactaacgtcgtcttctcgtggtcctaccaacgttctcggacaaccgtaccggtccctcccgtgaacctaactcgtcgtcgggtacctccgacggtcgtacgggaacggtacggaggtctacgtaacttacgttactcgactcgtcgtactatacgtgacgtacggtctacttcttacttatcgttacgttaccggtacgtaggaccgtaacggtccggtaccgttccgtacgtaccgacgacccgaaccgtaccccgtacccacgttccgtccttaccccg

SEQ ID NO: 258807 - DNA, 262 bp, Homo sapiens
  misc_feature: GYAE6OF02GYF4G.19.78.H01.1.454.CMB.1.raw
  modified_base (242)..(262): a, c, t, g, unknown or other
  misc_feature (242)..(262): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtctaggtcagcccaaggcccaacccatgtccactctcgttccccaccctcctaccacgagacgtacgaggcgggctggacaaggcgcatagnnnnnnnnnnnnnnnnnnnnn

SEQ ID NO: 258808 - DNA, 784 bp, Homo sapiens
  misc_feature: GYAE6OF02HTQLB.19.78.H01.1.454.CMB.1.raw
  modified_base (130)..(130): a, c, t, g, unknown or other
  misc_feature (130)..(130): n is a, c, g, or t
  modified_base (275)..(275): a, c, t, g, unknown or other
  misc_feature (275)..(275): n is a, c, g, or t
  modified_base (626)..(626): a, c, t, g, unknown or other
  misc_feature (626)..(626): n is a, c, g, or t
tcagtactctcgtgcacgaccggtgctcgatttagtgtgagtagtttggggtttggggggggggtcacaagaggcagcgctctcgggacgtctccaccatggcctgggctctgctgctctcactctcctnactcaggacacgtacgggtccgtgggcccagtcgtcgcccccgtagaccttcacgtcgtcgtcccgttccgtgttccgtgggtccttccgtggaaccgtagggtccggtaccaacctatcctccgtgccgtaacgtacggaaacnggacgtaggtagtagttacggtaaggttaaaacttccgtaacgtttcgtacgtccgtaacggtaaccaactacaaccaaaccgtaaaacgaaaccaacccctaactacattactaatttagagtactaccgactaacgaaccggtcccgtaccgtacggttacgggttacctacgtcgttacttctccgtcgtaccgacgttacgcgttacgaccgaaaccgtaccgtccctaccggtaacgaactacgttcccgttggtccggtaccgttccggacggttacgacgggacggtaaaccggtcggtacttacggtaaaccttacggtaacgtttccgcggtcctaaccttnttaacgaggttcacggtaccgtgtaccttacttagttactaccggttaacggttacgggacgtaccgggtactaccggtaacctaccggttaccggtacggttaccgaaccggaaccgtaaccccgaacccgttacccgtagtccgttagtacccccg

SEQ ID NO: 258809 - DNA, 749 bp, Homo sapiens
  misc_feature: GYAE6OF02HCE29.19.78.H01.1.454.CMB.1.raw
tcagtactctcgtgcacgaccggtgctcgatttagtgtgagtagtttgggtttgggggggggtcacaagaggcagcgctctcgggacgtctccaccatggcctgggctctgctgctcctcacgtctcctcactcaggacacagggtcctgggcccagtctgccctgactcagtctgcctccgtgtctgggtctcctggacagtcggtcacatctcctgcactggaaccagcagtgatgttaggaattctaacttgtctcctgtaccacatcaaccaaataaacgcccccaaactcatcatttatgatcgccaacgtaacgccgtccctgtacggggtttctaaacgtccgtcttctctcgggtacctcctaagtcgtcggacctaaccgaccggtcccttaccctagaacctaactccttcggtacgggctaccgagcgtggaacgtacggacgtcgtacgtaactttaccgtacgtcgtccgttacgtactacctaagtttacgtacggtaccggttacgggtttaccgttaacctttaccgttttacctttttaaacggttcgggttttaaccccgtttaacgggggtaacccggttaacccgggggttaaacccggtaaaccggtttacccggtaacccccggtttaccgggttaaccgggttacccgtaaacccgggtacccccgtaaacccgggaaccccccgtaaacccccgttaccgttacccggttaacccttacccccgg

SEQ ID NO: 258810 - DNA, 833 bp, Homo sapiens
  misc_feature: GYAE6OF02JOCAL.19.78.H01.1.454.CMB.1.raw
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacaggtgtcctgggcccagtctgccctgacctcagtctgcctcgtgtcgtggtcctcgtggacnggtcggtcaccagttctccgtgactacgtggaaccnggcagtgagttgtaggaaactttcctaaccttgtcctaccgtacggtaccaactataccctaaccaaaacgtaaacccgaccccctaaaaaccttcgtaacctttacttaacttttaagtacctaaacgttccgaacccgtaaacgttaacccggggtccccggtaaaccctttcgggttaaacgggggtttttacccctaaacgttcccgggttaacctttccggttacgtaccgggtaccttaacccgttaacggtccgttcgggaaccctaaccgtaccccgggttccccttaaccgttaccggaacttacgtacccgttccggtaccggtacccgttacccggagggtaccgttaccgggaagggtaaccggtaggtaccgttaccgtaagtttaccctacggtaccgtacgttcgtaccgtctaacgttacgtcggtacgtaccggtttaacgttccgttactttacgttacgttacggtccttaacgggtagtaaccggggtaccgttaccgtaccggttaccgttaccggtacgtacccgtaccggtacccgtaccggtaacccctaaacgtcccggttcctaaccgg

SEQ ID NO: 258811 - DNA, 696 bp, Homo sapiens
  misc_feature: GYAE6OF02FPT32.19.78.H01.1.454.CMB.1.raw
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtcgtgggtcctcgtggacagtcggtcaccatcctctgacactggaaccaggccaggtgacgtgttaggtaaactttcctaacctttgcttccgtacggtaaccaactactaccaaccctaaactaaaccgaaccccaacctacactactaatttatagactcgaccgtaactaacggtcccggtaccgtacggttaacgggtttactacgtaccgttccttactcgtacgtacctacctacgtacctcggaccaacgtacccgtccctacctacgaactactctaccgtcggtacccaccgtagggtacgtggacgacggtacgcgtaggtacttacgtcgtcgtcgtacgtctactatagtcggtacgtacgtacgttacttctttacttgttacgttaccgttacgtaacggttccggtaacctacggttcccaccgggtttaccgtaacggtaccgtaaccgacccggttaacccgaccccgttaaccgtacctaccggtccttacccgg

SEQ ID NO: 258812 - DNA, 708 bp, Homo sapiens
  misc_feature: GYAE6OF02H9AUJ.19.78.H01.1.454.CMB.1.raw
  modified_base (271)..(271): a, c, t, g, unknown or other
  misc_feature (271)..(271): n is a, c, g, or t
  modified_base (283)..(283): a, c, t, g, unknown or other
  misc_feature (283)..(283): n is a, c, g, or t
tcagtactctcgtgcacgaccggtgctcgatttagtgtgagtagtttgggtttggggggggggtcacaagaggcagcgctctcggggacgtctccaccatggcctgggctctgctgctcctcactctcctcactcaggacacagggtcctgggcccagtctgccctgactcagtctgcctccgtgcgtgggtctcctggcagtcggcaccatctcctgcactggaaccagcagtgattgttaggaattctaaccttgtctctgtaccaacntacaacctaaanaaccgaccccaactacatactattatgatcgaccacgtaacggccggtacccgttacggtacgggtttacctaacgtccgtaccttcgttcgtccggtacctacctaaggttccgtacggaccaaccgccgggttaccctacccgtacggaaacctacgtttaccgttacggtcgggtacccttacccggacgggtacgtacgggaacgggtacggaccgggtacgtagttaacttaaccttacggtctacgtccgtactaccgtaattcgtaccggtacggttcgtacgttacttccgtttacttacgttacgtccgtttaacgggtacgtaccgggtaacgtaccggtccctaccggttaccgtaccggaccgtacccgtacccggaacccgaccctaacccgtcgttaccgtaccttacccg

SEQ ID NO: 258813 - DNA, 728 bp, Homo sapiens
  misc_feature: GYAE6OF02IFZP9.19.78.H01.1.454.CMB.1.raw
  modified_base (219)..(219): a, c, t, g, unknown or other
  misc_feature (219)..(219): n is a, c, g, or t
  modified_base (226)..(226): a, c, t, g, unknown or other
  misc_feature (226)..(226): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacacgggtcctgggcccagtctgccctgactcacgtctcgcctccgtgtcgtcgggtctccgtggactacgtcggtcaccntctcgtnctacgtacggacagcagtgattgtagaacttctaaccttgtcctctcggtaacctaacactaccaacctaaataaccgaccccaaactccaatcctaatttactacgtactcgacctacgtaacgccggtcccttacggtacgggtttactacgttcgttcttacctcgttcgaccgttacgaacgttccgtaggtaccaaaccgtccggtaccctccgtagaaccctaagttccgttcgtcggtcctccggaacggtcgtaacggacgggaaccggcggtcgtacgttacgttaccttcgtactcgtactctacgtactacgtacgtacggttacgtaccgtttagttcctttacgtttcttacggttaccggttacggtaacccgttaccggttaacggtaacccggtccgttacccgttaccggttaaccgtaccgtaacccggtacccctaacccggttaccctaaccccggtaacgtccctaaccgtttaaccccgg

SEQ ID NO: 258814 - DNA, 814 bp, Homo sapiens
  misc_feature: GYAE6OF02JXN2T.19.78.H01.1.454.CMB.1.raw
  modified_base (143)..(143): a, c, t, g, unknown or other
  misc_feature (143)..(143): n is a, c, g, or t
  modified_base (180)..(180): a, c, t, g, unknown or other
  misc_feature (180)..(180): n is a, c, g, or t
tcagtactctcgtgcacgaccggtgctcgatttagtgtgagtagtttgggtttgggggggggtcgacaagaggcagcgctctcgggacgtctccaccatggcctgggctctgctgctcctcactctcctcactcaggacacgngggtccgtcgggcccaggttcctcgccccgtagactntacgttctccgtccccgtcccggttggtccgttggggtccgttccctagggcgtacgtccggtccaaccctactcctcccgtgtaactcgggaacccagccaaggttgattaggttcggaaatttacctaaccttgttcctccgttcgtaaccgtaaccatacaacccaaacttaaaccgacccccaaaacctcctatactatttaatgtactgaccacgtaccgcggtaccccgtcggttacgggtttacttaacgtcctcgttcctcttcggacctcgtatccgtagaccgtaacaccggtccgtaccgtccgtaacgactcgtcggtccgtcgtccgtacgtccgtaggacggtacggagtcgtacttcgtaacttacgtctctcgttactcgtattaacgtcgttaccggtacgtttaccgttttaacgtttccgtagttttacccgtttacgtttccgggtaaccggttaaccgggttacccggtaacgggttaacccgttaacccggggttcccgtacccgggtttaaccccgaaccgggtaacccccgtaacccgggttacccggtaaacccccccgttaacccgttaccccggttaccctttaacggttacccccgttttcccccg

SEQ ID NO: 258815 - DNA, 249 bp, Homo sapiens
  misc_feature: GYAE6OF02HNFO2.19.78.H01.1.454.CMB.1.raw
  modified_base (179)..(179): a, c, t, g, unknown or other
  misc_feature (179)..(179): n is a, c, g, or t
  modified_base (242)..(249): a, c, t, g, unknown or other
  misc_feature (242)..(249): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggcccaaaccccnctgtccactctcgttccccaccctcctccacgagagtactgagcggctggcaaggcgcatagnnnnnnnn

SEQ ID NO: 258816 - DNA, 768 bp, Homo sapiens
  misc_feature: GYAE6OF02INYY8.19.78.H01.1.454.CMB.1.raw
  modified_base (162)..(162): a, c, t, g, unknown or other
  misc_feature (162)..(162): n is a, c, g, or t
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
tcagtactctcgtgcacgaccggtgctcgatttagtgtgagtagtttgggtttggggggggggtcacaagaggcagcgctctcgggacgtctccaccatggcctgggctctgctgctcctcactctcctcactcaggacacgagggtcctgggcccagtccngccctgactcagtctgcctccgtgtcgtggtctccnggacngtcgcacatctcctgcactcggaaccagcagtgatgtagaacttctaaccttgtctcctggtaaccaacactaccaaaccaaaataaaccgacccccctaaaactacaacttacgtaattttatacgtatacgacccaataacggccgtacctcgtacggggttttaacaacgtacgtcttcgttcgtacggtcctacaacgtccgtttacggactaaccgtaacggcccttacccgtaacgtaactaaacgttccgtacggtccgggtacgtacccgtacgggtaccgtacgggaaagggaccggtacggtccgttaacgtaactttaaaccgtaccttccggacttacgtactacctaacgttagtaccggtaacgtaaccgggttcgttaacttccgtttaacgtttcgttccggtttaacgttaaccggttaaaccgggttaccggggtaaaccgtaacgggttaccctaaacccggttaccgttaacgggtaacctacccggtaacccggaacccggtaaaccccctaaccccggttaacttcccgtaaccgttaacccg

SEQ ID NO: 258817 - DNA, 824 bp, Homo sapiens
  misc_feature: GYAE6OF02F8ESZ.19.78.H01.1.454.CMB.1.raw
  modified_base (201)..(201): a, c, t, g, unknown or other
  misc_feature (201)..(201): n is a, c, g, or t
  modified_base (207)..(207): a, c, t, g, unknown or other
  misc_feature (207)..(207): n is a, c, g, or t
tcagtactctcgtgcacgaccggtgctcgatttagtgtgagtagtttgggtttggggggggggtcgacaagaggcagcgctctcgggacgtctccaccatggcctgggctctgctgctcctcactctcctcactgacgacacgagggtcctcgggcccagtctcgccctagtactcagtctcgcctcgtgtcgtggtctcnggtacngtcgtcaccatcctcctgctacgtacggaaccagcgtagtgaattggttaaggtaaacctttacctaaccgtttcgtccgtaccgttacggtaacccaactaacgtaccaaaccctaaaataaaacccgacccccctaaacttactaacgttcttaagttacttagactccgacaaccgtaacggccggtacccgtggttaacgggtttacctacgtccgttcttccgtctaggtcctaacgacgttacgcggaaccgtaaaccggtcccgccctttaccccgggaataaaccctatttcccggttacggcccgggtacccgtttaccgaacgggtaccgtacggggtaaaccggtaccgggaacggttacccgtaacgtttaaaccgttaaccgttccgtacggtactacccggttacgaaaccttaccttaaggttaccggtaccgtaacggttttcgtaaacgttttcccttaagtttccgtaacggtttaccggtacgggttaaaccgtacgggtaaccgttaccggggtaacccttacccgggtaccgtaccgtacgtaacccggtacccgaaacccggtcctaacccgggtcttaaccgtccgttaacccg

SEQ ID NO: 258818 - DNA, 675 bp, Homo sapiens
  misc_feature: GYAE6OF02IOR72.19.78.H01.1.454.CMB.1.raw
  modified_base (230)..(230): a, c, t, g, unknown or other
  misc_feature (230)..(230): n is a, c, g, or t
  modified_base (404)..(404): a, c, t, g, unknown or other
  misc_feature (404)..(404): n is a, c, g, or t
tcagtactctcgtgcacgaccggtgctcgatttagtgtgagtagtttgggtttggggggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactcggaaccngcagtgatggttaggaaatttctaaccttggtctccgttaggtaaccaaacatacaacccaaaataaacgcccccaaaataccatactatttatagatcgaccaaacttaacggccggtaccctacgtaggggtttactaagttccgtcttctactcggcttacgaagttccgnggaccaaacacggtccctcccgtagaaccaattctcgtagggccttaccgagggccttagggaaggaccggaggtccgtacgtaactttaactaccgtagccttcggacttccaattagtcgcggtaacggttccgtattcctttactttagttcgttacgttacggtaacgtccgggtaacgtaacgggtcccaacccggttacccttaagggaccctaaccggacccgaaccggacccccgtaacccgtacgtacgttaccctaacccg

SEQ ID NO: 258819 - DNA, 277 bp, Homo sapiens
  misc_feature: GYAE6OF02F13SZ.19.78.H01.1.454.CMB.1.raw
  modified_base (234)..(234): a, c, t, g, unknown or other
  misc_feature (234)..(234): n is a, c, g, or t
  modified_base (240)..(243): a, c, t, g, unknown or other
  misc_feature (240)..(243): n is a, c, g, or t
  modified_base (245)..(245): a, c, t, g, unknown or other
  misc_feature (245)..(245): n is a, c, g, or t
  modified_base (248)..(277): a, c, t, g, unknown or other
  misc_feature (248)..(277): n is a, c, g, or t
tcagtactctcgtgcacgaccggtgctcgatttagtgtgagtagtttgggtttgggtggtctccactcccgccttgacgaggctgattactactgctgctcatatgcaggtcgtatctcttatgtcttcggaactgggaccaaggtcaccgtctaggtcagcccaaggccaaccccatgtcactctcgttcccaccctcctccacgagacgtactgagcgggctggcaaggtcncatagnnnnangcnnnnnnnnnnnnnnnnnnnnnnnnnnnnnn

SEQ ID NO: 258820 - DNA, 780 bp, Homo sapiens
  misc_feature: GYAE6OF02FN9I3.19.78.H01.1.454.CMB.1.raw
tcagtactctcgtgcacgaccggtgctcgatttagtgtgagtagtttgggtttggggggggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcggtcaccatctctgcactggaaccagcagtgatgtaggaaattctaacttgtctcctagtaccaacataccaaccaaataaaccgaccccctaaactcaactacctaatttagatagtcgacctaacgtaaacgccggtaccccttacggtaacgggtttactaacgtccgtactttcctcgttacggtccttaccgaaacgttccgttacgggacctaaaccgtacccgggtaccccttacccgttacggaaacctaaacttccgttaccggtccgggtaccctaccgacgggtacgtacgggaagggaccggtacgggtacgttacggtaacctttaacttacgtacgtacgttcgtacctacgtaactagttaccgacgttaacggtttaccgttaagttcctttacgtttaacgtttccggtttaacggttaaccggttaaccgttacggggtaaccgtaacggggtttaccccaccgggttttaacccggtaaccggttacccgaaccggtaaccccgtaacccgggaacccccgttaaccccgtaccgttaccggttacccggttaacccc

SEQ ID NO: 258821 - DNA, 583 bp, Homo sapiens
  misc_feature: GYAE6OF02FFG7I.19.78.H01.1.454.CMB.1.raw
  modified_base (175)..(175): a, c, t, g, unknown or other
  misc_feature (175)..(175): n is a, c, g, or t
  modified_base (238)..(238): a, c, t, g, unknown or other
  misc_feature (238)..(238): n is a, c, g, or t
  modified_base (248)..(249): a, c, t, g, unknown or other
  misc_feature (248)..(249): n is a, c, g, or t
  modified_base (252)..(252): a, c, t, g, unknown or other
  misc_feature (252)..(252): n is a, c, g, or t
  modified_base (254)..(254): a, c, t, g, unknown or other
  misc_feature (254)..(254): n is a, c, g, or t
  modified_base (275)..(275): a, c, t, g, unknown or other
  misc_feature (275)..(275): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
  modified_base (300)..(301): a, c, t, g, unknown or other
  misc_feature (300)..(301): n is a, c, g, or t
  modified_base (305)..(306): a, c, t, g, unknown or other
  misc_feature (305)..(306): n is a, c, g, or t
  modified_base (320)..(320): a, c, t, g, unknown or other
  misc_feature (320)..(320): n is a, c, g, or t
  modified_base (325)..(325): a, c, t, g, unknown or other
  misc_feature (325)..(325): n is a, c, g, or t
  modified_base (334)..(334): a, c, t, g, unknown or other
  misc_feature (334)..(334): n is a, c, g, or t
  modified_base (341)..(341): a, c, t, g, unknown or other
  misc_feature (341)..(341): n is a, c, g, or t
  modified_base (356)..(356): a, c, t, g, unknown or other
  misc_feature (356)..(356): n is a, c, g, or t
  modified_base (376)..(376): a, c, t, g, unknown or other
  misc_feature (376)..(376): n is a, c, g, or t
tcagtactctcgtgcacgaccggtgctcgatttagtgtgagtagtttgggtttggtggtctccactcccgccttgacgaggctgattactactgctgctcatatgcaggtcgtatctctatgtcttcggaactgggaccaaggtcaccgtctaggtcagcccaaggccaaccccngtgtcactctcgttccccaccttcctcgacgagacgtactggacgcgggctgggccaagggcncgtatacggnntcngntcgctgcgaatcactggctcncggttacatgtacncgtcntcgtanngtanncagtctcgcacgtncgtgntaagcaacncggttancaacgagacgtttanacgacgacggtcgtttaacncgtacgtacgacgtacgacgtacgtacgacgtacgtacgtacgtacgtacgtacgtacgacgtacgtacgacgacgacgacgacgtacgtacgtacgacgtacgacgtacgtacgtacgtacgtacgtacgtacgtacgtactacgtacgtaacgtacgtacgtacgtacgtacgtacgtacgtacgtacgtacgtacgtacgtacg

SEQ ID NO: 258822 - DNA, 722 bp, Homo sapiens
  misc_feature: GYAE6OF02IGCIF.19.78.H01.1.454.CMB.1.raw
  modified_base (314)..(314): a, c, t, g, unknown or other
  misc_feature (314)..(314): n is a, c, g, or t
tcagtactctcgtgcacgaccggtgctcgatttagtgtgagtagtttgggtttggggggggggtcacaagaggcagcgctctcgggacgtctccaccatggcctgggctctgctgctcctcactctcctcactcaggacacagggtcctgggcccagtctgccctgactcagtctgcctccgtgtctcgggtctccgtggacacgtcggtcaccatcctcctgcacgtggaccagcagtgatgttagaacttctaaccttgtctcctgtaccaacatcaaccaaataacgccccaaatcaatctatttatgtancgaccactaacgccgccctcgagggtttctaatcgtcttctcgtgtctccaagtctaggaccaaccgccggtaccctccctagaacctaattccgtacgtacgggtcctacccgagggtctacggaacgggacgacgggtcttacggtactttaaccgttaacgtcgtccgttcggtaccttactaacttagtaccgggtacgtaacgggtttaccgttaccgtttactttacttttacggtcgtttaccggtttaaccgggaacggtttcccgggaaaccggttaacgggttccccggttaaaccccggtttaccggttaaccgggttacccgaacccgggtaaccccggtaaacccggtaccccccgtaaaccccccgtacgttaccggttaccccttaaccccgg

SEQ ID NO: 258823 - DNA, 249 bp, Homo sapiens
  misc_feature: GYAE6OF02G7JEO.19.78.H01.1.454.CMB.1.raw
  modified_base (241)..(249): a, c, t, g, unknown or other
  misc_feature (241)..(249): n is a, c, g, or t
tcagtactctcgtgcacgaccggtgctcgatttagtgtgagtagtttgggtttggtggtctccactcccgcttgacgaggctgattactactgctgctcatatgcaggtcgtatctcttatgtcttcggaactgggaccaaggtcaccgtcctaggtcagcccaaggccaacccatgtcactctcgttaccccaccctcctccacgagtagtacgtgacggcggctggacaaggcgcatgnnnnnnnnn

SEQ ID NO: 258824 - DNA, 791 bp, Homo sapiens
  misc_feature: GYAE6OF02JMU7I.19.78.H01.1.454.CMB.1.raw
  modified_base (206)..(206): a, c, t, g, unknown or other
  misc_feature (206)..(206): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctcgggcccagtctcgccctgctcagtctcgccgtcgtcgtcgtcggtctccgtggaccngtcggtcaacctctcctactcgactcgtacgaaccagcagttagacgtgttaaggtaaacttacccttaaccttcggtccttaccgtacgttaaccaacctactaccaaccgtaaaactaaccgacccctaaactccaacgttacaacttagtacgtatacggaacctacggtaacccggcccgtacccgttacggttacgggtttaacccgttaacttcggttcccttacgtaccgtcgggtacccttcaacgtttaccggtaccgacccgtaacccgtaccgggtaccccttaacgtacgtacccttaacgccgtttaccggtacggtacccgtaccggtaggtaccgggtaacgacgggttacggtaggtacccttacgtaacgtttaaaccgcgtttaaccggtctcccgtaaagtcgtaacttaacgtggtaccgtaacggtactttaacgtctttaacggttactcgttaacggtaacgaccggtacgtacggtaccgtaccggttaccttacggaaccgttacggacccgtcccggaaccggtaccccctacggtaccctaccggtattaacccccgg

SEQ ID NO: 258825 - DNA, 775 bp, Homo sapiens
  misc_feature: GYAE6OF02G3P34.19.78.H01.1.454.CMB.1.raw
  modified_base (229)..(229): a, c, t, g, unknown or other
  misc_feature (229)..(229): n is a, c, g, or t
tcagtactctcgtgcacgaccggtgctcgatttagtgtgagtagtttgggttgggggggggtcacaagaggcagcgctctcgggacgtctccacatggcctgggctctgctgctcctcactctcctcactcaggacacagggtcctgggcccagtctgccctgactcagtctgcctccgtgtctgggtctccgtggacaggtcggcaccatctcctgcacgtggaaccngctagtgagttagtacggaattcctaaccttgtctcctggaaccaactactccaaaccctaaaataaacccgaccccctaaaactctaactacttaatttacgtacgactcggaaccaacgttaacggcccggtaccccgtaggtaacggggttttactaacgttccgtctttaccgtcgttacggacccgttaccgtaaaggttccgtacgggtaacctaaacccggtaaccggggtcccctttaaccccgtacgtaaaacccgttaacgtttcccgttaccgggttaccgggacccttaccccggtaaagggtccccggttaaggggaaccgggtaaccgggtagggtacccttaaggtaaaccttttaccgtaaccggttacgtccgtgtaccgtactaacgttacgtcggtacgtacgggttacttacttacgttacgtttacgtcgtttacggtacgtaacggtacggtacgtaacggtcccgttacgtaccgtgccggtaacgaccggtaaccgaccctaacccgtactcgacttacccg

SEQ ID NO: 258826 - DNA, 260 bp, Homo sapiens
  misc_feature: GYAE6OF02FWK0P.19.78.H01.1.454.CMB.1.raw
  modified_base (244)..(260): a, c, t, g, unknown or other
  misc_feature (244)..(260): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggcccaaccccactgtcactctcgttccccaccctcctccacgagagtactgaggcggtctggcaaggcgacaatagnnnnnnnnnnnnnnnnn

SEQ ID NO: 258827 - DNA, 694 bp, Homo sapiens
  misc_feature: GYAE6OF02HJVQU.19.78.H01.1.454.CMB.1.raw
  modified_base (227)..(227): a, c, t, g, unknown or other
  misc_feature (227)..(227): n is a, c, g, or t
  modified_base (256)..(256): a, c, t, g, unknown or other
  misc_feature (256)..(256): n is a, c, g, or t
  modified_base (316)..(316): a, c, t, g, unknown or other
  misc_feature (316)..(316): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacgagggtcctgggcccagtctgccctgactcagtctgcctccgtgtctggtctcgtggacagtcgtcacatctcctgcactggaaccngcagtgatgttagaaactttcctaacttntctcctggtaaccaatactaccaaccaaactaaaccgacccctaactactatactattantactcgacctacgtaacgccggtcctacgtacgggttactagtccgtacttcgtcgtcgtctacgtagtcgtcgactacgccgtcctcctagactacgtcgtcgtcggactaccggacgtcgtaggaacggtacgacgtacgtacgtactaccgttacgtcgtcgcgttactacgtaacgttagtacggtaccggttaacggttacgttacctttaccgttaacgtttagttaccggttaccgttaacgggtaaccgttaccggtaaacccgttacggttacccgttaacccggttaccggttaaaccggacctaaacccgggtacccgaaaccccggtacccttaaacccccgttacgttaccgtcccgttaacccg

SEQ ID NO: 258828 - DNA, 625 bp, Homo sapiens
  misc_feature: GYAE6OF02F2KVG.19.78.H01.1.454.CMB.1.raw
  modified_base (184)..(184): a, c, t, g, unknown or other
  misc_feature (184)..(184): n is a, c, g, or t
  modified_base (198)..(198): a, c, t, g, unknown or other
  misc_feature (198)..(198): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacgagggtcctgggcccagtctgccctgactcagtctgcctccgtntctggtctctgacngtcgtccacatctcctgcacgtcggaaccagcagtgagttgttaggaaacttcctaaccgtttgtctccgtggtaacccaacactaccaaccctaaaataaaccgtacccccaaactcaatactattttactgtactcgaccaaccgtaacggccggcccgtacgtaggggtttcctaactcgtcttctcgtcggctaccgtagtccgtgaccgaaccgaccgtcctaccctagaactaacgttccgtcgttcggacccttccgaggtcgtaggaacggacgtacggtcgtagtaccttacgttaactgtctcgactacattacgtgacgtaggttccgtattacttcttatcgttcgttacgtacgtacgacgtacgtccgtaccgtcgtcgaccacgacccgacggacccaccgactcgcgtacc

SEQ ID NO: 258829 - DNA, 887 bp, Homo sapiens
  misc_feature: GYAE6OF02FZ5V1.19.78.H01.1.454.CMB.1.raw
  modified_base (135)..(135): a, c, t, g, unknown or other
  misc_feature (135)..(135): n is a, c, g, or t
  modified_base (180)..(180): a, c, t, g, unknown or other
  misc_feature (180)..(180): n is a, c, g, or t
tcagtactctcgtgcacgaccggtgctcgatttagtgtgagtagtttggggtttggggggggggtcacaagaggcagcgctctcgggacgtctccaccatggcctgggctctgctgctcctcactctcctcactnacgacacgagggtcctcgggacccagtctcgccctgactcagtcngcctccgtgtcgtggtctcgtaggactaggtccggtacaccattccgtcctacgactaccgtaacgggaaaccagtaccgtaaggttggtagttttcggttaaggtaaacctttaccgttaaccttcgtcctaccgttacgtaacctaactactaaccaaacccgtaaaacgtaaacccgtaaccccaaacttacaccttaacgttaacttttaactacgtaactaccgaccgtaaacgttaccggacccggtacccgttaacggtttacggggttttaaccttaacgttccgtttacgttaccttacggtacgttaaccgtaaccgtacgttaccggacggtacctaaaccggcccgttaaccctccgtaaccgttaacctacgttaccggttacggtaccggtaccgtccggaacggtcgacggggtaacgggacggtaacggtacgtttacgtaaaccgtttacggtactaccgttcgttacccgtacttaccgtaagttacgtacgtaacgggttacgtttaccggtttacttcgttttacgtacgttacgtttaaccggtaacggttaaccgggttaccggtaaaacccggtccggtttaaacccggtacccgtttaacgggttaacccggaccctaaaccgggtaccccgaacccgggttaaccctaaccccgttacgttcccggttacccgttaaccccg

SEQ ID NO: 258830 - DNA, 747 bp, Homo sapiens
  misc_feature: GYAE6OF02IT7YT.19.78.H01.1.454.CMB.1.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (333)..(333): a, c, t, g, unknown or other
  misc_feature (333)..(333): n is a, c, g, or t
tcagtactctcgtgcacgaccggtgctcgatttagtgtgagtagtttgggtttggggggggggtcacgaagaggcagcgctctcgggacgtctccaccatggcctgggctctgctgctcctcactctcctcactcaggacacagggtcctgggcccagtctgccctgactcagtctgcctccgtgtctgggtctccgtgacngtcggtcaccntctcctgcacgtcggaaccagcagtgatgtaggtaacttactaaccttgtcctccgttacggtaaccaacactccaaacccaaaactaaccgacccccaaactcctaactctaattttanagtatcgaccaacgtacgccggtcccgtacggttagggtttacctaacgttccgtcttccgtcgtcggtcctaccgtaagttcgtacgaccgaaccgtaccggtacccttcccgtacgaaccctacttccgttcggtccggtacccgtacccggtaggtccgtaggacggtaacggacgtcgttagtacctttagtaacttcggcttacggtctactacgtagtacgtacggttagttccgttacttaccgttagttttacgttcggttaccgttaacccgggtaacgttacccggggaaaccgttaaccgggttaaccccgttacccggtaaccggtttaacgtacccggtaacccggtaccccggtaaccggtaaccccccgaacccgttacgttcccgtaacccttccccg

SEQ ID NO: 258831 - DNA, 682 bp, Homo sapiens
  misc_feature: GYAE6OF02HQF8V.19.78.H01.1.454.CMB.1.raw
  modified_base (426)..(426): a, c, t, g, unknown or other
  misc_feature (426)..(426): n is a, c, g, or t
  modified_base (544)..(544): a, c, t, g, unknown or other
  misc_feature (544)..(544): n is a, c, g, or t
  modified_base (566)..(566): a, c, t, g, unknown or other
  misc_feature (566)..(566): n is a, c, g, or t
tcagtactctcgtgcacgaccggtgctcgatttagtgtgagtagtttgggtttggggggggcacaagaggcagcgctctcgggacgtctccacatggcctgggctctgctgctcctcactctcctcactcaggacacgtgggtcctgggcccagtcgtgccctgactcagtcctcgcctcgtgtctcggtctccgtgactaggtcgtcacctagttctcctggcctaccgtaacggaacctgtacgagttgaacgtttggtaaggttaacttacgtaacttgttccgttccgttaggtaaccaacgactaccaaaccctaaagtaaaccccgacccctaaactctaacttacgtaactttatagtaactacgacctaagtacccggccggttacctacggttacggttactacgtcctcttcgttnaccgtcctacgtacgttcgacgacgaacgtaaccgtcccttactacgactaccttgtacgccggtaccttccgagcgtaacggacgacggtcgtactacggtatccttactgacgtcncgtctagtagcgttacgtcggnttaacggtctttgtaccggttacctacgtaccggtacggcgttaacgtaccggtcccgtacgtcgtacggttacacccggaccgtacccgacccctacgtcctacgtcccttaccg

SEQ ID NO: 258832 - DNA, 937 bp, Homo sapiens
  misc_feature: GYAE6OF02FZJYD.19.78.H01.1.454.CMB.1.raw
  modified_base (177)..(177): a, c, t, g, unknown or other
  misc_feature (177)..(177): n is a, c, g, or t
  modified_base (290)..(290): a, c, t, g, unknown or other
  misc_feature (290)..(290): n is a, c, g, or t
  modified_base (333)..(333): a, c, t, g, unknown or other
  misc_feature (333)..(333): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacactagggtcctcgggcccagtctgccctgacctcagtcngcctcgtgtcgtggtctcctggactacgtcggtcaccatctcctgcacgtacggaaccagctaggtgacttagttacgaaaattccgtaaacttcgtactccgtacgaccaanacaccaaccaaactaaccgaccccaaatcactactaatttagntaactcgacctaacgtaacggtcccgacccttacggtacgggtttactaacgtcgtcctttacctcgttacgggtaccttaaccgtaacggttaccgttacgggaaccaaaccggtaacccgggttaccccttaacccgtaacggtaaacccgtaaaaccgtttcccggttacggggttaccgggtaacccttacccgggtaacggtacccgttaagggggaaccggggtaaccggtaaacggggtaacccgtttaacgggttaaaccttttaaaaccgttaacccggttacgggtcccgttacccggtaaccgtttaaaccgtaacgtttaacggttaccgggtaacgtttaaccgggtttaccgtttaaccggttaaccttttaacccgtttaacgtttaccgggttttaacccggttaccgggggttaaaccgttacccggggtaaacccgttaaaccgggggtttccccggttaaaccccgggttacccggtttaacccgggtaaacccggtaacccggtaaaccccgggtaaaccccggttaaaccccccgttaaaccccccggttaacccggtttagttaaccccccgttaacccggg

SEQ ID NO: 258833 - DNA, 795 bp, Homo sapiens
  misc_feature: GYAE6OF02H8WXC.19.78.H01.1.454.CMB.1.raw
  modified_base (129)..(129): a, c, t, g, unknown or other
  misc_feature (129)..(129): n is a, c, g, or t
  modified_base (214)..(214): a, c, t, g, unknown or other
  misc_feature (214)..(214): n is a, c, g, or t
  modified_base (232)..(232): a, c, t, g, unknown or other
  misc_feature (232)..(232): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctnactcaggacacgagggtcctgggcccagtctgccctgactcagtctgcctcgtgtctggtctctggacagtcgtacacatctctncactggaaccagcagtgntgttaggaacttctaaccgttgtcctccgtggtacctaactactcaaccgtaaataaacgaccccctaaactacactacctatttagtacgtacgtcgtaccgtaactaacggaccggtaccctcggttaacggggttttacctaacgttccggtacctttaccgttccgtacggtaccttaccgtaaacggttcgtacggtaccaaaccggtacccgggtacccttaccccgtacgtaacccgttaaccgttccgttaccgttcgggtaccctacccggtacgggtacgtacgggtaacgggacggtacggtacgttacgtacgttaaccgttcgttacgccgttacgtaccgtactagtacgttcgaccggttagtaccggttacttacgttcgttttaaccgttcgggtttacccgttaccggggtaaacccgtttaccggggtaacccgtaaccgggttacccgtaccccggttaccggttaaccgggttaccctacccgggaacccgaacccgggttacccccaacccggtaccttaccgggttacccctaacccggg

SEQ ID NO: 258834 - DNA, 765 bp, Homo sapiens
  misc_feature: GYAE6OF02GWR8J.19.78.H01.1.454.CMB.1.raw
tcagtactctcgtgcacgaccggtgctcgatttagtgtgagtagtttgggtttgggggggggtcacaagaggcagcgctctcgggacgtctccaccatggcctgggctcgtgctgctcctcacgtctcctcactcacggacacagggtacctgggacccagtctcgtccctgactcagtctgcctcgtgtcgtggtctccgtaggctacgtcggacaccgatcctctagcacgtacggaaccagctagtagagttgtagtaacttccgttaaccttgtaccttccgtacggtaacccaacgtactaaccctaaccctaaaagtaaacccgtacccccctaaaatccctacgttactaacttttacggacgtacgtacccgtaccgtaaccggttaaccggacccggtaccccgttacgggttacgggtttaacctaaccgttccgttaccttcggtaccgttgtaaccccgtttaacacggttaccgtaggtaacccgaaacccgtccgtacccccgttcctaacggacctaccttcggtaccgtcggccgttaccgacggtacggcggtaaacggtcggacggtactagtacttaaccgtgtcgtctacggtactcgttagtctaggtccgttagtaccttaccggttacttacgttacgtctaccggtaacggtccgtaccggtaaccgtcggtacccgttacggttaccaacggttcccaccgtaacccgccgaaccccaccgtagtcctaaccgttccccg

SEQ ID NO: 258835 - DNA, 701 bp, Homo sapiens
  misc_feature: GYAE6OF02FK51E.19.78.H01.1.454.CMB.1.raw
  modified_base (230)..(230): a, c, t, g, unknown or other
  misc_feature (230)..(230): n is a, c, g, or t
tcagtactctcgtgcacgaccggtgctcgatttagtgtgagtagtttgggtttggggggggggtcacaagaggcagcgctctcgggacgtctccaccatggcctggactctgctgctcctcactctcctcactcaggacacagggtcctgggcccagtctgccctgactcagtctgcctccgtgtcgtgggtctcctggactggtcgtcaccatctctgcactggaaccngcagtgatggttaggaaacttctaacttgtctcctacggtaaccaacataccaaccaaaataaccgaccccctaaatcaactactagtttactgtactcgaccaactaacggccgtaccctacggtaacggggtttactaaacgttccgtaccttccttcgtacggtacctaccgtaacgtcgtacggacctaaccgtaccggtccctacccgtacgacctaactccgtacggtcgggtaccctacggtacgtccgtagggacggacggtacggtactaggtacctttactacgtgtccgtacgtctatacgtacgtcggtacgttacggtcttacgttaccttacgtttacggttcgttaccgttaccgggtaacggtaccggaaccgtaccggttacctaccggttacgtaccggttaccgaacgaccccgtacggaaccccctacccgtacgtacgttacctaacccg

SEQ ID NO: 258836 - DNA, 257 bp, Homo sapiens
  misc_feature: GYAE6OF02HNFOM.19.78.H01.1.454.CMB.1.raw
  modified_base (247)..(257): a, c, t, g, unknown or other
  misc_feature (247)..(257): n is a, c, g, or t
tcagtactctcgtgcacgaccggtgctcgatttagtgtgagtagtttgggtttggtggtctccactcccgccttgacgaggctgattactactgctgctcatatgcaggtcgtatctcttatgtcttcggaactgggaccaaggtcaccgtcctaggtcagcccaaggcccaaccccactgtcactctcgttcccgccctcctccacgagagtacctgacggcgggctcggcaagggccgacatagnnnnnnnnnnn

SEQ ID NO: 258837 - DNA, 639 bp, Homo sapiens
  misc_feature: GYAE6OF02FYPM8.19.78.H01.1.454.CMB.1.raw
  modified_base (309)..(309): a, c, t, g, unknown or other
  misc_feature (309)..(309): n is a, c, g, or t
  modified_base (502)..(502): a, c, t, g, unknown or other
  misc_feature (502)..(502): n is a, c, g, or t
  modified_base (624)..(624): a, c, t, g, unknown or other
  misc_feature (624)..(624): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatcctctgcactggaaccagcagtgatgttagaattctaacttgtctctggtaccaacatcaacccaaataaacgacccccaaactcaatctaatttangtatcgaccaactaacgcccggtacccgtcgtaagggggttttctaagtccgtcctttcctcgtacggtcctacctaacgttcgtacgggacaaaccgtaccgggtcccttccctagtaacctaactcctcgtacggcctccgacggtcgtggacggacggagctagtacttaactacgagtctctctatatncgacgtacggtacttacgttcttacttacttcgttaccgttacggtaacgttacgggaacctaacggttcccaaccggttccgtacggtccaacggtacccgaaccggtaacccctaacccncgttctaccctaccg

SEQ ID NO: 258838 - DNA, 620 bp, Homo sapiens
  misc_feature: GYAE6OF02I258N.19.78.H01.1.454.CMB.1.raw
  modified_base (389)..(389): a, c, t, g, unknown or other
  misc_feature (389)..(389): n is a, c, g, or t
  modified_base (417)..(417): a, c, t, g, unknown or other
  misc_feature (417)..(417): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcggtcaccatctcctgcactggaaccagcagtgatgttaggaaattctaaccttgtctctggtaccaacatcaaccaaataacgcccccaaatcatctatttatgatcgaccactaacgccggtccctcgacgggtccctagactcgcttctctggcctacagtctggacacaccgcctaccctaacnctcctcgtcggcctccgaggtctggagngtcgaggtctagtaactttaacgttactcgtctcgtctacgtaatgtacggacgtaggaccgtaagggttaccttaagggttttacggttaacgttccggggaccgggtacgggaacccgtacggtccgtaccggtacccgttaccgttacggtaccgaccgacccggtaacggtccctacccggtcccccgttcggttaccc

SEQ ID NO: 258839 - DNA, 697 bp, Homo sapiens
  misc_feature: GYAE6OF02GL4C1.19.78.H01.1.454.CMB.1.raw
  modified_base (208)..(208): a, c, t, g, unknown or other
  misc_feature (208)..(208): n is a, c, g, or t
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
tcagtactctcgtgcacgaccggtgctcgatttagtgtgagtagtttgggtttgggggggggtcacaagaggcagcgctctcgggacgtctccgccatggcctgggctctgctgctcctcactctcctcactcaggacacagggtcctggcccagtctcgccctgactcagtctgcctccgtgtctggtctctggacagtcgtcaccntctcctgcacgtggaaccagcagtgatgtagaaattctacttntctcctgacanactaccaaccaaactaaccgaccccaatcactactagttangtacncgtaccaactacgccgtccctagtacgggtttactaacgtccgtacttccgtcgcgtcctacgtacgttccgtacggacctaaccgtacccggtcccttaccctagtaacctaacttccgtacgggttccgtaccgtaccggacgtcgtacgggtaaacgggacgggtacggtacgttaacgtaaccgtttaaccgtacgttcgtaccgtcgtaccttaaccgtaattacgtggtacccgttaggttaccgtttacttacctttaccgtttagttccggttaaccgttaaccggtaccgttacgggtaaccgtaaccggtacggtacccgtacgttacggaccctacggaccccgaccgtaaccccgaccttacgttacacccttcccg

SEQ ID NO: 258840 - DNA, 630 bp, Homo sapiens
  misc_feature: GYAE6OF02HQRLQ.19.78.H01.1.454.CMB.1.raw
  modified_base (128)..(128): a, c, t, g, unknown or other
  misc_feature (128)..(128): n is a, c, g, or t
  modified_base (167)..(167): a, c, t, g, unknown or other
  misc_feature (167)..(167): n is a, c, g, or t
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
tcagtactctcgtgcacgaccggtgctcgatttagtgtgagtagtttgggtttggggggggtcacaagaggcagcgctctcgggacgtctccaccatggcctgggctctgctgctcctcactctcctnactcaggacacagggtcctgggcccagtctgccctgacncagtctgcctccgtgtctgggtctcctggacagtcggtacaccatctcctgcactggaccngcagtnatgtgaattctaactgtctctgtacagatcaccaataaacgccctaaactcatctatttatagtatcgacctactaacgccgcccgtacgtacgggtttactaacgtcgtcttctcgtacggtctccgaaagtctcggtacaaacgtccgcccttaccgtgaacctaagttctacgtgggaccttccaacggtactggacggaacgtacgggacctaggtacttaacgtaacgtttcggacttcggtacttaccgagttagcgtacaggtacttgtaccttgttacgtcgttgttacgaccgttcgggtaccgtaacggtaccgtacccggtacctaacggtaccgaccggtacccaaacgggacccttaaacccccgagtcccgttacccgaccg

SEQ ID NO: 258841 - DNA, 751 bp, Homo sapiens
  misc_feature: GYAE6OF02IB1KZ.19.78.H01.1.454.CMB.1.raw
  modified_base (151)..(151): a, c, t, g, unknown or other
  misc_feature (151)..(151): n is a, c, g, or t
  modified_base (159)..(159): a, c, t, g, unknown or other
  misc_feature (159)..(159): n is a, c, g, or t
  modified_base (175)..(175): a, c, t, g, unknown or other
  misc_feature (175)..(175): n is a, c, g, or t
  modified_base (229)..(229): a, c, t, g, unknown or other
  misc_feature (229)..(229): n is a, c, g, or t
  modified_base (356)..(356): a, c, t, g, unknown or other
  misc_feature (356)..(356): n is a, c, g, or t
  modified_base (451)..(451): a, c, t, g, unknown or other
  misc_feature (451)..(451): n is a, c, g, or t
tcagtactctcgtgcacgaccggtgctcgatttagtgtgagtagtttggggtttgggggggggtcacaaggaggcagcgctctcgggacgtctccaccatggcctgggctctgctgctcctcactcctcctcactcagacacgagggtccncgggcccnggtctgccctgacctngtctcgccctcgttcgtcgtcggtcctcctaggactggtccgtcaccatcctcncgcacgtcggaaccagcagtgtattagtagtaacttcttaaccttcgtacctacgtacgtaaccaaccactaaccgaacctaaaacaaaccgacccccaaactacaattacctaaatttatagtacncgacctaacgtaccggccgtaccgttaggtacggtttacctaagtccttaccgttctacgtccggtctaaccgtaacgttcgtacgaaccgtacncccggtcctacccgtagtaaacctacctttcgtaccgtacggtccgtacccggtacgggtaccgttacgggaacccggtaacgggaccgtttaaccgtaccggttaacgttaaccggttccttacgggtaccttcggttacctacgtaacgttcggtaacgtaccgttacggtttacgttaccgtttaccttacgtttacgtacgtacggttaccgtacggacggttaaaccgtccgtacgtaccggtagaccgttaaccaccgtacccgaccgtacccacccgtcttaccgtctacccg

SEQ ID NO: 258842 - DNA, 680 bp, Homo sapiens
  misc_feature: GYAE6OF02HE9V2.19.78.H01.1.454.CMB.1.raw
  modified_base (120)..(120): a, c, t, g, unknown or other
  misc_feature (120)..(120): n is a, c, g, or t
  modified_base (219)..(219): a, c, t, g, unknown or other
  misc_feature (219)..(219): n is a, c, g, or t
  modified_base (318)..(318): a, c, t, g, unknown or other
  misc_feature (318)..(318): n is a, c, g, or t
  modified_base (531)..(531): a, c, t, g, unknown or other
  misc_feature (531)..(531): n is a, c, g, or t
tcagtactctcgtgcacgaccggtgctcgatttagtgtgagtagtttgggtttggggggggggtcacaagaggcagcgctctcgggacgtctccacatggcctgggctctgctgctcctnactctcctcactcaggacacgagggtcctgggcccagtctcgcctgactcgagtctgcctccgtgtctgggtctcgtggactaggtcggcacactctcngcacgtaggacaggcagtgattgtaagtaattcctactagtctctacggtacaactacaccaacaaaacgaaccgaccccaaacgtacatacttattanagtactaccgaacctaacgtaacgccggtaccctacgttacgggtttactaacggttcctctttaccgcgttacggtacttaccgtagtaccggtaggtaaccaaccggtccggtaccccttacctacgtaacgtaaccttcgtacggtcggtaccgtccgagtcgtagggaggacgtagacgtatacttcgaactgtcgtacgctacgtacngtacggtgtacggtaactttcggttactttaattcgggttaaacgtttccgaacggttacggtaccgggttactaaaccgtccggttaccgttaaggtaccgaaccgtacgaccgaaccgtacccacccgtactacgtaccgttaccgg

SEQ ID NO: 258843 - DNA, 789 bp, Homo sapiens
  misc_feature: GYAE6OF02IDZRN.19.78.H01.1.454.CMB.1.raw
tcagtactctcgtgcacgaccggtgctcgatttagtgtgagtagtttgggtttggggggggggtcacaagaggcagcgctctcgggacgtctccaccatggcctgggctctgctgctcctcactctcctgactcaggacacgtagggtcctgggcccagtctcggccctgaactcagtcgtcgtccctacggtgtcggttgggtcctaccgtagggtacctacggttccggtacctaacctattccttaccgtcggacctacggtacggtaacccacggtcgaaggttgtaacgttacgggttaaggtaaaacctttcgttaaccgtttcggttccctaccggtacggaaacctaacgtaactaccaaaaccctaaaagtaaaccccggaccccctaaatctaaacgttccttaatttacgtacgttcgaccgtactaacgtacggcccggtacctttacgggtacggttaactaactccggttcctcgtacggtaccgtactaacccgtaaggttcgtaaccggccaaaacggttccccgtccaccgtaagaacctacggttccgcgtcggtcctcgacgtcgtacggaggacggtacggtcgtacgtaacgtacgttcgtaaaacgtcgtcgtactactacgtacgtacgtaccggttacgttacgtacgttacgttacgttcgttacggttacgttaaccgggtacgtaccggaaccgttacgtacgtaccgtacgtacgtaccgaaccgtccggaaccgaccgtaccgtacgtaccgtacgtccg

SEQ ID NO: 258844 - DNA, 913 bp, Homo sapiens
  misc_feature: GYAE6OF02HX148.19.78.H01.1.454.CMB.1.raw
  modified_base (261)..(261): a, c, t, g, unknown or other
  misc_feature (261)..(261): n is a, c, g, or t
tcagtactctcgtgcacgaccggtgctcgatttagtgtgagtagtttgggttggggggggtcacaagaggcagcgctcgtcgggacgtctccaccatggcctgggctctgctgctcctcactctcctcactcgaggaccacgagggtcctagggcccagtcctcggccctgactcgagtctcgcctccgtgtcgtgggtcctaccgtggaccgacggtcggtccaccgtactccgttccgcggctaaccgtcgggaaaccnggtaccgagtcgtaacgttggttaacggtaaacttttcgtaaaccttggtccttaccgtacgggtaacccaacgtaacctaccgaaaacccctaaacgtaaaaccccgtaccccctaaactccgtactacctttaagttaaccgtacgtagtacccgtacctaacgtaaccgggtccgtacccgtacgggttaacggtttacctaacgttcgtaccgttcgtacggtcgtacctacgtaacgtttcgaacggtaccaaccggtcccggtcccttacccgtagtaacctacggtacccgtttcggacggtacccggtaacggtaccggtaacgtaacggtaacggggacccgtaacgggttaccggtaagttaacccgttaacgtaccggtttacgtacgtcccgttaaacgtcgttaaaccgttagtaaccccgtagggttcccgggtaaacctttaccgtttacccgtttagttaccggttaccgttacccgggttttaaacgggacccgggttaaggtaaccccggtttccgggttaaacccgtacccggttccggttaaaccggttacccggacccggtttaacccccgggacctaaaacccccccgggttaaccccgtttacggttacccccggttaagttccccccg

SEQ ID NO: 258845 - DNA, 929 bp, Homo sapiens
  misc_feature: GYAE6OF02GXLZP.19.78.H01.1.454.CMB.1.raw
  modified_base (188)..(188): a, c, t, g, unknown or other
  misc_feature (188)..(188): n is a, c, g, or t
  modified_base (246)..(246): a, c, t, g, unknown or other
  misc_feature (246)..(246): n is a, c, g, or t
tcagtactctcgtgcacgaccggtgctcgatttagtgtgagtagtttggggtttgggggggggtcacaagaggcagcgctctcgggacgtctccaccatggcctgggctctgctgctcctcactcctcctcacctgacggacacgcgggtccgtcgggccctagtctcgcccgtagactccagttccncgtccgtccgtgttcgtcgggttcctaccgtggacgtacggttccggtaccaaccgtnttccctaccgtcgaccgttaaccggtaccggaaaccctggaaccggttaacgtggttaaccggtttaggtttaaacggttaacgtttacctttaaaccgttccggttccttacccggttaacggttaaacccaaacgtaaccttaacccgaaaaaccctaaaacgtaaacccccgtaaaccccctaacctacttaaccttaacttaacgttttaacacggtacctttaccggaacctaaaccggttaacgggccccggttaccgttaacggggtttaacgggttttacctaacggtccgtttaccgttccgtcggtttacggaccgtttaaacggtccggtttaacgccccgttaaacaacccgggttacccttccccgtaacgttacgtaaaccggttaacggttcccgttccgggcgtttaacccgcccggtaagggttaccgagggtaacccggtaaggtccgggttaacttaacggtactttacgttccggacggtttctaccggtctaaggtacttagggtcccggaacgtttgtaacctccgtttatttaccgggttacctaccggttacgtacggggttaaccggtaccgaccgttaacggtcccgttacccggtaagtacgtacccggacccgaacgtacccctaccttccgggactttccgaccgtttaccccg

SEQ ID NO: 258846 - DNA, 773 bp, Homo sapiens
  misc_feature: GYAE6OF02JKAUB.19.78.H01.1.454.CMB.1.raw
  modified_base (213)..(213): a, c, t, g, unknown or other
  misc_feature (213)..(213): n is a, c, g, or t
  modified_base (219)..(219): a, c, t, g, unknown or other
  misc_feature (219)..(219): n is a, c, g, or t
  modified_base (757)..(757): a, c, t, g, unknown or other
  misc_feature (757)..(757): n is a, c, g, or t
  modified_base (765)..(765): a, c, t, g, unknown or other
  misc_feature (765)..(765): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggacacgagggtcctcgggcccagtctcgccctgactctacgtctcgcctcgtgtctgggtctcgtggacagtcgcacntctccngacagtacgacagcagtcatgttagaacttctacgttgtctccgtcgtaaccaactactacaacccctaaaagtaaaccgacccccctaaactcgaacttactaagttttaactacggaacttccgaccgtaaacgtaacggtccccggtcccgttaacgggttaacggggttttaacctaacgtttccgtaacctttcctacggttccggtacctaccgtaaaccggttcgtcggaacctaaccggttaccggacccttcccgtagtaaccgttaacgttcccgttacgggtacccgggtaccctaccggttaaccgggtcgttaaacggggaccgggaaccggttaaaccggtactacggttaaactttaacccgttaaccggttacgtaccgtacgtactttaacgaggttaccttggaaaccgtttcggtacttaccgttcgttactttacgtcgttacgttacgtacggccggttaaactccggtactacccgttaggtaccgacgtaaccgcccggtacgtacccctaaccncggttacnccgttacc

SEQ ID NO: 258847 - DNA, 792 bp, Homo sapiens
  misc_feature: GYAE6OF02JIEO9.19.78.H01.1.454.CMB.1.raw
  modified_base (176)..(176): a, c, t, g, unknown or other
  misc_feature (176)..(176): n is a, c, g, or t
tcagtactctcgtgcacgaccggtgctcgatttagtgtgagtagtttgggttgggggggggtcacaagaggcagcgctcgtcgggaccgtctccaccatggcctgggctctgctgctcctcactctcctcactcaggacacgagggtcctagggcccaggtctcgccctagactcncgtctgccctacgtgtcgtggtactccgtaggactcggtcgtaccacctatccctcctgacctaccgtggaaccatccgtagtggatttggtaacgtaaccttctaaccttcgtctcggtacgtaccaactactaccgtaacctaaacaccccgtaccctaactctacgtacttacttacgtacgtactaccgaccacgttaaccgcccggttacccgttacggttaacggttctaccggtaccttcgttacctcggtacgtacctaccgtagtcgtaccgaaccggacttccggtcctaacccgtggttaaacctccgttccgtaccggtccggtaccgtaccggtaccgtaccgtaccggtaacggggtaaccggtaggttacgtaccgttacgttacccgttaacgtccgtaccgttccgaccttagtacttacggccgttaacgaccgggtaccgttaacgttaccgttaaccggtttcggtacggtaaccgggttaccggaccgggtaccctaacggtaccggttacccggaacccgttcgtaccggtaacccgtaccgtaccggtacccgtccgtaacccccgttccggtcccgttacccgttaccccgg

SEQ ID NO: 258848 - DNA, 677 bp, Homo sapiens
  misc_feature: GYAE6OF02F8W15.19.78.H01.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (658)..(658): a, c, t, g, unknown or other
  misc_feature (658)..(658): n is a, c, g, or t
tcagtactctcgtgcacgaccggtgctcgatttagtgtgagtagtttgggtttgggggggggtcacaagaggcagcgctctcgggacgtctccaccatggcctgggctctgctgctcctcactctcctcactcaggtacacagggtcctgggcctagtctgccctgactcagtctgcctccgtgtctggtctcctagacngtccgtcaccgntctcctgcacgtacggaaccagcgagtgatgttacggaaacttcgtaacttgtactaccgtcggtaaccgaactacgtaccgtaaccaaaactaaaccgaccccctaaatccaacttacctaagttatatacgtaccgacctaacgtaacgtccgtccgttacgtacgggtttactaacgtcgtacttcgacgtcgactacgtaacgtcgtacgacaacgtccgtacctcgtactactacgtcgtacgtacggtacctacgaggtaccgtaggacggacgtacggtacgttagtaacgttaccgtagtacgtcgtacgtcgtaacacgttagacgtactagtacgttactgtactttcgtcgttacgtacgtacgtaccgggtaactaacggtccgtaccggttacgtaacggactaacccggacccaaccgtaaccccgaacccncggttccgtacgttacccg

SEQ ID NO: 258849 - DNA, 588 bp, Homo sapiens
  misc_feature: GYAE6OF01BY145.38.21.B10.1.454.CMB.1.raw
  modified_base (380)..(380): a, c, t, g, unknown or other
  misc_feature (380)..(380): n is a, c, g, or t
tcagtcgatcacgtcacgaccggtgctcgatttagtgtcgtcgcaagggggagctctgggagacgagcccagcactggaagtcgccggtgtttccattcggtgatcatcactgaacacagaggactcaccatggagtttgggctgagcgtggtttcgcgttaggctctttaagaggtgtccaatgtcacgtacaactggtggaatctggaggaggcttggtccagtctgggacgtccttaaggctctcctgtgcagcctctggattcaacttcaggtacttataccttccacgtgggtccgccagtctccaggcaaggggctggagtgggtggcagctatatcatatgataggaaacactaaatactaggagactaccgnggaaacgggccgattcctcatctccagagactagtaccaaagaacaccctgtacctctagacctaaatgaacgcaagccctagacgaccgtaggaacggacacgggacttggttaccttagtttaaccgtggttacgtacgaaggtaacggaacttaacgaaaacgtttacctaattaacctaaattaaaacgttaaactaaaccccg

SEQ ID NO: 258850 - DNA, 662 bp, Homo sapiens
  misc_feature: GYAE6OF01AQJA3.38.21.B10.1.454.CMB.1.raw
  modified_base (253)..(253): a, c, t, g, unknown or other
  misc_feature (253)..(253): n is a, c, g, or t
  modified_base (303)..(303): a, c, t, g, unknown or other
  misc_feature (303)..(303): n is a, c, g, or t
tcagtcgatcacgtcacgaccggtgctcgatttagtgtcgtcgcaaggggagctctgggagacgagcccagcactggaagtcgccagtgtttccattcggtgatcatcactgaacacagaggactcaccatggagtttgggctgagctgggttttcctcgttgctcttttaagaggtgtccaatgtcacgtacaactggtggaatctggaggaggcttgggtccagtctgggacgtccttaaggctctcctgngcagccttctggattcaacttcaggtacttataccttccagtcgggtccncctagtcctccgacgggtcaaggggctcgggaggtggggtacgccaggtcctaatactctaatcgtagacgtaaggaaacctaacgttaaatacgtacgggatactccggtaggaacggccgtacttctaccagttacctccgaagtacgtaacgtacgttacccaaacggtaacctaccccgtgtaccttccgtaacggacctaaaagtcggtaacgccaaacggttccctaaagggtccgtaaccgtaggacggtaccaccgggtccttgttaccttaattaccggtggttacggttacaacgggtacgtaaacttacggtaaaaacgttcctaaatccgtaaaattaaagtaaccc

SEQ ID NO: 258851 - DNA, 556 bp, Homo sapiens
  misc_feature: GYAE6OF01CJ93G.38.21.B10.1.454.CMB.1.raw
  modified_base (356)..(356): a, c, t, g, unknown or other
  misc_feature (356)..(356): n is a, c, g, or t
  modified_base (500)..(500): a, c, t, g, unknown or other
  misc_feature (500)..(500): n is a, c, g, or t
  modified_base (525)..(525): a, c, t, g, unknown or other
  misc_feature (525)..(525): n is a, c, g, or t
tcagtcgatcacgtcacgaccggtgctcgatttagtgtcgtcgcaagggggagctctgggagacgagcccagcactggaagtcgccggtgtttccattcggtgatcatcactgaacacagaggactcaccatggagtttgggctgagctgggttttcctcgttgctcttttaagaggtgtccaatgtcacgtacaactgatggaatctggaggaggcttggtccagtctgggacgtccttaaggctctcctgtgcagcctctggattcaacttcaggactttactaccttccacgtgggtcccgccacggtcctccaggcgaaggggctgggagtggggtgcagctagtatcatangataggaaacactaaatactaacggacgactaccgtaggaagggccgtattcctccatcctaccagacgacacgttaccaaagaccaccctgtcctacgtcgacaatcgagccagccctagacgaccgtagaccgacaccgggntcggtactattactgtgtacaggtnatacgtaaacgtactaatcaattaataaacc

SEQ ID NO: 258852 - DNA, 639 bp, Homo sapiens
  misc_feature: GYAE6OF01ET07H.38.21.B10.1.454.CMB.1.raw
  modified_base (319)..(319): a, c, t, g, unknown or other
  misc_feature (319)..(319): n is a, c, g, or t
  modified_base (370)..(370): a, c, t, g, unknown or other
  misc_feature (370)..(370): n is a, c, g, or t
  modified_base (484)..(484): a, c, t, g, unknown or other
  misc_feature (484)..(484): n is a, c, g, or t
tcagtcgatcacgtcacgaccggtgctcgatttagtgtcgtcgcaagggggagctctgggagacgagcccagcactggaagtcgccggtgtttccattcggtgatcatcactgaacacagaggactcaccatggagtttgggctgagctgggctttcctcgttgcttcttttaagaggtgtccaatgtcacgtacaactggtggaatcgtgggaggaggcttggtccagtcgtgggacgttccttaaggctctccgtgtcgcagtcctcgtggtattacaacttcgaaggtactttactaccttccacgtcgggtcccncagtcctccgaggcgaaggggctgggagtgggtgcagtctatagtcatagngaagtacggaaactacgttaaatacgtacggacgtaccgtcggaggaaacggggtcctagtttccacctactcgtaccaagacgtacacgttacaacgacctacctgtcctacncgaactaagcgacacgtaacgtcctaggaacgtaccgtaggaaccgggtaccacggtcttaccggttactaagtttaccgtggttacgtacgtaaggaaccgttaaattaaccggtaaaacttaccgttaaatactaaagttaaacgttaaaccc

SEQ ID NO: 258853 - DNA, 731 bp, Homo sapiens
  misc_feature: GYAE6OF01AGCKF.38.21.B10.1.454.CMB.1.raw
  modified_base (179)..(179): a, c, t, g, unknown or other
  misc_feature (179)..(179): n is a, c, g, or t
  modified_base (309)..(309): a, c, t, g, unknown or other
  misc_feature (309)..(309): n is a, c, g, or t
  modified_base (554)..(554): a, c, t, g, unknown or other
  misc_feature (554)..(554): n is a, c, g, or t
tcagtcgatcacgtcacgaccggtgctcgatttagtgtcgtcgcaaggggagctctgggagacgagcccagcactggaagtcgccggtgtttccattcggtgatcatcactgaacacagaggactcaccatggagtttgggctgagctgggttttcctcgttgcttcttttaagaggtntccaatgtcacgtacaactggtggaatcgtggaggaggtcttggtccagtctgggactcctaaggcctctccgtgtacgcagcctatggattccaacttcaggtacttataccttccacgttgggtcccnccagttcctcccgaggaccgtaagggggcctagggaggtcggggtgccaaggtccttaagtatccagttaagtggaactacgggaaaacctaagttaaaacgtacggtaaccgggatacccgttacccggggtaggaccggggtaccctaagtttacccttacccgagttacccgtccgaacggtaacgtaacccgtaacggtttacccgaaaaggtaaccccacccgtttgtaccctccggtanaaccgtaaagtcgacgtaaccgcgaccgttaggaacgttccgacggtacgaacgttccgacggttaccttgttaaacgttacgtttcggacgtttaaccgaagtaaccgtacttaaaaccgaaacgggtttacaaaccggtaatttaaacccttaaagtaacccggttaaacccccg

SEQ ID NO: 258854 - DNA, 740 bp, Homo sapiens
  misc_feature: GYAE6OF01A0HSE.38.21.B10.1.454.CMB.1.raw
  modified_base (428)..(428): a, c, t, g, unknown or other
  misc_feature (428)..(428): n is a, c, g, or t
tcagtcgatcacgtcacgaccggtgctcgatttagtgtcgtcgcaagggggagctctgggagacgagcccagcactggaagtcgccggtgtttccattcggtgatcatcactgaacacagaggactcaccatgggagtttgggctgagcttgggttttcctcgttgcttcttttaagaggtgtccaatgtcacgtacaatggtaggaatcgtgggaggaggtcttggtccagtcgtggggaccgttccttaaggcctccttccgtgtcgcacggtcccttcgtggtaactttacctaaaccttccgaagggttacctttaacttaacccctttccccgtaccggttcggggtccccgtaccctacgttcctccggagggacggaacgggggtcctggggtaggtggggtgcgagtctatatacagtangatacgggaaaactactaaatacgtaacggaacgccgtacggtaggaacgggtcctaacttcctacctacttcctaccgtagacgtactaacgttaaccaacgtacccaccgtgtcctactacgaactaacgtcgaacgtccgaacgtccgtacggaaccgtacccgtaggaaccggaacccggtaccggtacgttacggttaaccgttacgtttaccgtcggttaacggtacgtaaggtaaaccgtaacgttaaacgtaaacgttaaccttaagtaaaccttaacgttaaaacctaaaccgttaacccccg

SEQ ID NO: 258855 - DNA, 736 bp, Homo sapiens
  misc_feature: GYAE6OF01DTILK.38.21.B10.1.454.CMB.1.raw
  modified_base (181)..(181): a, c, t, g, unknown or other
  misc_feature (181)..(181): n is a, c, g, or t
  modified_base (216)..(216): a, c, t, g, unknown or other
  misc_feature (216)..(216): n is a, c, g, or t
  modified_base (597)..(597): a, c, t, g, unknown or other
  misc_feature (597)..(597): n is a, c, g, or t
tcagtcgatcacgtcacgaccggtgctcgatttagtgtcgtcgcaaggggagctctgggagacgagcccagcactggaagtcgccggtgtttccattcggtgatcatcactgaacacagaggactcaccatggtagtttgggctgagtcttgggttttcctcgttgcttacgttttaaggnggtcgtccaatgtcacgtacaagtggtagaatcgnggaggagtcttggctagtcggtggtacgttaccttaaggcttctcgtgtcgcgtacgccttcgtaggtacttacgtaaccgttgaacggttacctttaaccgtacccttccgtacggtccgggtccctaccgacgtttccaccggtaggaccgggtaaacggggtccttaggggaacggttggggtacgacgtaacggtcttaaagttacgtacgtaagttacgtaggaaagttaaacggaaaacctaagttaaaacgacgtaacggagtacctacggaggacggtcctattccacgtcacgaccgagtaccgtatacgtacaaacgtaccctaccgtgtaccctagacgtaataacgtagtacgacgtaccgtacggtanaaccgcgttaaggaccgtacgtacggtacgtttacgtcgttaaactacgttcggtaactaacggaacgttaaacgtaaccgttaaaagaaccgttaacttaacgaaattaaaccgttaaaacctaccggttaacccccc

SEQ ID NO: 258856 - DNA, 792 bp, Homo sapiens
  misc_feature: GYAE6OF01CYHSV.38.21.B10.1.454.CMB.1.raw
  modified_base (177)..(177): a, c, t, g, unknown or other
  misc_feature (177)..(177): n is a, c, g, or t
  modified_base (255)..(255): a, c, t, g, unknown or other
  misc_feature (255)..(255): n is a, c, g, or t
tcagtcgatcacgtcacgaccggtgctcgatttagtgtcgtcgcaaggggagctctgggagacgaacccagcactggaagtcgccggtgtttccattcggtgatcatcactgaacacagaggactcaccatggagtttgggctgagtcttgggttttcctcgttgcttcttttaagnggttgtccaatgtcacgtacaactggtgaatcgtggaggagcttggtccagtcgtgggactcgtaggctctctgtgcngcctcgtgacttcaacttcacggtacttactaccttccacgttcgggtaccgcctagtccgtccgacgggtacgagggggtcgtgggtagggtacgggtcgggacgtaggtcctaagtacttacgaatagtggtaagtaacggtaaaacctaacttaaaacgttacgtaacggacgtaacgtccgttagggaaccgggtctaaccgttacgtacctacgttcccgtaccgaacggtaacggtaaccgtacgttaacccgaaaccggtaaaccctaccccggttacttaccgtccgtaacgggtaaacctaaacggttcggaaccgacgttacggccgtaacggtaccggtaaccggtagggaaccggtaccggtaccgggttaccgttaacggttaccggttacctttacgttaagggtaccggttaacggtaaacggtaaggttaaacccgttaaaacggttaaaacgtttaccttaaaccttaacgttaaagttttaaaacccgttaaaccttaaccccgttaaaccccccccgg

SEQ ID NO: 258857 - DNA, 861 bp, Homo sapiens
  misc_feature: GYAE6OF01CN1I1.38.21.B10.1.454.CMB.1.raw
tcagtcgatcacgtcacgaccggtgctcgatttagtgtcgtcgcaaggggagctctgggagacgagcccagcactggaagtcgccggtgtttccattcggtgatcatcactgaacacagaggactcacatggagtttggctgtaacgttgggttttcctcgtagcttatttaacgaggtgtccagtgtcagatcgcaggcgtggtggtaggtcggtagggggattcggtacggtccgacggtcccgggttggggggtcccctaggaacgtccttccgtccgtggtcgccgtaacgtccgttcggtacggtaactttacctaaaacctttaacgttaaaaaagtttcggtacgggtactacggtaccggtaacggttcggggtacccccgtaccggtaacggtacccgttaccgggaaggaccgggtaaacgggggttccgttagggggtaggttacgggggttacgtaaccttaaacggttaacttacgtaccggttaaattaggtaagttaacgggttaaaggtttaaaacgttttaaacggtagtaacggttaaccgggccggtttaaacccggtcgtaaccggggtaacccggtcttaaccgtttaccaaccgttacgtacccgtacggaaacgtacgttaaaacgtcgttaacgaaccggtacgtaccctaactacccgtagtttacgtaacaaactaaagtaccgtaacgacggtaccggtagggtacgtaacgttacggacggtaaccgtacggttcgttagtaccgtagtttaccggcgtaacggtaaccgaaccgggttcctaccggttagtaacggggttcggggtaagttacggttcggtcggtaccgggg

SEQ ID NO: 258858 - DNA, 1049 bp, Homo sapiens
  misc_feature: GYAE6OF01EVZCU.38.21.B10.1.454.CMB.1.raw
tcagtcgatcacgtcacgaccggtgctcgatttagtgtcgtcgcaaggggagctctggggagacgagcccagcactggaagtcgccggtgtttccattcggtgatcatcactgaacacaggagactcacctatgggagtttgggctgagtcgttgggttttcctcggttgtctttacgttttaaggacgggttcgtacctaaagttcggtaccaacgtaacaacgttgggtacggtaattcggtaggggagggtacggtcgttacgggtccctaggttcgtacgggggtaccttaccggttaacggccttccgtaccgtggtcgtacacggtcccttacggtggttaacttaccgtaaccgtttacgtaacgggttaacctttaacctaccccgtttaccccgtaaccggttccggggtacccccgtaccgtaccggttaccttaacccgggaacggggtacccgggtaaacggggggttccgttaaggggggtaccggggttagggggtccggtaacccgtagggttaccttaacgtacggttaaccaacgtttaaggtcggtaaaacgtaaccggggtaaaaaccttaacgtttaaaaacgtaacccgggtaaaccggggtaactaccccgggtttacggtaaacgggggtaaacgggttcccgttaaacgtttaccccgtccgtaaaccgttacccgaaccggtaacggtaaacgttaaccccggtacggttaaacccgtaaacccgtaacccgttacccgttacggttacccgttaacgtaccggtaaacctaaagggttccggaaccggtaccgtaaccgttacgggtaccggtaaccgtaaccggggtttaaccggaaccgggtaacccggtaccgggtttacccgttacgggttttaccctttaaacgggtttacccggttacggttaacccgttaaggtaaccggttaaaaccgtaaccgttaaaacccggtaaaagttttaacccgttaaatttaaacccggtaaaacttaaaaccctttaaccggtaaaccccccccgg

SEQ ID NO: 258859 - DNA, 513 bp, Homo sapiens
  misc_feature: GYAE6OF02IVU4Q.38.21.B10.1.454.CMB.1.raw
  modified_base (299)..(299): a, c, t, g, unknown or other
  misc_feature (299)..(299): n is a, c, g, or t
  modified_base (370)..(370): a, c, t, g, unknown or other
  misc_feature (370)..(370): n is a, c, g, or t
  modified_base (488)..(488): a, c, t, g, unknown or other
  misc_feature (488)..(488): n is a, c, g, or t
  modified_base (502)..(502): a, c, t, g, unknown or other
  misc_feature (502)..(502): n is a, c, g, or t
tcagtcgatcacgtcacgaccggtgctcgatttagtgtcgtcgcaaggggagctctgggagacgagcccagcactggaagtcgccggtgtttccattcggtgatcatcactgaacacagaggactcaccatggagtttgggctgagctgggttttcctcgttgctcttttaagaggtgtccaatgtcacgtacaactggtggaatctggaggaggcttggtccagtctgggacgtccttaaggctctcctgtgcagcctctggattcaacttcaggacttataccttccactgggtccnccagtctccaggcaaggggctggagtgggtggcagctatatcatatgatggaaacactaaatactacgganactccgtgaagggccattctccatctccagagacagttccaagaaccaccctagtcctctgaccaaatgagcagcctgacgacctgacggacacggctgtctattactgtgtcagganatacaagtactatnaatataatacc

SEQ ID NO: 258860 - DNA, 532 bp, Homo sapiens
  misc_feature: GYAE6OF02GWV7G.38.21.B10.1.454.CMB.1.raw
  modified_base (299)..(299): a, c, t, g, unknown or other
  misc_feature (299)..(299): n is a, c, g, or t
  modified_base (406)..(406): a, c, t, g, unknown or other
  misc_feature (406)..(406): n is a, c, g, or t
tcagtcgatcacgtcacgaccggtgctcgatttagtgtcgtcgcaaggggagctctgggagacgagcccagcactggaagtcgccggtgtttccattcggtgatcatcactgaacacagaggactcaccatggagtttgggctgagctgggttttcctcgttgctcttttaagaggtgtccaatgtcacgtacaactggtggaatctggaggaggcttggtccagtctgggacgtccttaaggctctcctgtgcagcctctggattcaacttcaggacttataccttccactgggtccnccagtctccaggcaaggggctggagtggggtgcagctatatcatatgatggaaacactaaatactacggagactccgtagaagggccattcctccatcctaccaganactagttaccaagaaccaccctgtcctctgacaaatgaagccagcctagacgtacctagacggacacgggctgtctattactggtcgtcagagactagaaagttactatactaataatataacccg

SEQ ID NO: 258861 - DNA, 671 bp, Homo sapiens
  misc_feature: GYAE6OF02ICSS1.38.21.B10.1.454.CMB.1.raw
tcagtcgatcacgtcacgaccggtgctcgatttagtgtcgtcgcaaggggagctctgggagacgagcccagcactggaagtcgccggtgtttccattcggtgatcatcactgaacacagaggactcaccatggagtttgggctgagctgggttttcctcgttgctcttttaagaggtgtccaatgtcacgtacaactggtggaatctggaggaggctttgggtccagtcgtgggacgttccttaagggctctcctgtgcagcctctggattcaacttcaggtaccttataccgttccacgtcgggtcccgtccagttcctccgacgggtcgaaggggtctggagtttggggtcgcgaggtcctagtatccaagttatggtaatacggaaacacttaaaagtacgtaaccggtagtaaccgttacccggaggaaccgggtccgtattcctaccgtactccttacgagaacgtcgtaaacgttaccaaacggtaaccctacccgttagtaccttaccgtagaccgtaaacgtacggacaccgacgtacctcgtaaccgtacgtacgggaaccgaaccggaacggtcctaggttaccttacgttaaccttggtaactcgaagtacgtaactacgtaaacgttaactagttaactaagtaacttaacgtaacccg

SEQ ID NO: 258862 - DNA, 722 bp, Homo sapiens
  misc_feature: GYAE6OF02JPQ0K.38.21.B10.1.454.CMB.1.raw
tcagtcgatcacgtcacgaccggtgctcgatttagtgtcgtcgcaagggagctctgggagacgagcccagcactggaagtcgccggtgtttccattcggtgatcatcactgaacacagaggactcaccatggagttggctgagctgggtttcctcgttgctctttagaggtgtccaatgtcacgtacaactggtgaatctggaggaggtcttggtccagtcgtgggacgtccgttaaggctctccgtagtcgcacgtcctacgtggtacttcgtaaccttcgacggtaacctttacttacccttacctaacgttcgggtaccctacccgtaacggttcctacccgtagggacctaacgggggtcctacggggacggttgggggtcggaccgtaggtccgttaagttaactccgtaagttacttaggagtttaacggaaactaacgttaaatacgtaaccggagtaccctcggtaacgacgggcctaattcctcgactctccgaagacacgtacgttaccgaacgtaccaccccgttgtccgttacgtacgaacgtaaacgttcggaaccgtcgaacgtaccgttacggaaccgtaccggttacgaacgtacccggacggtaccgtacgttaccgtacgttaccggtgttcggtaccgtaacggtagtaaccgtacgttaaaggtccttaacgtaacgtaatttaaccgtaacgttaaccccg

SEQ ID NO: 258863 - DNA, 736 bp, Homo sapiens
  misc_feature: GYAE6OF02JHHBH.38.21.B10.1.454.CMB.1.raw
tcagtcgatcacgtcacgaccggtgctcgatttagtgtcgtcgcaaggggagctctgggagacgagcccagcactggaagtcgccggtgtttccattcggtgatcatcactgaacacagaggactcaccatggagtttgggctgagcttgggttttcctcgttgcttcttttaaggaggtgtccagtgtcagatgcagctggtggagtcgtgggggagtcggtggtccgaggccgtggggggtcccctggacgtcctctccgtgtcgcacgtcctcgtggtacttaccaaacttactaaaaattgtagggtactcgactacggtcgggtacccgccgacggcctccgacgggacgaaggggtctagggaggtgggtcggtacaacgtatatacgatatggagttaagggtaaagtttaaagacgttagtcgggaccggtaccgtaccggtaaggaacgggccgtacgttaccaccgtaacttcccgtaccgaaggtaacgaaaccttaacgttacccgaaaggccgtaaccgtaaccttaaccttacgtttaatttaccgaaaccgtaaagttacgaaacgtccggtacccggttagggaaccttcggtaacgggaacggaaccgtaccgggtcttacggtttaacgtacgttaacggtggaacgtaaccggaaaccggttaccccgtaccgttcggttaacgggtcggggttaacgggttacgttacggttcggg

SEQ ID NO: 258864 - DNA, 568 bp, Homo sapiens
  misc_feature: GYAE6OF02FJHWO.38.21.B10.1.454.CMB.1.raw
  modified_base (359)..(359): a, c, t, g, unknown or other
  misc_feature (359)..(359): n is a, c, g, or t
tcagtcgatcacgtcacgaccggtgctcgatttagtgtcgtcgcaagggggagctctgggagacgagcccagcactggaagtcgccggtgtttccattcggtgatcatcactgaacacagaggactcaccatggagtttgggctgagctgggttttcctcgttgctcttttaagaggtgtccaatgtcacgtacaactggtggaatctggaggaggcttggtccagtcgtgggacgtccgttaaggctctcctgtgcagcctctggattcaacttcaggtacttataccttccactgggtcccgccagtctccaggcaaggggctggagtgggtggcagctatatcatatgatggaaanactaaatactacggagactcgtagacgggccgattctaccacgtctccagacgactagttaccaagaaccaccctgtacctctagaccaaatggaacgcaacggtcctaggaacgtacctaggacggaccacgggcttgtactttactacgtcggttagtcagacgtaatacgtaaacgtactaataccaaattaactaagttaacccc

SEQ ID NO: 258865 - DNA, 842 bp, Homo sapiens
  misc_feature: GYAE6OF02JQYP4.38.21.B10.1.454.CMB.1.raw
tcagtcgatcacgtcacgaccggtgctcgatttagtgtcgtcgcaaggggagctctgggagacgagcccagcactggaagtcgccggtgtttccattcggtgatcatcactgaacacagaggactcaccatggagtttggctgagctgggttttcctcgttgctctttaagagtgtccaatgtcacgtacaactggtggaatcgtggaggaggcttgggtccaggtctggggtaccgttccttaagggcctctcccgtggtcgctacgtcctcgtaggcttacgtaacttccgaggtacttacgtacccttccacggttcgggtcccgtaccgtacggtacctcccgaacggggaccgtaacggggggtccttaggggtacggttcgggggttaggaccgacgtaccttagtaagtcctaagtagttacgagtttaacgggaaaacctaaccgttaaagttaaccgtacgggtaacgtaaccgttccggggaaggtaaaccggggtacctaacgttaccgtaccgtacgtacccgttaccgaacgtacggtaacctaaccggttaaccgaaacggtaaacccgtacccgttacgggttacctttaccggacgttaaaccgtaaacgttcggaacggtacccgtaacgtacccgttaggtaaaccccgtaccggttaacggtaaaccgggtacggtaaccccggtacggtttacgttaacccgttttacgtaaccggtttcggttaaccgggttaccgtaaacggtaacgttaacggttaaacctaaacggttaaccttaaccgttaagtaaacccgtttaaacgtaacccggttaaaccccg

SEQ ID NO: 258866 - DNA, 707 bp, Homo sapiens
  misc_feature: GYAE6OF02GVOE5.38.21.B10.1.454.CMB.1.raw
  modified_base (171)..(171): a, c, t, g, unknown or other
  misc_feature (171)..(171): n is a, c, g, or t
  modified_base (197)..(197): a, c, t, g, unknown or other
  misc_feature (197)..(197): n is a, c, g, or t
  modified_base (213)..(213): a, c, t, g, unknown or other
  misc_feature (213)..(213): n is a, c, g, or t
  modified_base (252)..(252): a, c, t, g, unknown or other
  misc_feature (252)..(252): n is a, c, g, or t
  modified_base (628)..(628): a, c, t, g, unknown or other
  misc_feature (628)..(628): n is a, c, g, or t
  modified_base (643)..(643): a, c, t, g, unknown or other
  misc_feature (643)..(643): n is a, c, g, or t
  modified_base (652)..(652): a, c, t, g, unknown or other
  misc_feature (652)..(652): n is a, c, g, or t
  modified_base (696)..(696): a, c, t, g, unknown or other
  misc_feature (696)..(696): n is a, c, g, or t
tcagtcgatcacgtcacgaccggtgctcgatttagtgtcgtcgcaagggagcgtctgggagacgagcccagcactggaagtcgccggtgtttccattcggtgatcatcactgaacacagaggactcaccatggagtttggctgagctggtttcctcgttgctactttaagnggtgtccaatgtcacgtacacttggnggtaactgtggaaggnggcttggtccagtcgtgggactcgtaaggctctctggtncgatcctcgtgtacgttcaacttacaggtaccttagttaccttcctaacggtcgggtacccgccgtacgttccgtaccctacgggtccgtaaacgggggcccttagggtaacggtttcgggggttcgggacggtacgggtacctttaggttaacttaccgtattaagtgtaagaacgggtaaacaaacgttaaacgtaaccgtaacggtaacgaacgtttccccggtaaggtacgggggtacctacgttcctaccgtaactctccgaagttaacgacgaacgttccgaaacgaaccaacctttcggccttacgtacgtaaacaacgttaagacgacgtacgacgttacgaacggtcaacggtacgacgaacgttcncggttctattaccgngttaccgtnaaccggtatacgtaacgtaacgttacctaatcccgtaaattaanaacttaacccg

SEQ ID NO: 258867 - DNA, 752 bp, Homo sapiens
  misc_feature: GYAE6OF02HIRJ0.38.21.B10.1.454.CMB.1.raw
  modified_base (361)..(361): a, c, t, g, unknown or other
  misc_feature (361)..(361): n is a, c, g, or t
  modified_base (719)..(719): a, c, t, g, unknown or other
  misc_feature (719)..(719): n is a, c, g, or t
tcagtcgatcacgtcacgaccggtgctcgatttagtgtcgtcgcaagggggagctctgggagacgagcccagcactggaagtcgccggtgtttccattcggtgatcatcactgaacacagaggactcaccatggagtttgggctgagcgttgggttttcctcgttgcttacgttttaagaggtgtccaatgtcacgtacaacgtggtagaatctgggaaggtggtcttcggccagtcgtgggaccgttccgttaaggcttctccgtaggtcgcgacgtcctcgtggtacttacaacttcgagtacttacgttacctccgacgtgggtcccactagtctccgaggaccgaaggggcttaggnggtcggggtgaccgtagaccttagtagtaccgaagttacgtaggtaaacggtaacggtaaaaaccttaaacgtaaaacgtttaccgaaacgggtaacgtaaccgttaccggggtaacgggaaacgggtcctaaccgtttcgtaacctacgtacccgttaacccgaaggtaaccgtaaccgttagtaacccgtaaaacggtaaccctacccgttaggttcctacggtacaagtaaacgttcgaacggtactaacggtccttacggacctaacggtcgaaccggaaccgttcggactttacgtaccttagttaacgcgttaaggtaccaaggtaaccgtaagtaacgtaaacggtttacnttaacggtaaattaccggtaaacttacccccgg

SEQ ID NO: 258868 - DNA, 670 bp, Homo sapiens
  misc_feature: GYAE6OF02HFERT.38.21.B10.1.454.CMB.1.raw
tcagtcgatcacgtcacgaccggtgctcgatttagtgtcgtcgcaagggggagctctgggagacgagcccagcactggaagtcgccggtgtttccattcggtgatcatcactgaacacagaggactcaccatggagtttgggctgagctgggttttcctcgttgctcttttaagagtgtccaatgtcacgtacaactggtgaatcgtggaggaggtcttggtccagtctgggacgttcctaaggcctctcctgtcgcagtcctcgtggtacttcaacttcaggtacttactacccttccgactcgggtcccgcctagtcctccgaggtaccgaaggggtctgggtacggtggggtgccgagtactagtactcgtaatatgataacggaaactaacgtaaactacgtaacggacgtacgtaccgtaggaacggtctacttcgtaccgtactcctaccgtaagacgaacgtacgttaccgaaacgtaaccgtacccgtacgttacctctagtaactaagtacgacgtacgacgtaccgtacgtaccgtacgtacggacgtaccggtacggtcgtacgttacgttacgtttcgttacggtcgtaccgtagtaacgtaacttaaccgtaaacttacttaaccgtaactaacgttaaacttaacgttaacccccg

SEQ ID NO: 258869 - DNA, 693 bp, Homo sapiens
  misc_feature: GYAE6OF02GE9CM.38.21.B10.1.454.CMB.1.raw
  modified_base (174)..(174): a, c, t, g, unknown or other
  misc_feature (174)..(174): n is a, c, g, or t
  modified_base (318)..(318): a, c, t, g, unknown or other
  misc_feature (318)..(318): n is a, c, g, or t
tcagtcgatcacgtcacgaccggtgctcgatttagtgtcgtcgcaagggggagctctgggagacgagcccagcactggaagtcgccggtgtttccattcggtgatcatcactgaacacagaggactcaccatggagttgggctgagcttgggtttcctcgtgctctttagagtntcatgtcacgtacactggtgaatcgtggaggaggtcgttgtccgtagtcgtgggtacgtaccgttaaggccttctacctggtcgctacgccttactggattacgtacttacgaggtacttactaccttcctacgtcgggtaccnctacgtctaccgaggaccgaaggggtcctagggaggtgggtcgggactacggcttataacgtcaatcgtaagtagtaacggaaactaaacctaagttaaccgtaaggaacgtactaccgggtaacgaaccggggtactaacgttcgtaccgtactacctccgaacgagtaaccgtagtaaccgtaacgaacccaccgttcgtccgtacttacgaacctagtaacgctacgacgactacgacgtacctacggaacgtaccgacgttacgtacgtaccgttacttaacggtaggtacccgttagaaaccgggtgtaaacctttaaggtaaccttaacggtaactttaacaaggttaaaccctaagttaacccccccg

SEQ ID NO: 258870 - DNA, 740 bp, Homo sapiens
  misc_feature: GYAE6OF02FE9K3.38.21.B10.1.454.CMB.1.raw
  modified_base (181)..(181): a, c, t, g, unknown or other
  misc_feature (181)..(181): n is a, c, g, or t
  modified_base (350)..(350): a, c, t, g, unknown or other
  misc_feature (350)..(350): n is a, c, g, or t
tcagtcgatcacgtcacgaccggtgctcgatttagtgtcgtcgcaagggggagctctgggagacgagcccagcactggaagtcgccggtgtttccattcggtgatcatcactgaacacagaggactcaccatggtagtttgggctgagtcttgggttttcctcgttgcttacttttaaggnggtgtccaatgtcacgtaacaacgtggtgatcgtgggaggaggtcttcggtccctagtcgtacggggtaccgttaccgttaaggccttctccgttggtcgcgcgtcctcgtggtacttactaaccgttcgaaggttaccttaactacccttccacgttccggggtcccncctagtcctccgaggtacgtaaggggtcctgggtacggtcggggtgccgaggtactaattacaccgtaagttagtacggtagtaaccggaaactaaacttaaacgttaccggtacggaacgtaccgtaccggggtaggaaccgggtacctacttacccgtaccgtactccgtaccgaagtacgtaccgtacgttaacaaccgtaacctacccgttgttacctcgtacaactaacgtcgacgtaccgaccgtaccgtacgaaccgtccgtaggaaccggtccaccggttcttaccgtactttacgtacgtacggttacgtaacaacggtaacgtaacgtaacgttaaaggttacctaacgtaacctaacttaaacgttaacctaaccccgg

SEQ ID NO: 258871 - DNA, 179 bp, Homo sapiens
  misc_feature: GYAE6OF01CSUXF.33.53.E09.1.454.CMB.1.raw
  modified_base (172)..(179): a, c, t, g, unknown or other
  misc_feature (172)..(179): n is a, c, g, or t
tcagtacacacactcacgaccggtgctcgatttagagagagtgtgttgggtttggggaagaggaagactgacggtccccaggagttcaggtgctgggccacagcggccctgggctgcctggtcaaggactacttccagtgtgtgtactgagcgggctggcaaggcgcatagnnnnnnnn

SEQ ID NO: 258872 - DNA, 173 bp, Homo sapiens
  misc_feature: GYAE6OF01DFDA1.33.53.E09.1.454.CMB.1.raw
  modified_base (171)..(173): a, c, t, g, unknown or other
  misc_feature (171)..(173): n is a, c, g, or t
tcagtacacacactcacgaccggtgctcgatttagagagagtgtgttgggtttggggaagaggaagactgacggtccccaggagttcaggtgctgggcacagcggccctgggctgcctggtcaaggactacttccagtgtgtgtactgagcgggctggcaaggcgcatagnnn

SEQ ID NO: 258873 - DNA, 175 bp, Homo sapiens
  misc_feature: GYAE6OF01DT4YU.33.53.E09.1.454.CMB.1.raw
  modified_base (173)..(175): a, c, t, g, unknown or other
  misc_feature (173)..(175): n is a, c, g, or t
tcagtacacacactcacgaccggtgctcgatttagagagagtgtgttgggtttgggggaagaggaagactgacggtcccccaggagttcaggtgctgggcacagcggccctgggctgcctggtcaaggactacttccagtgtgtgtactgagcgggctggcaaggcgcatagnnn

SEQ ID NO: 258874 - DNA, 174 bp, Homo sapiens
  misc_feature: GYAE6OF01A20CN.33.53.E09.1.454.CMB.1.raw
  modified_base (173)..(174): a, c, t, g, unknown or other
  misc_feature (173)..(174): n is a, c, g, or t
tcagtacacacactcacgaccggtgctcgatttagagagagtgtgttgggtttgggggaagaggaagactgacggtcccccaggagttcaggtgctgggcacagcggccctgggctgcctggtcaaggactacttccagtgtgtgtactgagcgggctggcaaggcgcatagnn

SEQ ID NO: 258875 - DNA, 174 bp, Homo sapiens; identical to SEQ ID NO: 258874
  misc_feature: GYAE6OF02GGO35.33.53.E09.1.454.CMB.1.raw
  modified_base (173)..(174): a, c, t, g, unknown or other
  misc_feature (173)..(174): n is a, c, g, or t

SEQ ID NO: 258876 - DNA, 175 bp, Homo sapiens; identical to SEQ ID NO: 258873
  misc_feature: GYAE6OF02H3RZU.33.53.E09.1.454.CMB.1.raw
  modified_base (173)..(175): a, c, t, g, unknown or other
  misc_feature (173)..(175): n is a, c, g, or t

SEQ ID NO: 258877 - DNA, 175 bp, Homo sapiens; identical to SEQ ID NO: 258873
  misc_feature: GYAE6OF02ISWLB.33.53.E09.1.454.CMB.1.raw
  modified_base (173)..(175): a, c, t, g, unknown or other
  misc_feature (173)..(175): n is a, c, g, or t

SEQ ID NO: 258878 - DNA, 197 bp, Homo sapiens
  misc_feature: GYAE6OF02G69D1.33.53.E09.1.454.CMB.1.raw
  modified_base (175)..(197): a, c, t, g, unknown or other
  misc_feature (175)..(197): n is a, c, g, or t
tcagtacacacactcacgaccggtgctcgatttagagagagtgtgttgggtttgggggaagaggaagactgacggtcccccaggagttcaggtgctgggcacaggccggccctgggctgcctggtcaaggactacttccagtgtgtgtactgagcgggctggcaaggcgcatagnnnnnnnnnnnnnnnnnnnnnnn

SEQ ID NO: 258879 - DNA, 177 bp, Homo sapiens
  misc_feature: GYAE6OF02G08GP.33.53.E09.1.454.CMB.1.raw
  modified_base (174)..(177): a, c, t, g, unknown or other
  misc_feature (174)..(177): n is a, c, g, or t
tcagtacacacactcacgaccggtgctcgatttagagagagtgtgttgggtttgggggaagaggaagactgacggtccccccaggagttcaggtgctgggcacagcggccctgggctgcctggtcaaggactacttccagtgtgtgtactgagcgggctggcaaggcgcatagnnnn

SEQ ID NO: 258880 - DNA, 184 bp, Homo sapiens
  misc_feature: GYAE6OF01BZ2YA.52.5.A05.1.454.CMB.1.raw
  modified_base (182)..(184): a, c, t, g, unknown or other
  misc_feature (182)..(184): n is a, c, g, or t
tcagcgcagtacgacacgaccggtgctcgattagatagatagacaggcaccaaggcccatcggtcttccctcgcgacctcctccaacgagcacctcctgggcggacagcggcccgtcggcgtgcctcggtcgaaggacgtacttcctactacgatcgctgagcggcgtggcaagcgcatagnnn

SEQ ID NO: 258881 - DNA, 178 bp, Homo sapiens
  misc_feature: GYAE6OF01B2OJY.52.5.A05.1.454.CMB.1.raw
  modified_base (178)..(178): a, c, t, g, unknown or other
  misc_feature (178)..(178): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctcgtagcactctgagcgggctggcaaggcgcatagn

SEQ ID NO: 258882 - DNA, 173 bp, Homo sapiens
  misc_feature: GYAE6OF01D5HEV.52.5.A05.1.454.CMB.1.raw
  modified_base (172)..(173): a, c, t, g, unknown or other
  misc_feature (172)..(173): n is a, c, g, or t
tcagcgcagtacgacacgaccggtgctcgatttagatagatagacaggcaccaaggccatcggtcttccctggcacctcctccaagagcacctctgggcacagcggccctgggctgcctggtcaaggactacttcctatacgatcgctgagcgggctggcaaggcgcatagnn

SEQ ID NO: 258883 - DNA, 180 bp, Homo sapiens
  misc_feature: GYAE6OF01D90YM.52.5.A05.1.454.CMB.1.raw
  modified_base (178)..(180): a, c, t, g, unknown or other
  misc_feature (178)..(180): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctatacgatcgctgagcgggctggcaaggcgcatagnnn

SEQ ID NO: 258884 - DNA, 181 bp, Homo sapiens
  misc_feature: GYAE6OF01ATY6F.52.5.A05.1.454.CMB.1.raw
  modified_base (178)..(181): a, c, t, g, unknown or other
  misc_feature (178)..(181): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctatacgatcgctgagcgggctggcaaggcgcatagnnnn

SEQ ID NO: 258885 - DNA, 177 bp, Homo sapiens
  misc_feature: GYAE6OF01EDQRJ.52.5.A05.1.454.CMB.1.raw
  modified_base (176)..(177): a, c, t, g, unknown or other
  misc_feature (176)..(177): n is a, c, g, or t
tcagcgcagtacgacacgaccggtgctcgatttagatagatagacagggcaccaaggcccatcggtcttccctggcaccctcctccaagagcacctctggggcacagcggccctgggctgcctggtcaaggactacttcctatacgatcgctgagcgggctggcaaggcgcatagnn

SEQ ID NO: 258886 - DNA, 181 bp, Homo sapiens
  misc_feature: GYAE6OF01ENCL3.52.5.A05.1.454.CMB.1.raw
  modified_base (173)..(181): a, c, t, g, unknown or other
  misc_feature (173)..(181): n is a, c, g, or t
tcagcgcagtacgacacgaccggtgctcgatttagatagatagacagggcaccaaggccatcggtcttccctggcaccctcctccaagagcacctctgggcacagcggcctgggctgcctggtcaaggactacttcctatacgatcgctgagcgggctggcaaggcgcatagnnnnnnnnn

SEQ ID NO: 258887 - DNA, 333 bp, Homo sapiens
  misc_feature: GYAE6OF01CHRNP.52.5.A05.1.454.CMB.1.raw
  modified_base (200)..(200): a, c, t, g, unknown or other
  misc_feature (200)..(200): n is a, c, g, or t
  modified_base (204)..(204): a, c, t, g, unknown or other
  misc_feature (204)..(204): n is a, c, g, or t
  modified_base (220)..(220): a, c, t, g, unknown or other
  misc_feature (220)..(220): n is a, c, g, or t
  modified_base (223)..(225): a, c, t, g, unknown or other
  misc_feature (223)..(225): n is a, c, g, or t
  modified_base (227)..(227): a, c, t, g, unknown or other
  misc_feature (227)..(227): n is a, c, g, or t
  modified_base (229)..(229): a, c, t, g, unknown or other
  misc_feature (229)..(229): n is a, c, g, or t
  modified_base (234)..(235): a, c, t, g, unknown or other
  misc_feature (234)..(235): n is a, c, g, or t
  modified_base (243)..(243): a, c, t, g, unknown or other
  misc_feature (243)..(243): n is a, c, g, or t
  modified_base (249)..(250): a, c, t, g, unknown or other
  misc_feature (249)..(250): n is a, c, g, or t
  modified_base (252)..(252): a, c, t, g, unknown or other
  misc_feature (252)..(252): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (265)..(265): a, c, t, g, unknown or other
  misc_feature (265)..(265): n is a, c, g, or t
  modified_base (267)..(267): a, c, t, g, unknown or other
  misc_feature (267)..(267): n is a, c, g, or t
  modified_base (269)..(269): a, c, t, g, unknown or other
  misc_feature (269)..(269): n is a, c, g, or t
  modified_base (278)..(278): a, c, t, g, unknown or other
  misc_feature (278)..(278): n is a, c, g, or t
  modified_base (281)..(281): a, c, t, g, unknown or other
  misc_feature (281)..(281): n is a, c, g, or t
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
  modified_base (301)..(301): a, c, t, g, unknown or other
  misc_feature (301)..(301): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (311)..(311): a, c, t, g, unknown or other
  misc_feature (311)..(311): n is a, c, g, or t
  modified_base (313)..(313): a, c, t, g, unknown or other
  misc_feature (313)..(313): n is a, c, g, or t
  modified_base (315)..(315): a, c, t, g, unknown or other
  misc_feature (315)..(315): n is a, c, g, or t
  modified_base (321)..(321): a, c, t, g, unknown or other
  misc_feature (321)..(321): n is a, c, g, or t
  modified_base (323)..(323): a, c, t, g, unknown or other
  misc_feature (323)..(323): n is a, c, g, or t
  modified_base (325)..(333): a, c, t, g, unknown or other
  misc_feature (325)..(333): n is a, c, g, or t
tcagcgcagtacgacacgaccggtgctcgatttagatagatagacagggacgaccaagggcccatccggtctttcccctaggcaccctcctccaacgagcacctctgggcacagcggccgtgggactcgcctggtcaaggactaacttcctagtacgattcgcttgagcgggctggggcccaaaggtccgcgagtacgtnaccnggcaggacctgcactntcnnncncncagcnncgtctccncgcgcnncncngncncncgngncncngcgcgcgcngcngngagactactcngtgtgtntntgngcggngngngagcgnanannnnnnnnn

SEQ ID NO: 258888 - DNA, 179 bp, Homo sapiens
  misc_feature: GYAE6OF01EOVD7.52.5.A05.1.454.CMB.1.raw
  modified_base (178)..(179): a, c, t, g, unknown or other
  misc_feature (178)..(179): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctatacgatcgctgagcgggctggcaaggcgcatagnn

SEQ ID NO: 258889 - DNA, 176 bp, Homo sapiens
  misc_feature: GYAE6OF01D4MH2.52.5.A05.1.454.CMB.1.raw
  modified_base (176)..(176): a, c, t, g, unknown or other
  misc_feature (176)..(176): n is a, c, g, or t
tcagcgcagtacgacacgaccggtgctcgatttagatagatagacagggcaccaagggcccatcggtcttccctggcaccctcctccaagagcacctctgggcacagcggccctgggctgcctggtcaaggactacttcctatacgatcgctgagcgggctggcaaggcgcatagn

SEQ ID NO: 258890 - DNA, 177 bp, Homo sapiens
  misc_feature: GYAE6OF01BWEO4.52.5.A05.1.454.CMB.1.raw
  modified_base (175)..(177): a, c, t, g, unknown or other
  misc_feature (175)..(177): n is a, c, g, or t
tcagcgcagtacgacacgaccggtgctcgatttagatagatagacaggcaccaaggcccatcggtcttcccctggcaccctcctccaagagcacctctggggcacagcggcctgggctgcctggtcaaggactacttcctatacgatcgctgagcgggctggcaaggcgcatagnnn

SEQ ID NO: 258891 - DNA, 180 bp, Homo sapiens; identical to SEQ ID NO: 258883
  misc_feature: GYAE6OF01DD0GR.52.5.A05.1.454.CMB.1.raw
  modified_base (178)..(180): a, c, t, g, unknown or other
  misc_feature (178)..(180): n is a, c, g, or t

SEQ ID NO: 258892 - DNA, 179 bp, Homo sapiens; identical to SEQ ID NO: 258888
  misc_feature: GYAE6OF01DUPSF.52.5.A05.1.454.CMB.1.raw
  modified_base (178)..(179): a, c, t, g, unknown or other
  misc_feature (178)..(179): n is a, c, g, or t

SEQ ID NO: 258893 - DNA, 179 bp, Homo sapiens; identical to SEQ ID NO: 258888
  misc_feature: GYAE6OF01EGMRT.52.5.A05.1.454.CMB.1.raw
  modified_base (178)..(179): a, c, t, g, unknown or other
  misc_feature (178)..(179): n is a, c, g, or t

SEQ ID NO: 258894 - DNA, 180 bp, Homo sapiens
  misc_feature: GYAE6OF01CSN6F.52.5.A05.1.454.CMB.1.raw
  modified_base (178)..(180): a, c, t, g, unknown or other
  misc_feature (178)..(180): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctcgtactgcgctgagcgggctggcaaggcgcatagnnn

SEQ ID NO: 258895 - DNA, 181 bp, Homo sapiens
  misc_feature: GYAE6OF01CPCTJ.52.5.A05.1.454.CMB.1.raw
  modified_base (179)..(181): a, c, t, g, unknown or other
  misc_feature (179)..(181): n is a, c, g, or t
tcagcgcagtacgacacgaccggtgctcgatttagatagatagacagggcaccgaagggcccatcggtcttcccctggcaccctcctccaagagcacctctggggcacagcggccctgggctgcctggtcaaggactacttcctatacgatcgctgagcgggctggcaaggcgcatagnnn

SEQ ID NO: 258896 - DNA, 185 bp, Homo sapiens
  misc_feature: GYAE6OF01BYVFD.52.5.A05.1.454.CMB.1.raw
  modified_base (178)..(185): a, c, t, g, unknown or other
  misc_feature (178)..(185): n is a, c, g, or t
tcagcgcagtacgacacgaccggtgctcgatttagatagatagacagggcaccgaagggcccatcggtcttcccctggcaccctcctccaagagcacctctggggcacagcggcctgggctgcctggtcaaggactacttcctatacgatcgctgagcgggctggcaaggcgcatagnnnnnnnn

SEQ ID NO: 258897 - DNA, 178 bp, Homo sapiens
  misc_feature: GYAE6OF01AHJ0X.52.5.A05.1.454.CMB.1.raw
  modified_base (178)..(178): a, c, t, g, unknown or other
  misc_feature (178)..(178): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctatacgatcgctgagcgggctggcaaggcgcatagn

SEQ ID NO: 258898 - DNA, 175 bp, Homo sapiens
  misc_feature: GYAE6OF01D744J.52.5.A05.1.454.CMB.1.raw
  modified_base (174)..(175): a, c, t, g, unknown or other
  misc_feature (174)..(175): n is a, c, g, or t
tcagcgcagtacgacacgaccggtgctcgatttagatagatagacaggcaccaaggccatcggtcttccctggcaccctcctccaagagcacctcgtgggcacagcggccctgggctgcctggtcaaggactacttcctatacgatcgctgagcgggctggcaaggcgcatagnn

SEQ ID NO: 258899 - DNA, 179 bp, Homo sapiens; identical to SEQ ID NO: 258888
  misc_feature: GYAE6OF01B8RCP.52.5.A05.1.454.CMB.1.raw
  modified_base (178)..(179): a, c, t, g, unknown or other
  misc_feature (178)..(179): n is a, c, g, or t

SEQ ID NO: 258900 - DNA, 179 bp, Homo sapiens; identical to SEQ ID NO: 258888
  misc_feature: GYAE6OF01DOLNI.52.5.A05.1.454.CMB.1.raw
  modified_base (178)..(179): a, c, t, g, unknown or other
  misc_feature (178)..(179): n is a, c, g, or t

SEQ ID NO: 258901 - DNA, 183 bp, Homo sapiens
  misc_feature: GYAE6OF01BR0O8.52.5.A05.1.454.CMB.1.raw
  modified_base (178)..(183): a, c, t, g, unknown or other
  misc_feature (178)..(183): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctcgtactgcgctgagcgggctggcaaggcgcatagnnnnnn

SEQ ID NO: 258902 - DNA, 199 bp, Homo sapiens
  misc_feature: GYAE6OF01CJCM3.52.5.A05.1.454.CMB.1.raw
  modified_base (179)..(199): a, c, t, g, unknown or other
  misc_feature (179)..(199): n is a, c, g, or t
tcagcgcagtacgacacgaccggtgctcgatttagatagatagacagggcaccaagggccatccggtcttcccctggcaccctcctccaagagcacctctggggcacagcggccctggctgcctggtcaaggactacttcctatacgatcgcttgagcgggctggtcaaggcgcatagnnnnnnnnnnnnnnnnnnnnn

SEQ ID NO: 258903 - DNA, 187 bp, Homo sapiens
  misc_feature: GYAE6OF01EK3G5.52.5.A05.1.454.CMB.1.raw
  modified_base (179)..(187): a, c, t, g, unknown or other
  misc_feature (179)..(187): n is a, c, g, or t
tcagcgcagtacgacacgaccggtgctcgatttagatagatagacagggcgaccaagggcccatcggtcttcccctggcaccctcctccaagagcacctctggggcacagcggccctgggctgcctggtcaaggactacttcctatacgatcgctgagcgggctggcaaggcgcatagnnnnnnnnn

SEQ ID NO: 258904 - DNA, 178 bp, Homo sapiens; identical to SEQ ID NO: 258897
  misc_feature: GYAE6OF01D3W4Y.52.5.A05.1.454.CMB.1.raw
  modified_base (178)..(178): a, c, t, g, unknown or other
  misc_feature (178)..(178): n is a, c, g, or t

SEQ ID NO: 258905 - DNA, 180 bp, Homo sapiens; identical to SEQ ID NO: 258883
  misc_feature: GYAE6OF01EW0W1.52.5.A05.1.454.CMB.1.raw
  modified_base (178)..(180): a, c, t, g, unknown or other
  misc_feature (178)..(180): n is a, c, g, or t

SEQ ID NO: 258906 - DNA, 190 bp, Homo sapiens
  misc_feature: GYAE6OF01DBL7X.52.5.A05.1.454.CMB.1.raw
  modified_base (179)..(190): a, c, t, g, unknown or other
  misc_feature (179)..(190): n is a, c, g, or t
tcagcgcagtacgacacgaccggtgctcgatttagatagatagacagggcaccgaagggcccatcggtcttcccctggcaccctcctccaagagcacctctggggcacagcggccctgggctgcctggtcaaggactacttcctatacgatcgctgagcgggctggcaaggcgcatagnnnnnnnnnnnn

SEQ ID NO: 258907 - DNA, 180 bp, Homo sapiens; identical to SEQ ID NO: 258883
  misc_feature: GYAE6OF01C4XI6.52.5.A05.1.454.CMB.1.raw
  modified_base (178)..(180): a, c, t, g, unknown or other
  misc_feature (178)..(180): n is a, c, g, or t

SEQ ID NO: 258908 - DNA, 179 bp, Homo sapiens; identical to SEQ ID NO: 258888
  misc_feature: GYAE6OF01CGWCT.52.5.A05.1.454.CMB.1.raw
  modified_base (178)..(179): a, c, t, g, unknown or other
  misc_feature (178)..(179): n is a, c, g, or t

SEQ ID NO: 258909 - DNA, 176 bp, Homo sapiens; identical to SEQ ID NO: 258889
  misc_feature: GYAE6OF01AE90H.52.5.A05.1.454.CMB.1.raw
  modified_base (176)..(176): a, c, t, g, unknown or other
  misc_feature (176)..(176): n is a, c, g, or t

SEQ ID NO: 258910 - DNA, 180 bp, Homo sapiens; identical to SEQ ID NO: 258883
  misc_feature: GYAE6OF01AWKHN.52.5.A05.1.454.CMB.1.raw
  modified_base (178)..(180): a, c, t, g, unknown or other
  misc_feature (178)..(180): n is a, c, g, or t

SEQ ID NO: 258911 - DNA, 180 bp, Homo sapiens; identical to SEQ ID NO: 258883
  misc_feature: GYAE6OF01A6I4K.52.5.A05.1.454.CMB.1.raw
  modified_base (178)..(180): a, c, t, g, unknown or other
  misc_feature (178)..(180): n is a, c, g, or t

SEQ ID NO: 258912 - DNA, 179 bp, Homo sapiens; identical to SEQ ID NO: 258888
  misc_feature: GYAE6OF01D0F6R.52.5.A05.1.454.CMB.1.raw
  modified_base (178)..(179): a, c, t, g, unknown or other
  misc_feature (178)..(179): n is a, c, g, or t

SEQ ID NO: 258913 - DNA, 188 bp, Homo sapiens
  misc_feature: GYAE6OF01CCJJN.52.5.A05.1.454.CMB.1.raw
  modified_base (179)..(188): a, c, t, g, unknown or other
  misc_feature (179)..(188): n is a, c, g, or t
tcagcgcagtacgacacgaccggtgctcgatttagatagatagacagggcgaccaagggcccatcggtcttcccctggcaccctcctccaagagcacctctggggcacagcggccctgggctgcctggtcaaggactacttcctcgtagcactctgagcgggctggcaaggcgcatagnnnnnnnnnn

SEQ ID NO: 258914 - DNA, 179 bp, Homo sapiens; identical to SEQ ID NO: 258888
  misc_feature: GYAE6OF01AZV9D.52.5.A05.1.454.CMB.1.raw
  modified_base (178)..(179): a, c, t, g, unknown or other
  misc_feature (178)..(179): n is a, c, g, or t

SEQ ID NO: 258915 - DNA, 178 bp, Homo sapiens
  misc_feature: GYAE6OF01B08TG.52.5.A05.1.454.CMB.1.raw
  modified_base (175)..(178): a, c, t, g, unknown or other
  misc_feature (175)..(178): n is a, c, g, or t
tcagcgcagtacgacacgaccggtgctcgatttagatagatagacaggcaccaaggcccatcggtcttcccctggcaccctcctccaagagcacctctggggcacagcggcctgggctgcctggtcaaggactacttcctatacgatcgctgagcgggctggcaaggcgcatagnnnn

SEQ ID NO: 258916 - DNA, 181 bp, Homo sapiens
  misc_feature: GYAE6OF01CEN06.52.5.A05.1.454.CMB.1.raw
  modified_base (178)..(181): a, c, t, g, unknown or other
  misc_feature (178)..(181): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctcgtagcactctgagcgggctggcaaggcgcatagnnnn

SEQ ID NO: 258917 - DNA, 177 bp, Homo sapiens
  misc_feature: GYAE6OF01ET8DM.52.5.A05.1.454.CMB.1.raw
  modified_base (175)..(177): a, c, t, g, unknown or other
  misc_feature (175)..(177): n is a, c, g, or t
tcagcgcagtacgacacgaccggtgctcgatttagatagatagacagggcaccaaggcccatcggtcttcccctggcaccctcctccaagagcacctctgggcacagcggcctgggctgcctggtcaaggactacttcctatacgatcgctgagcgggctggcaaggcgcatagnnn

SEQ ID NO: 258918 - DNA, 181 bp, Homo sapiens; identical to SEQ ID NO: 258884
  misc_feature: GYAE6OF01BSNPZ.52.5.A05.1.454.CMB.1.raw
  modified_base (178)..(181): a, c, t, g, unknown or other
  misc_feature (178)..(181): n is a, c, g, or t

SEQ ID NO: 258919 - DNA, 179 bp, Homo sapiens
  misc_feature: GYAE6OF01BON6R.52.5.A05.1.454.CMB.1.raw
  modified_base (178)..(179): a, c, t, g, unknown or other
  misc_feature (178)..(179): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggttaaggactacttcctatacgatcgctgagcgggctggcaaggcgcatagnn

SEQ ID NO: 258920 - DNA, 194 bp, Homo sapiens
  misc_feature: GYAE6OF01D91S5.52.5.A05.1.454.CMB.1.raw
  modified_base (179)..(194): a, c, t, g, unknown or other
  misc_feature (179)..(194): n is a, c, g, or t
tcagcgcagtacgacacgaccggtgctcgatttagatagatagacagggcaccgaagggcccatcggtcttcccctggcaccctcctccaagagcacctctggggcacagcggccctgggctgcctggtcaaggactacttcctatacgatcgctgagcgggctggcaaggcgcatagnnnnnnnnnnnnnnnn

SEQ ID NO: 258921 - DNA, 245 bp, Homo sapiens
  misc_feature: GYAE6OF01BO6JU.52.5.A05.1.454.CMB.1.raw
  modified_base (181)..(183): a, c, t, g, unknown or other
  misc_feature (181)..(183): n is a, c, g, or t
  modified_base (185)..(187): a, c, t, g, unknown or other
  misc_feature (185)..(187): n is a, c, g, or t
  modified_base (189)..(191): a, c, t, g, unknown or other
  misc_feature (189)..(191): n is a, c, g, or t
  modified_base (193)..(245): a, c, t, g, unknown or other
  misc_feature (193)..(245): n is a, c, g, or t
tcagcgcagtacgacacgaccggtgctcgatttagatagatagacagggcaccaaggggcccatcggtcttccccctggcaccctcctccaagagcacctcctggggcacagcggccctgggctgcctggtcaaggactacttcctcgtactgcgctgagcgggctggcaaggcgcatagnnntnnngnnncnnnnnnnnnnnnnnnnnnnnnnnnnnnnnnnnnnnnnnnnnnnnnnnnnnnnn

SEQ ID NO: 258922 - DNA, 178 bp, Homo sapiens; identical to SEQ ID NO: 258897
  misc_feature: GYAE6OF01BLXJ2.52.5.A05.1.454.CMB.1.raw
  modified_base (178)..(178): a, c, t, g, unknown or other
  misc_feature (178)..(178): n is a, c, g, or t

SEQ ID NO: 258923 - DNA, 178 bp, Homo sapiens; identical to SEQ ID NO: 258897
  misc_feature: GYAE6OF01D2LF4.52.5.A05.1.454.CMB.1.raw
  modified_base (178)..(178): a, c, t, g, unknown or other
  misc_feature (178)..(178): n is a, c, g, or t

SEQ ID NO: 258924 - DNA, 180 bp, Homo sapiens; identical to SEQ ID NO: 258883
  misc_feature: GYAE6OF01ASBC2.52.5.A05.1.454.CMB.1.raw
  modified_base (178)..(180): a, c, t, g, unknown or other
  misc_feature (178)..(180): n is a, c, g, or t

SEQ ID NO: 258925 - DNA, 178 bp, Homo sapiens; identical to SEQ ID NO: 258897
  misc_feature: GYAE6OF01EZB4M.52.5.A05.1.454.CMB.1.raw
  modified_base (178)..(178): a, c, t, g, unknown or other
  misc_feature (178)..(178): n is a, c, g, or t

SEQ ID NO: 258926 - DNA, 194 bp, Homo sapiens
  misc_feature: GYAE6OF01AMTUK.52.5.A05.1.454.CMB.1.raw
  modified_base (177)..(194): a, c, t, g, unknown or other
  misc_feature (177)..(194): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctatacgatcgctgagcggctggcaaggcgcatagnnnnnnnnnnnnnnnnnn

SEQ ID NO: 258927 - DNA, 178 bp, Homo sapiens
  misc_feature: GYAE6OF01CZR9E.52.5.A05.1.454.CMB.1.raw
  modified_base (177)..(178): a, c, t, g, unknown or other
  misc_feature (177)..(178): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctatacatcgctgagcgggctggcaaggcgcatagnn

SEQ ID NO: 258928 - DNA, 195 bp, Homo sapiens
  misc_feature: GYAE6OF01DNFWH.52.5.A05.1.454.CMB.1.raw
  modified_base (179)..(195): a, c, t, g, unknown or other
  misc_feature (179)..(195): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctcgtagcactctgagcgggctggcaaggcgcaatagnnnnnnnnnnnnnnnnn

SEQ ID NO: 258929 - DNA, 178 bp, Homo sapiens; identical to SEQ ID NO: 258897
  misc_feature: GYAE6OF01BTPRD.52.5.A05.1.454.CMB.1.raw
  modified_base (178)..(178): a, c, t, g, unknown or other
  misc_feature (178)..(178): n is a, c, g, or t

SEQ ID NO: 258930 - DNA, 201 bp, Homo sapiens
  misc_feature: GYAE6OF01B9DEU.52.5.A05.1.454.CMB.1.raw
  modified_base (199)..(201): a, c, t, g, unknown or other
  misc_feature (199)..(201): n is a, c, g, or t
tcagcgcagtacgacacgaccggtgctcgatttagatagatagacagggcaccaagggcccatcggtcttccccctcggcgaccctccctccaacgaagcacctcctggggcggaccagcgggcccgtcgggcgtgcctcggtcgaaggaacgtaccttcctactacgatcgctgagcgggcgtggcaaggcgcatagnnn

SEQ ID NO: 258931 - DNA, 182 bp, Homo sapiens
  misc_feature: GYAE6OF01CAPZM.52.5.A05.1.454.CMB.1.raw
  modified_base (178)..(182): a, c, t, g, unknown or other
  misc_feature (178)..(182): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctcgtactgcgctgagcgggctggcaaggcgcatagnnnnn

SEQ ID NO: 258932 - DNA, 179 bp, Homo sapiens; identical to SEQ ID NO: 258888
  misc_feature: GYAE6OF01E5JFA.52.5.A05.1.454.CMB.1.raw
  modified_base (178)..(179): a, c, t, g, unknown or other
  misc_feature (178)..(179): n is a, c, g, or t

SEQ ID NO: 258933 - DNA, 179 bp, Homo sapiens; identical to SEQ ID NO: 258888
  misc_feature: GYAE6OF01DXNXK.52.5.A05.1.454.CMB.1.raw
  modified_base (178)..(179): a, c, t, g, unknown or other
  misc_feature (178)..(179): n is a, c, g, or t

SEQ ID NO: 258934 - DNA, 178 bp, Homo sapiens
  misc_feature: GYAE6OF01DQ0GJ.52.5.A05.1.454.CMB.1.raw
  modified_base (178)..(178): a, c, t, g, unknown or other
  misc_feature (178)..(178): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctcgtactgcgctgagcgggctggcaaggcgcatagn

SEQ ID NO: 258935 - DNA, 189 bp, Homo sapiens
  misc_feature: GYAE6OF01ECSAN.52.5.A05.1.454.CMB.1.raw
  modified_base (178)..(189): a, c, t, g, unknown or other
  misc_feature (178)..(189): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctatacgatcgctgagcgggctggcaaggcgcatagnnnnnnnnnnnn

SEQ ID NO: 258936 - DNA, 180 bp, Homo sapiens; identical to SEQ ID NO: 258883
  misc_feature: GYAE6OF01A7ZN2.52.5.A05.1.454.CMB.1.raw
  modified_base (178)..(180): a, c, t, g, unknown or other
  misc_feature (178)..(180): n is a, c, g, or t

SEQ ID NO: 258937 - DNA, 177 bp, Homo sapiens
  misc_feature: GYAE6OF01EHV43.52.5.A05.1.454.CMB.1.raw
  modified_base (177)..(177): a, c, t, g, unknown or other
  misc_feature (177)..(177): n is a, c, g, or t
tcagcgcagtacgacacgaccggtgctcgatttagatagatagacagggcaccaagggcccatcggtcttcccctggcaccctcctccaagagcacctctgggcacagcggccctgggctgcctggtcaaggactacttcctatacgatcgctgagcgggctggcaaggcgcatagn

SEQ ID NO: 258938 - DNA, 178 bp, Homo sapiens; identical to SEQ ID NO: 258897
  misc_feature: GYAE6OF01A6P1U.52.5.A05.1.454.CMB.1.raw
  modified_base (178)..(178): a, c, t, g, unknown or other
  misc_feature (178)..(178): n is a, c, g, or t

SEQ ID NO: 258939 - DNA, 180 bp, Homo sapiens; identical to SEQ ID NO: 258894
  misc_feature: GYAE6OF01CI4S5.52.5.A05.1.454.CMB.1.raw
  modified_base (178)..(180): a, c, t, g, unknown or other
  misc_feature (178)..(180): n is a, c, g, or t

SEQ ID NO: 258940 - DNA, 179 bp, Homo sapiens; identical to SEQ ID NO: 258888
  misc_feature: GYAE6OF01EROOS.52.5.A05.1.454.CMB.1.raw
  modified_base (178)..(179): a, c, t, g, unknown or other
  misc_feature (178)..(179): n is a, c, g, or t

SEQ ID NO: 258941 - DNA, 193 bp, Homo sapiens
  misc_feature: GYAE6OF01BDIN1.52.5.A05.1.454.CMB.1.raw
  modified_base (180)..(193): a, c, t, g, unknown or other
  misc_feature (180)..(193): n is a, c, g, or t
tcagcgcagtacgacacgaccggtgctcgatttagatagatagacagggcgaccaagggcccatcggtcttcccctggcaccctcctccaagagccacctctggggcacagcggccctgggctgcctggtcaaggactacttcctatacgatcgctgagcgggctggcaaggcgcatagnnnnnnnnnnnnnn

SEQ ID NO: 258942 - DNA, 197 bp, Homo sapiens
  misc_feature: GYAE6OF01CX7FN.52.5.A05.1.454.CMB.1.raw
  modified_base (128)..(128): a, c, t, g, unknown or other
  misc_feature (128)..(128): n is a, c, g, or t
  modified_base (180)..(197): a, c, t, g, unknown or other
  misc_feature (180)..(197): n is a, c, g, or t
tcagcgcagtacgacacgaccggtgctcgatttagatagatagacagggtcgaaccaagggcccatcggtcttccccgtggcaccctcctccaagagcacctctggggcacagcggcctggctcgccnggtcaaggctactccatacgatcggctgagcgggctgggcaaggcgcatagnnnnnnnnnnnnnnnnnn

SEQ ID NO: 258943 - DNA, 178 bp, Homo sapiens; identical to SEQ ID NO: 258897
  misc_feature: GYAE6OF01C9YYI.52.5.A05.1.454.CMB.1.raw
  modified_base (178)..(178): a, c, t, g, unknown or other
  misc_feature (178)..(178): n is a, c, g, or t

SEQ ID NO: 258944 - DNA, 178 bp, Homo sapiens; identical to SEQ ID NO: 258897
  misc_feature: GYAE6OF01CBJY0.52.5.A05.1.454.CMB.1.raw
  modified_base (178)..(178): a, c, t, g, unknown or other
  misc_feature (178)..(178): n is a, c, g, or t

SEQ ID NO: 258945 - DNA, 181 bp, Homo sapiens; identical to SEQ ID NO: 258884
  misc_feature: GYAE6OF01CHW3X.52.5.A05.1.454.CMB.1.raw
  modified_base (178)..(181): a, c, t, g, unknown or other
  misc_feature (178)..(181): n is a, c, g, or t

SEQ ID NO: 258946 - DNA, 179 bp, Homo sapiens; identical to SEQ ID NO: 258888
  misc_feature: GYAE6OF01CRDL1.52.5.A05.1.454.CMB.1.raw
  modified_base (178)..(179): a, c, t, g, unknown or other
  misc_feature (178)..(179): n is a, c, g, or t

SEQ ID NO: 258947 - DNA, 179 bp, Homo sapiens
  misc_feature: GYAE6OF01AZ9KS.52.5.A05.1.454.CMB.1.raw
  modified_base (178)..(179): a, c, t, g, unknown or other
  misc_feature (178)..(179): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctcgtactgcgctgagcgggctggcaaggcgcatagnn

SEQ ID NO: 258948 - DNA, 178 bp, Homo sapiens; identical to SEQ ID NO: 258897
  misc_feature: GYAE6OF01BMGSS.52.5.A05.1.454.CMB.1.raw
  modified_base (178)..(178): a, c, t, g, unknown or other
  misc_feature (178)..(178): n is a, c, g, or t

SEQ ID NO: 258949 - DNA, 179 bp, Homo sapiens; identical to SEQ ID NO: 258888
  misc_feature: GYAE6OF01A305Z.52.5.A05.1.454.CMB.1.raw
  modified_base (178)..(179): a, c, t, g, unknown or other
  misc_feature (178)..(179): n is a, c, g, or t

SEQ ID NO: 258950 - DNA, 183 bp, Homo sapiens
  misc_feature: GYAE6OF01CNWQP.52.5.A05.1.454.CMB.1.raw
  modified_base (177)..(183): a, c, t, g, unknown or other
  misc_feature (177)..(183): n is a, c, g, or t
tcagcgcagtacgacacgaccggtgctcgatttagatagatagacagggcaccaagggcccatcggtcttcccctggcaccctcctccaagagcacctctggggcacagcggcctgggctgcctggtcaaggactacttcctatacgatcgctgagcgggctggcaaggcgcatagnnnnnnn

SEQ ID NO: 258951 - DNA, 198 bp, Homo sapiens
  misc_feature: GYAE6OF01ESXCX.52.5.A05.1.454.CMB.1.raw
  modified_base (180)..(198): a, c, t, g, unknown or other
  misc_feature (180)..(198): n is a, c, g, or t
tcagcgcagtacgacacgaccggtgctcgatttagatagatagacagggcaccaagggccatccggtcttcccctggcaccctcctccaagagcacctctggggcacagcggccctgggctgcctggtcaaggactacttcctatacgatcgcttgagcgggctggtcaaggcgcatagnnnnnnnnnnnnnnnnnnn

SEQ ID NO: 258952 - DNA, 201 bp, Homo sapiens
  misc_feature: GYAE6OF01B79G8.52.5.A05.1.454.CMB.1.raw
  modified_base (181)..(201): a, c, t, g, unknown or other
  misc_feature (181)..(201): n is a, c, g, or t
tcagcgcagtacgacacgaccggtgctcgatttagatagatagacagggcaccaagggcccatcggtcttcccctggcaccctcctccaagagtcacctcgtggggcacagcggccctgggctgcctggtcaaggactacttcctatacgatcgctgagtcgggctggcaaggcgcatagnnnnnnnnnnnnnnnnnnnnn

SEQ ID NO: 258953 - DNA, 180 bp, Homo sapiens; identical to SEQ ID NO: 258883
  misc_feature: GYAE6OF01CTKXB.52.5.A05.1.454.CMB.1.raw
  modified_base (178)..(180): a, c, t, g, unknown or other
  misc_feature (178)..(180): n is a, c, g, or t

SEQ ID NO: 258954 - DNA, 181 bp, Homo sapiens; identical to SEQ ID NO: 258884
  misc_feature: GYAE6OF01D5IYD.52.5.A05.1.454.CMB.1.raw
  modified_base (178)..(181): a, c, t, g, unknown or other
  misc_feature (178)..(181): n is a, c, g, or t

SEQ ID NO: 258955 - DNA, 190 bp, Homo sapiens
  misc_feature: GYAE6OF01B5OXU.52.5.A05.1.454.CMB.1.raw
  modified_base (179)..(190): a, c, t, g, unknown or other
  misc_feature (179)..(190): n is a, c, g, or t
tcagcgcagtacgacacgaccggtgctcgatttagatagatagacagggcgaccaagggcccatcggtcttcccctggcaccctcctccaagagcacctctggggcacagcggccctgggctgcctggtcaaggactacttcctatacgatcgctgagcgggctggcaaggcgcatagnnnnnnnnnnnn

SEQ ID NO: 258956 - DNA, 179 bp, Homo sapiens
  misc_feature: GYAE6OF01CHNTG.52.5.A05.1.454.CMB.1.raw
  modified_base (178)..(179): a, c, t, g, unknown or other
  misc_feature (178)..(179): n is a, c, g, or t
tcagcgcagtacgacacgaccggtgctcgatttagatagatagacagggcaccaggggcccatcggtcttcccctggcaccctcctccaagagcacctctggggcacagcggccctgggctgcctggtcaaggactacttcctatacgatcgctgagcgggctggcaaggcgcatagnn

SEQ ID NO: 258957 - DNA, 179 bp, Homo sapiens; identical to SEQ ID NO: 258888
  misc_feature: GYAE6OF01C985L.52.5.A05.1.454.CMB.1.raw
  modified_base (178)..(179): a, c, t, g, unknown or other
  misc_feature (178)..(179): n is a, c, g, or t

SEQ ID NO: 258958 - DNA, 185 bp, Homo sapiens
  misc_feature: GYAE6OF01CJRZD.52.5.A05.1.454.CMB.1.raw
  modified_base (177)..(185): a, c, t, g, unknown or other
  misc_feature (177)..(185): n is a, c, g, or t
tcagcgcagtacgacacgaccggtgctcgatttagatagatagacagggcaccaagggccatcggtcttcccctggcaccctcctccaagagcacctctggggcacagcggccctgggctgcctggtcaaggactacttcctatacgatcgctgagcgggctggcaaggcgcatagnnnnnnnnn

SEQ ID NO: 258959 - DNA, 180 bp, Homo sapiens; identical to SEQ ID NO: 258883
  misc_feature: GYAE6OF01EPX7N.52.5.A05.1.454.CMB.1.raw
  modified_base (178)..(180): a, c, t, g, unknown or other
  misc_feature (178)..(180): n is a, c, g, or t

SEQ ID NO: 258960 - DNA, 177 bp, Homo sapiens
  misc_feature: GYAE6OF01DGUNV.52.5.A05.1.454.CMB.1.raw
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctatacgatcgctgagcgggctggcaaggcgcatag

SEQ ID NO: 258961 - DNA, 179 bp, Homo sapiens; identical to SEQ ID NO: 258888
  misc_feature: GYAE6OF01A718V.52.5.A05.1.454.CMB.1.raw
  modified_base (178)..(179): a, c, t, g, unknown or other
  misc_feature (178)..(179): n is a, c, g, or t

SEQ ID NO: 258962 - DNA, 180 bp, Homo sapiens; identical to SEQ ID NO: 258883
  misc_feature: GYAE6OF01CRUL9.52.5.A05.1.454.CMB.1.raw
  modified_base (178)..(180): a, c, t, g, unknown or other
  misc_feature (178)..(180): n is a, c, g, or t

SEQ ID NO: 258963 - DNA, 183 bp, Homo sapiens
  misc_feature: GYAE6OF01CGF23.52.5.A05.1.454.CMB.1.raw
  modified_base (178)..(183): a, c, t, g, unknown or other
  misc_feature (178)..(183): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctatacgatcgctgagcgggctggcaaggcgcatagnnnnnn

SEQ ID NO: 258964 - DNA, 180 bp, Homo sapiens; identical to SEQ ID NO: 258883
  misc_feature: GYAE6OF01ERBJU.52.5.A05.1.454.CMB.1.raw
  modified_base (178)..(180): a, c, t, g, unknown or other
  misc_feature (178)..(180): n is a, c, g, or t

SEQ ID NO: 258965 - DNA, 180 bp, Homo sapiens; identical to SEQ ID NO: 258883
  misc_feature: GYAE6OF01ECX27.52.5.A05.1.454.CMB.1.raw
  modified_base (178)..(180): a, c, t, g, unknown or other
  misc_feature (178)..(180): n is a, c, g, or t

SEQ ID NO: 258966 - DNA, 180 bp, Homo sapiens; identical to SEQ ID NO: 258883
  misc_feature: GYAE6OF01EUBRY.52.5.A05.1.454.CMB.1.raw
  modified_base (178)..(180): a, c, t, g, unknown or other
  misc_feature (178)..(180): n is a, c, g, or t

SEQ ID NO: 258967 - DNA, 188 bp, Homo sapiens
  misc_feature: GYAE6OF01AUWU7.52.5.A05.1.454.CMB.1.raw
  modified_base (178)..(188): a, c, t, g, unknown or other
  misc_feature (178)..(188): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctatacgatcgctgagcgggctggcaaggcgcatagnnnnnnnnnnn

SEQ ID NO: 258968 - DNA, 189 bp, Homo sapiens
  misc_feature: GYAE6OF01DBPYL.52.5.A05.1.454.CMB.1.raw
  modified_base (178)..(189): a, c, t, g, unknown or other
  misc_feature (178)..(189): n is a, c, g, or t
tcagcgcagtacgacacgaccggtgctcgatttagatagatagacagggcaccaagggcccatcggtcttcccctggcaccctcctccaagagcacctctggggcacagcggcctgggctgcctggtcaaggactacttcctatacgattcgctgagcgggctggcaaggcgcatagnnnnnnnnnnnn

SEQ ID NO: 258969 - DNA, 180 bp, Homo sapiens; identical to SEQ ID NO: 258894
  misc_feature: GYAE6OF01A16DY.52.5.A05.1.454.CMB.1.raw
  modified_base (178)..(180): a, c, t, g, unknown or other
  misc_feature (178)..(180): n is a, c, g, or t

SEQ ID NO: 258970 - DNA, 178 bp, Homo sapiens
  misc_feature: GYAE6OF01AJKTQ.52.5.A05.1.454.CMB.1.raw
  modified_base (177)..(178): a, c, t, g, unknown or other
  misc_feature (177)..(178): n is a, c, g, or t
tcagcgcagtacgacacgaccggtgctcgatttagatagatagacagggcaccaagggcccatcggtcttcccctggcaccctcctccaagagcacctctggggcacagcggcctgggctgcctggtcaaggactacttcctatacgatcgctgagcgggctggcaaggcgcatagnn

SEQ ID NO: 258971 - DNA, 181 bp, Homo sapiens; identical to SEQ ID NO: 258884
  misc_feature: GYAE6OF01CO26U.52.5.A05.1.454.CMB.1.raw
  modified_base (178)..(181): a, c, t, g, unknown or other
  misc_feature (178)..(181): n is a, c, g, or t

SEQ ID NO: 258972 - DNA, 180 bp, Homo sapiens; identical to SEQ ID NO: 258883
  misc_feature: GYAE6OF01BF69Q.52.5.A05.1.454.CMB.1.raw
  modified_base (178)..(180): a, c, t, g, unknown or other
  misc_feature (178)..(180): n is a, c, g, or t

SEQ ID NO: 258973 - DNA, 179 bp, Homo sapiens; identical to SEQ ID NO: 258888
  misc_feature: GYAE6OF01BF5KK.52.5.A05.1.454.CMB.1.raw
  modified_base (178)..(179): a, c, t, g, unknown or other
  misc_feature (178)..(179): n is a, c, g, or t

SEQ ID NO: 258974 - DNA, 182 bp, Homo sapiens; identical to SEQ ID NO: 258931
  misc_feature: GYAE6OF01EYDAN.52.5.A05.1.454.CMB.1.raw
  modified_base (178)..(182): a, c, t, g, unknown or other
  misc_feature (178)..(182): n is a, c, g, or t

SEQ ID NO: 258975 - DNA, 180 bp, Homo sapiens; identical to SEQ ID NO: 258894
  misc_feature: GYAE6OF01E3RPX.52.5.A05.1.454.CMB.1.raw
  modified_base (178)..(180): a, c, t, g, unknown or other
  misc_feature (178)..(180): n is a, c, g, or t

SEQ ID NO: 258976 - DNA, 179 bp, Homo sapiens; identical to SEQ ID NO: 258888
  misc_feature: GYAE6OF01EVYXV.52.5.A05.1.454.CMB.1.raw
  modified_base (178)..(179): a, c, t, g, unknown or other
  misc_feature (178)..(179): n is a, c, g, or t

SEQ ID NO: 258977 - DNA, 180 bp, Homo sapiens; identical to SEQ ID NO: 258883
  misc_feature: GYAE6OF01E05YB.52.5.A05.1.454.CMB.1.raw
  modified_base (178)..(180): a, c, t, g, unknown or other
  misc_feature (178)..(180): n is a, c, g, or t

SEQ ID NO: 258978 - DNA, 180 bp, Homo sapiens; identical to SEQ ID NO: 258883
  misc_feature: GYAE6OF01ESSYQ.52.5.A05.1.454.CMB.1.raw
  modified_base (178)..(180): a, c, t, g, unknown or other
  misc_feature (178)..(180): n is a, c, g, or t

SEQ ID NO: 258979 - DNA, 178 bp, Homo sapiens; identical to SEQ ID NO: 258897
  misc_feature: GYAE6OF01B50UR.52.5.A05.1.454.CMB.1.raw
  modified_base (178)..(178): a, c, t, g, unknown or other
  misc_feature (178)..(178): n is a, c, g, or t

SEQ ID NO: 258980 - DNA, 181 bp, Homo sapiens; identical to SEQ ID NO: 258884
  misc_feature: GYAE6OF01C9BZI.52.5.A05.1.454.CMB.1.raw
  modified_base (178)..(181): a, c, t, g, unknown or other
  misc_feature (178)..(181): n is a, c, g, or t

SEQ ID NO: 258981 - DNA, 178 bp, Homo sapiens; identical to SEQ ID NO: 258881
  misc_feature: GYAE6OF01DN4J4.52.5.A05.1.454.CMB.1.raw
  modified_base (178)..(178): a, c, t, g, unknown or other
  misc_feature (178)..(178): n is a, c, g, or t

SEQ ID NO: 258982 - DNA, 175 bp, Homo sapiens
  misc_feature: GYAE6OF01C7TLJ.52.5.A05.1.454.CMB.1.raw
  modified_base (172)..(175): a, c, t, g, unknown or other
  misc_feature (172)..(175): n is a, c, g, or t
tcagcgcagtacgacacgaccggtgctcgatttagatagatagacaggcaccaaggccatcggtcttcccctggcaccctcctccaagagcacctctgggcacagcggcctggctgcctggtcaaggactacttcctatacgatcgctgagcgggctggcaaggcgcatagnnnn

SEQ ID NO: 258983 - DNA, 178 bp, Homo sapiens; identical to SEQ ID NO: 258897
  misc_feature: GYAE6OF01C5SE9.52.5.A05.1.454.CMB.1.raw
  modified_base (178)..(178): a, c, t, g, unknown or other
  misc_feature (178)..(178): n is a, c, g, or t

SEQ ID NO: 258984 - DNA, 179 bp, Homo sapiens; identical to SEQ ID NO: 258888
  misc_feature: GYAE6OF01B3ZN2.52.5.A05.1.454.CMB.1.raw
  modified_base (178)..(179): a, c, t, g, unknown or other
  misc_feature (178)..(179): n is a, c, g, or t

SEQ ID NO: 258985 - DNA, 175 bp, Homo sapiens
  misc_feature: GYAE6OF01DLUS5.52.5.A05.1.454.CMB.1.raw
  modified_base (174)..(175): a, c, t, g, unknown or other
  misc_feature (174)..(175): n is a, c, g, or t
tcagcgcagtacgacacgaccggtgctcgatttagatagatagacagggcaccaagggcccatcggtctcccctggcaccctcctccaagagcacctctggggcacagcggcctgggctgcctggtcaaggactacttcctatacgatcgctgagcggctgcaaggcgcatagnn

SEQ ID NO: 258986 - DNA, 188 bp, Homo sapiens
  misc_feature: GYAE6OF01BTVXP.52.5.A05.1.454.CMB.1.raw
  modified_base (174)..(188): a, c, t, g, unknown or other
  misc_feature (174)..(188): n is a, c, g, or t
tcagcgcagtacgacacgaccggtgctcgatttagatagatagacagggcaccaagggccatcggtcttcccctggcaccctcctccaagagcacctctggggcacagcggcctggctgcctggtcaaggactacttcctatacgatcgctgagcggctggcaaggcgcatagnnnnnnnnnnnnnnn

SEQ ID NO: 258987 - DNA, 211 bp, Homo sapiens
  misc_feature: GYAE6OF01CFF62.52.5.A05.1.454.CMB.1.raw
  modified_base (177)..(211): a, c, t, g, unknown or other
  misc_feature (177)..(211): n is a, c, g, or t
tcagcgcagtacgacacgaccggtgctcgatttagatagatagacagggcaccaaggggcccatcggtcttcccctggcaccctcctccaagagcacctctggggcacagcggcctggctgcctggtcaaggactacttcctatacgatcgctgagcgggctggcaaggcgcatagnnnnnnnnnnnnnnnnnnnnnnnnnnnnnnnnnnn

SEQ ID NO: 258988 - DNA, 499 bp, Homo sapiens
  misc_feature: GYAE6OF01EMFF9.52.5.A05.1.454.CMB.1.raw
tcagcgcagtacgacacgaccggtgctcgatttagatagatagacagggggcctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcggccctcagggatccctgacgcgattctctggctccaattctggaaatgcagccactctgaccatcagcgggacccagcctatggatgagctgactattactgtcaggcgtgggacaggttaggttgtgtcgtttcgggcggtagggaccgaaggctggaccgtcctacgtcacgcccaaggctcgcccccgtcgg

SEQ ID NO: 258989 - DNA, 183 bp, Homo sapiens; identical to SEQ ID NO: 258963
  misc_feature: GYAE6OF01BS24T.52.5.A05.1.454.CMB.1.raw
  modified_base (178)..(183): a, c, t, g, unknown or other
  misc_feature (178)..(183): n is a, c, g, or t

SEQ ID NO: 258990 - DNA, 179 bp, Homo sapiens; identical to SEQ ID NO: 258888
  misc_feature: GYAE6OF01A3PQV.52.5.A05.1.454.CMB.1.raw
  modified_base (178)..(179): a, c, t, g, unknown or other
  misc_feature (178)..(179): n is a, c, g, or t

SEQ ID NO: 258991 - DNA, 179 bp, Homo sapiens; identical to SEQ ID NO: 258888
  misc_feature: GYAE6OF01EJNYO.52.5.A05.1.454.CMB.1.raw
  modified_base (178)..(179): a, c, t, g, unknown or other
  misc_feature (178)..(179): n is a, c, g, or t

SEQ ID NO: 258992 - DNA, 178 bp, Homo sapiens; identical to SEQ ID NO: 258897
  misc_feature: GYAE6OF01BXSF5.52.5.A05.1.454.CMB.1.raw
  modified_base (178)..(178): a, c, t, g, unknown or other
  misc_feature (178)..(178): n is a, c, g, or t

SEQ ID NO: 258993 - DNA, 233 bp, Homo sapiens
  misc_feature: GYAE6OF01EBGWY.52.5.A05.1.454.CMB.1.raw
  modified_base (186)..(233): a, c, t, g, unknown or other
  misc_feature (186)..(233): n is a, c, g, or t
tcagcgcagtacgacacgaccggtgctcgatttagatagatagacgagggcgaccaagggcccatcggtccttcccctggcaccctcctccaagagcacctctgggggccacagcggccctgggcgtgcctggtcaaggctacttcctataccgattcgctgagcgggctggcaaggcgcatagcnnnnnnnnnnnnnnnnnnnnnnnnnnnnnnnnnnnnnnnnnnnnnnnn

SEQ ID NO: 258994 - DNA, 178 bp, Homo sapiens; identical to SEQ ID NO: 258897
  misc_feature: GYAE6OF01E48AO.52.5.A05.1.454.CMB.1.raw
  modified_base (178)..(178): a, c, t, g, unknown or other
  misc_feature (178)..(178): n is a, c, g, or t

SEQ ID NO: 258995 - DNA, 179 bp, Homo sapiens; identical to SEQ ID NO: 258888
  misc_feature: GYAE6OF01AZAKX.52.5.A05.1.454.CMB.1.raw
  modified_base (178)..(179): a, c, t, g, unknown or other
  misc_feature (178)..(179): n is a, c, g, or t

SEQ ID NO: 258996 - DNA, 180 bp, Homo sapiens; identical to SEQ ID NO: 258883
  misc_feature: GYAE6OF01EMS0D.52.5.A05.1.454.CMB.1.raw
  modified_base (178)..(180): a, c, t, g, unknown or other
  misc_feature (178)..(180): n is a, c, g, or t

SEQ ID NO: 258997 - DNA, 179 bp, Homo sapiens; identical to SEQ ID NO: 258888
  misc_feature: GYAE6OF01BQYCP.52.5.A05.1.454.CMB.1.raw
  modified_base (178)..(179): a, c, t, g, unknown or other
  misc_feature (178)..(179): n is a, c, g, or t

SEQ ID NO: 258998 - DNA, 180 bp, Homo sapiens; identical to SEQ ID NO: 258883
  misc_feature: GYAE6OF01CFLCL.52.5.A05.1.454.CMB.1.raw
  modified_base (178)..(180): a, c, t, g, unknown or other
  misc_feature (178)..(180): n is a, c, g, or t

SEQ ID NO: 258999 - DNA, 185 bp, Homo sapiens
  misc_feature: GYAE6OF01ARDHW.52.5.A05.1.454.CMB.1.raw
  modified_base (178)..(185): a, c, t, g, unknown or other
  misc_feature (178)..(185): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctatacgatcgctgagcgggctggcaaggcgcatagnnnnnnnn

SEQ ID NO: 259000 - DNA, 190 bp, Homo sapiens
  misc_feature: GYAE6OF01C3GRH.52.5.A05.1.454.CMB.1.raw
  modified_base (179)..(190): a, c, t, g, unknown or other
  misc_feature (179)..(190): n is a, c, g, or t
tcagcgcagtacgacacgaccggtgctcgatttagatagatagacagggcaccgaagggcccatcggtcttcccctggcaccctcctccaagagcacctctggggcacagcggccctgggctgcctggtcaaggactacttcctcgtactgcgctgagcgggctggcaaggcgcatagnnnnnnnnnnnn

SEQ ID NO: 259001 - DNA, 180 bp, Homo sapiens; identical to SEQ ID NO: 258883
  misc_feature: GYAE6OF01BG5HW.52.5.A05.1.454.CMB.1.raw
  modified_base (178)..(180): a, c, t, g, unknown or other
  misc_feature (178)..(180): n is a, c, g, or t

SEQ ID NO: 259002 - DNA, 567 bp, Homo sapiens
  misc_feature: GYAE6OF01AYAVV.52.5.A05.1.454.CMB.1.raw
  modified_base (210)..(210): a, c, t, g, unknown or other
  misc_feature (210)..(210): n is a, c, g, or t
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (217)..(217): a, c, t, g, unknown or other
  misc_feature (217)..(217): n is a, c, g, or t
  modified_base (220)..(220): a, c, t, g, unknown or other
  misc_feature (220)..(220): n is a, c, g, or t
  modified_base (224)..(225): a, c, t, g, unknown or other
  misc_feature (224)..(225): n is a, c, g, or t
  modified_base (227)..(227): a, c, t, g, unknown or other
  misc_feature (227)..(227): n is a, c, g, or t
  modified_base (230)..(230): a, c, t, g, unknown or other
  misc_feature (230)..(230): n is a, c, g, or t
  modified_base (232)..(232): a, c, t, g, unknown or other
  misc_feature (232)..(232): n is a, c, g, or t
  modified_base (235)..(235): a, c, t, g, unknown or other
  misc_feature (235)..(235): n is a, c, g, or t
  modified_base (237)..(237): a, c, t, g, unknown or other
  misc_feature (237)..(237): n is a, c, g, or t
  modified_base (241)..(241): a, c, t, g, unknown or other
  misc_feature (241)..(241): n is a, c, g, or t
  modified_base (264)..(264): a, c, t, g, unknown or other
  misc_feature (264)..(264): n is a, c, g, or t
  modified_base (273)..(273): a, c, t, g, unknown or other
  misc_feature (273)..(273): n is a, c, g, or t
  modified_base (280)..(280): a, c, t, g, unknown or other
  misc_feature (280)..(280): n is a, c, g, or t
  modified_base (284)..(284): a, c, t, g, unknown or other
  misc_feature (284)..(284): n is a, c, g, or t
  modified_base (293)..(293): a, c, t, g, unknown or other
  misc_feature (293)..(293): n is a, c, g, or t
  modified_base (295)..(295): a, c, t, g, unknown or other
  misc_feature (295)..(295): n is a, c, g, or t
  modified_base (297)..(297): a, c, t, g, unknown or other
  misc_feature (297)..(297): n is a, c, g, or t
  modified_base (300)..(300): a, c, t, g, unknown or other
  misc_feature (300)..(300): n is a, c, g, or t
  modified_base (305)..(305): a, c, t, g, unknown or other
  misc_feature (305)..(305): n is a, c, g, or t
  modified_base (307)..(307): a, c, t, g, unknown or other
  misc_feature (307)..(307): n is a, c, g, or t
  modified_base (338)..(338): a, c, t, g, unknown or other
  misc_feature (338)..(338): n is a, c, g, or t
  modified_base (343)..(343): a, c, t, g, unknown or other
  misc_feature (343)..(343): n is a, c, g, or t
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
  modified_base (357)..(357): a, c, t, g, unknown or other
  misc_feature (357)..(357): n is a, c, g, or t
  modified_base (359)..(359): a, c, t, g, unknown or other
  misc_feature (359)..(359): n is a, c, g, or t
  modified_base (361)..(361): a, c, t, g, unknown or other
  misc_feature (361)..(361): n is a, c, g, or t
  modified_base (406)..(406): a, c, t, g, unknown or other
  misc_feature (406)..(406): n is a, c, g, or t
tcagcgcagtacgacacgaccggtgctcgatttagatagatagactaggggtcgggaccaagggcccgagtcggtcttccccctggcacccgtcctccaacgacgcaccgtcctgggggcaccagccggcccttcgggcctcgccctggtcaacggacgtacttcctcggtacctggccgctgagccgggctggcaaggccgcactacgncngcncngcntcgnncntcncngcncngacncatgctgtctatatctgtctctnaccaacacncccgganaacncccaatcantntntgngtcgngngcgcgcgcgtcgtctctctctctctcgctcncgcgngcncgcgcgccncncncnctcgtcgcgcgcgcgcgcgacgacgcgtcgtgtacgtactcgtcncgtacgtactactactaactaactaactaactaacgtacgttacggtcggtacggtaccggtaccggtaccgtaaccgtaccgtaccgtaccgtaccgtaccgtaccgaccgaccgcccgtcccgtcccgtccgtcgtaccgtccgttcccgtcccgtccc

SEQ ID NO: 259003 - DNA, 513 bp, Homo sapiens
  misc_feature: GYAE6OF01BTW93.52.5.A05.1.454.CMB.1.raw
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagccggccctcagggactccctgagcgtattctctggctccaattctggaaatgacagccactctcgaccatcagccggacccagcctatggatgaggctgactattactgtcgaggtcgtgggacgtaggtaggtttgtgttcgtttcgggcgggagggtaccgagtcgtcggacccgtccgtacgtcgacgcccaaggcctcgccccgtccgg

SEQ ID NO: 259004 - DNA, 186 bp, Homo sapiens
  misc_feature: GYAE6OF01D5T2S.52.5.A05.1.454.CMB.1.raw
  modified_base (178)..(186): a, c, t, g, unknown or other
  misc_feature (178)..(186): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctatacgatcgctgagcgggctggcaaggcgcatagnnnnnnnnn

SEQ ID NO: 259005 - DNA, 210 bp, Homo sapiens
  misc_feature: GYAE6OF01C5F85.52.5.A05.1.454.CMB.1.raw
  modified_base (177)..(210): a, c, t, g, unknown or other
  misc_feature (177)..(210): n is a, c, g, or t
tcagcgcagtacgacacgaccggtgctcgatttagatagatagacgaggggcaccaagggcccatcggtcttcccctggcaccctcctccaagagcacctcgtggggcacagcggcctgggctgcctggtcaaggctattccatacgatcgctgagcgggctggcaaggcgcatagnnnnnnnnnnnnnnnnnnnnnnnnnnnnnnnnnn

SEQ ID NO: 259006 - DNA, 179 bp, Homo sapiens
  misc_feature: GYAE6OF01CHDX5.52.5.A05.1.454.CMB.1.raw
  modified_base (179)..(179): a, c, t, g, unknown or other
  misc_feature (179)..(179): n is a, c, g, or t
tcagcgcagtacgacacgaccggtgctcgatttagatagatagacagggcatcaagggcccatcggtcttcccctggcaccctcctccaagagcacctctgggggcacagcggccctgggctgcctggtcaaggactacttcctatacgatcgctgagcgggctggcaaggcgcatagn

SEQ ID NO: 259007 - DNA, 179 bp, Homo sapiens; identical to SEQ ID NO: 258888
  misc_feature: GYAE6OF01DFK5W.52.5.A05.1.454.CMB.1.raw
  modified_base (178)..(179): a, c, t, g, unknown or other
  misc_feature (178)..(179): n is a, c, g, or t

SEQ ID NO: 259008 - DNA, 178 bp, Homo sapiens; identical to SEQ ID NO: 258897
  misc_feature: GYAE6OF01EHJJI.52.5.A05.1.454.CMB.1.raw
  modified_base (178)..(178): a, c, t, g, unknown or other
  misc_feature (178)..(178): n is a, c, g, or t

SEQ ID NO: 259009 - DNA, 181 bp, Homo sapiens
  misc_feature: GYAE6OF01C4E02.52.5.A05.1.454.CMB.1.raw
  modified_base (179)..(181): a, c, t, g, unknown or other
  misc_feature (179)..(181): n is a, c, g, or t
tcagcgcagtacgacacgaccggtgctcgatttagatagatagacagggcaccaagggcccatcggtcttccccctggcaccctcctccaagagcacctctggggcacagcggccctgggctgcctggtcaaggactacttcctcgtagcactctgagcgggctggcaaggcgcatagnnn

SEQ ID NO: 259010 - DNA, 519 bp, Homo sapiens
  misc_feature: GYAE6OF01CIJ3A.52.5.A05.1.454.CMB.1.raw
  modified_base (293)..(293): a, c, t, g, unknown or other
  misc_feature (293)..(293): n is a, c, g, or t
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagntgtcaagcggccctcgagggatcccgtgagcgattctctggctccaattctaggaaatgacacgccactctcgaccatcacgcggacccagcctagtggatgagctgacttattactgtacaggcggtgggactaggttaggtttgtcgtcgtttcggcggtaggaccgaacggtctcggtcccgtaccgtacggtacgacgacccaggcctccgccccgttccgg

SEQ ID NO: 259011 - DNA, 181 bp, Homo sapiens; identical to SEQ ID NO: 258884
  misc_feature: GYAE6OF01BEHBT.52.5.A05.1.454.CMB.1.raw
  modified_base (178)..(181): a, c, t, g, unknown or other
  misc_feature (178)..(181): n is a, c, g, or t

SEQ ID NO: 259012 - DNA, 188 bp, Homo sapiens; identical to SEQ ID NO: 258967
  misc_feature: GYAE6OF01B96SN.52.5.A05.1.454.CMB.1.raw
  modified_base (178)..(188): a, c, t, g, unknown or other
  misc_feature (178)..(188): n is a, c, g, or t

SEQ ID NO: 259013 - DNA, 179 bp, Homo sapiens; identical to SEQ ID NO: 258888
  misc_feature: GYAE6OF01B33B6.52.5.A05.1.454.CMB.1.raw
  modified_base (178)..(179): a, c, t, g, unknown or other
  misc_feature (178)..(179): n is a, c, g, or t

SEQ ID NO: 259014 - DNA, 180 bp, Homo sapiens
  misc_feature: GYAE6OF01EA13E.52.5.A05.1.454.CMB.1.raw
  modified_base (179)..(180): a, c, t, g, unknown or other
  misc_feature (179)..(180): n is a, c, g, or t
tcagcgcagtacgacacgaccggtgctcgatttagatagatagacagggcaccaagggcccatcggtcttccccctggcaccctcctccaagagcacctctggggcacagcggccctgggctgcctggtcaaggactacttcctcgtactgcgctgagcgggctggcaaggcgcatagnn

SEQ ID NO: 259015 - DNA, 178 bp, Homo sapiens
  misc_feature: GYAE6OF01DGA57.52.5.A05.1.454.CMB.1.raw
  modified_base (174)..(178): a, c, t, g, unknown or other
  misc_feature (174)..(178): n is a, c, g, or t
tcagcgcagtacgacacgaccggtgctcgatttagatagatagacaggcaccaaggcccatcggtcttccctggcaccctcctccaagagcacctctgggcacagcggccctgggctgcctggtcaaggactacttcctatacgatcgctgagcgggctggcaaggcgcatagnnnnn

SEQ ID NO: 259016 - DNA, 551 bp, Homo sapiens
  misc_feature: GYAE6OF01DBYIQ.52.5.A05.1.454.CMB.1.raw
tcagcgcagtacgacacgaccggtgctcgatttagatagatagacagggggcctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattggggatatacatgttcctggtatcagcagaagccaggccagtctcctgttctctcatctataaagatgtacaagcggccctacgagggactcccgtgacgcgtattctcgtcggctcctaattctaggaaatgcagccactctgaccagtcagccggacccagacctagtggatggagctgacttacttacgtcgtacgaggtcggtaggacgtaggttaggtttgtcgttcgtttcgggacgggtacggaccgtaggcgttacggacccgttccgtaccgtaccgtaccgtacccgaacggtcccgtccgcccccgttacccgg

SEQ ID NO: 259017 - DNA, 200 bp, Homo sapiens
  misc_feature: GYAE6OF01BH97S.52.5.A05.1.454.CMB.1.raw
  modified_base (180)..(200): a, c, t, g, unknown or other
  misc_feature (180)..(200): n is a, c, g, or t
tcagcgcagtacgacacgaccggtgctcgatttagatagatagacagggcaccgaagggcccatcggtcttcccctggcaccctcctccaagagcacctcgtggggcacagcggccctgggctgcctggtcaaggactacttcctatacgatcgctgagcgggctggcaaggcgcatagnnnnnnnnnnnnnnnnnnnnn

SEQ ID NO: 259018 - DNA, 179 bp, Homo sapiens; identical to SEQ ID NO: 258888
  misc_feature: GYAE6OF01DIX5S.52.5.A05.1.454.CMB.1.raw
  modified_base (178)..(179): a, c, t, g, unknown or other
  misc_feature (178)..(179): n is a, c, g, or t

SEQ ID NO: 259019 - DNA, 181 bp, Homo sapiens
  misc_feature: GYAE6OF01DGHZY.52.5.A05.1.454.CMB.1.raw
  modified_base (177)..(181): a, c, t, g, unknown or other
  misc_feature (177)..(181): n is a, c, g, or t
tcagcgcagtacgacacgaccggtgctcgatttagatagatagacagggcaccaaggcccatcggtcttcccctggcaccctcctccaagagcacctctggggcacagcggccctgggctgcctggtcaaggactacttcctatacgatcgctgagcgggctggcaaggcgcatagnnnnn

SEQ ID NO: 259020 - DNA, 186 bp, Homo sapiens
  misc_feature: GYAE6OF01EWJKM.52.5.A05.1.454.CMB.1.raw
  modified_base (178)..(186): a, c, t, g, unknown or other
  misc_feature (178)..(186): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctcgtactgcgctgagcgggctggcaaggcgcatagnnnnnnnnn

SEQ ID NO: 259021 - DNA, 181 bp, Homo sapiens; identical to SEQ ID NO: 258884
  misc_feature: GYAE6OF01CCTQ6.52.5.A05.1.454.CMB.1.raw
  modified_base (178)..(181): a, c, t, g, unknown or other
  misc_feature (178)..(181): n is a, c, g, or t

SEQ ID NO: 259022 - DNA, 482 bp, Homo sapiens
  misc_feature: GYAE6OF01ESRB8.52.5.A05.1.454.CMB.1.raw
  modified_base (237)..(237): a, c, t, g, unknown or other
  misc_feature (237)..(237): n is a, c, g, or t
  modified_base (310)..(310): a, c, t, g, unknown or other
  misc_feature (310)..(310): n is a, c, g, or t
  modified_base (330)..(330): a, c, t, g, unknown or other
  misc_feature (330)..(330): n is a, c, g, or t
  modified_base (459)..(459): a, c, t, g, unknown or other
  misc_feature (459)..(459): n is a, c, g, or t
  modified_base (476)..(476): a, c, t, g, unknown or other
  misc_feature (476)..(476): n is a, c, g, or t
tcagcgcagtacgacacgaccggtgctcgatttagatagatagacagggggcctgggcctcaggaagcagcatcggaggtgcctcagccatggcatggatccctctcttcctcggcgtccttgcttactgcacaggttctgtggcctcctatgacttgacacagccaccctcggtgtcagtgtccccaggacagacggccaggatcacctgctctggagatgcattgccaaaaccgntatgcttattggtaccagcagaagccggccaggcccctgtgttggtgatgtataaagacactgagaggccctnagggatccctgagcgattcnctggctccaggtcagggacacggtcacattggccatcagtggagtccaggcaggaggacgagctgactattatgtacaatcaacagacaccattgtacttatgtctcggactgcgacgaggtcacgtcnggcacgccagccacccntgtacc

SEQ ID NO: 259023 - DNA, 339 bp, Homo sapiens
  misc_feature: GYAE6OF01B0E02.52.5.A05.1.454.CMB.1.raw
  modified_base (205)..(205): a, c, t, g, unknown or other
  misc_feature (205)..(205): n is a, c, g, or t
  modified_base (207)..(207): a, c, t, g, unknown or other
  misc_feature (207)..(207): n is a, c, g, or t
  modified_base (215)..(215): a, c, t, g, unknown or other
  misc_feature (215)..(215): n is a, c, g, or t
  modified_base (254)..(254): a, c, t, g, unknown or other
  misc_feature (254)..(254): n is a, c, g, or t
  modified_base (296)..(296): a, c, t, g, unknown or other
  misc_feature (296)..(296): n is a, c, g, or t
  modified_base (299)..(339): a, c, t, g, unknown or other
  misc_feature (299)..(339): n is a, c, g, or t
tcagcgcagtacgacacgaccggtgctcgatttagatagatagacgagggcacccgaagggcccatcggttcttccccctggcaccctccgtcccaagacgccacctcctggggcacagcgggcccctaggggccgtgccctgggtccaaaggacttacttcctcgtagcacgtctgagcgggctggcaaaggtcgcgattaggngngacagctncgctagcagccagctgcccctgcactctgttcccaaccnctcctctctctacgactcgagacgcggcgtcgacgagcgcanagnnnnnnnnnnnnnnnnnnnnnnnnnnnnnnnnnnnnnnnnn

SEQ ID NO: 259024 - DNA, 197 bp, Homo sapiens
  misc_feature: GYAE6OF01DPP2W.52.5.A05.1.454.CMB.1.raw
  modified_base (178)..(197): a, c, t, g, unknown or other
  misc_feature (178)..(197): n is a, c, g, or t
tcagcgcagtacgacacgaccggtgctcgatttagatagatagacagggcaccaagggcccatcggtcttcccctggcaccctcctaccaagagcacctctggggcacagcggccctgggctgcctggtcaaggctacttcctatacgatcgctgagcgggctggcaaggcgcatagnnnnnnnnnnnnnnnnnnnn

SEQ ID NO: 259025 - DNA, 179 bp, Homo sapiens; identical to SEQ ID NO: 258888
  misc_feature: GYAE6OF01C3NY6.52.5.A05.1.454.CMB.1.raw
  modified_base (178)..(179): a, c, t, g, unknown or other
  misc_feature (178)..(179): n is a, c, g, or t

SEQ ID NO: 259026 - DNA, 802 bp, Homo sapiens
  misc_feature: GYAE6OF01EWHLG.52.5.A05.1.454.CMB.1.raw
  modified_base (293)..(293): a, c, t, g, unknown or other
  misc_feature (293)..(293): n is a, c, g, or t
tcagcgcagtacgacacgaccggtgctcgatttagatagatagacagggggcctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattggggatatacattgttcctggtatcagcagaagccaggccagtctcctgttctcctcatctataagntgtcaagcgaccctcgagggtactccgtagacgtcgtattctcgtggtcctacctaatttacgtaggtaaacgttcggaccacgtacccgtacttaccgttacgaacccgtaagttacccgaacgggtacccgggtaacccgacggtaccccgttaaggttacgggtaacttacgggtacggtaccgttacggttaacctttaacgtttaaccggttacggttaaccggtaacggggttaccggggttaacggggttaacccggttaaggggtttttaacgggttttcgggttaccgggtttacccggggtttttaccggggggaacccgggggttaaacgggggttaaaccccggttaaacggggttaccccggttaaccgggttaacccccgggtttaacccccggtttaaacccgggttaaccccggtaaaccccgggtaacccccggtaaaacccggggttccccccggttccccggttacccccccccggtttaaccccggggg

SEQ ID NO: 259027 - DNA, 179 bp, Homo sapiens
  misc_feature: GYAE6OF01B57SB.52.5.A05.1.454.CMB.1.raw
  modified_base (177)..(179): a, c, t, g, unknown or other
  misc_feature (177)..(179): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttctcgtagcactctgagcgggctggcaaggcgcatagnnn

SEQ ID NO: 259028 - DNA, 534 bp, Homo sapiens
  misc_feature: GYAE6OF01BL66E.52.5.A05.1.454.CMB.1.raw
  modified_base (402)..(402): a, c, t, g, unknown or other
  misc_feature (402)..(402): n is a, c, g, or t
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgagttgggggatatacatgtttcctggtatcagcagagccagcagtctcctgttctcctcatctataaagatgtcaagccggccctcgagggactccctgagcgattctctggctccaattcgtagaaatgacagtccactctcgaccatcacggccgggacccagcctagtggatgacggntacgacttattacgtgtacgaggcggtgggtactaggttaggtttgtacggttcgtttacgggcgggagggtacccaggtctcggcccgtccgtacgtacacgacccgaaggcctcccggtccccgtaccgg

SEQ ID NO: 259029 - DNA, 531 bp, Homo sapiens
  misc_feature: GYAE6OF01BU80M.52.5.A05.1.454.CMB.1.raw
  modified_base (293)..(293): a, c, t, g, unknown or other
  misc_feature (293)..(293): n is a, c, g, or t
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagntgtcaagcggccctcagggctccctgagcgattctctggctccattctgaaatgcagccactctgaccatcacgccggacccagccctagtggatggacgctgacttagttactgtcagggtcgtagggtataggttaggtttgtgttcggtttcgggacggtacgggaccgacgtcgtacggtacccgtccgttacggtacgacgacccgaaggccctccggtcccccgttaccggg

SEQ ID NO: 259030 - DNA, 181 bp, Homo sapiens
  misc_feature: GYAE6OF01C1JTL.52.5.A05.1.454.CMB.1.raw
  modified_base (179)..(181): a, c, t, g, unknown or other
  misc_feature (179)..(181): n is a, c, g, or t
tcagcgcagtacgacacgaccggtgctcgatttagatagatagacagggcaccaagggcccatcggtcttccccctggcaccctcctccaagagcacctctggggcacagcggccctgggctgcctggtcaaggactacttcctatacgatcgctgagcgggctggcaaggcgcatagnnn

SEQ ID NO: 259031 - DNA, 194 bp, Homo sapiens
  misc_feature: GYAE6OF01EIBGH.52.5.A05.1.454.CMB.1.raw
  modified_base (179)..(194): a, c, t, g, unknown or other
  misc_feature (179)..(194): n is a, c, g, or t
tcagcgcagtacgacacgaccggtgctcgatttagatagatagacagggcaccaagggcccatcggtcttccccctggcaccctcctccaagagccacctctggggcacagcggccctgggctgcctggtcaaggactacttccatacgatcgctgagcgggctggcaaggcgcatagnnnnnnnnnnnnnnnn

SEQ ID NO: 259032 - DNA, 649 bp, Homo sapiens
  misc_feature: GYAE6OF01AMLLY.52.5.A05.1.454.CMB.1.raw
tcagcgcagtacgacacgaccggtgctcgatttagatagatagacagggggccgtgggccgtcaggaagcagcatcggaggtgcctcagccatggcatggatccctctcttcctcgcgtccttgcttactgcacaggttctgtggcctcctatgacttgactcagccaccctcagtgtccgtgtccccaggacagacagccaccatcacctgctctggacatcgattggggatatacattgtttcctggtatcagcagaagcctaggccaggtctcctgttctcctcatctataagtactgtcaagccgtccctcgacgggtactccccgtaggacgtacgtaactttccgtcgtcggtctaccctaaattccgtacggtaaatcgacctacggtccctacctcgtacgacctacgttcgacggtccgggacccacgtcctaacgtcggtagtacggacggtcttacggacttacgttacgttggtaccggtggtacggttacgggacggttaagttacgggtttagttacggttccgtttacgggtacgggtaacgggtacccgtaacggtcgttaccggtcccggttacccgttacggtaccgtaaccggtaccgtaacggcccgttcccggtcccccgttaccggg

SEQ ID NO: 259033 - DNA, 187 bp, Homo sapiens
  misc_feature: GYAE6OF01B47J2.52.5.A05.1.454.CMB.1.raw
  modified_base (180)..(187): a, c, t, g, unknown or other
  misc_feature (180)..(187): n is a, c, g, or t
tcagcgcagtacgacacgaccggtgctcgatttagatagatagacagggcgaccaagggcccatcggtcttcccctggcaccctcctccaagagcacctcgtggggcacagcggccctgggctgcctggtcaaggactacttcctatacgatcgctgagcgggctggcaaggcgcatagnnnnnnnn

SEQ ID NO: 259034 - DNA, 181 bp, Homo sapiens; identical to SEQ ID NO: 258884
  misc_feature: GYAE6OF01CL6P9.52.5.A05.1.454.CMB.1.raw
  modified_base (178)..(181): a, c, t, g, unknown or other
  misc_feature (178)..(181): n is a, c, g, or t

SEQ ID NO: 259035 - DNA, 178 bp, Homo sapiens; identical to SEQ ID NO: 258897
  misc_feature: GYAE6OF01AR5LR.52.5.A05.1.454.CMB.1.raw
  modified_base (178)..(178): a, c, t, g, unknown or other
  misc_feature (178)..(178): n is a, c, g, or t

SEQ ID NO: 259036 - DNA, 181 bp, Homo sapiens; identical to SEQ ID NO: 258916
  misc_feature: GYAE6OF01DK9K1.52.5.A05.1.454.CMB.1.raw
  modified_base (178)..(181): a, c, t, g, unknown or other
  misc_feature (178)..(181): n is a, c, g, or t

SEQ ID NO: 259037 - DNA, 207 bp, Homo sapiens
  misc_feature: GYAE6OF01AZU0T.52.5.A05.1.454.CMB.1.raw
  modified_base (183)..(207): a, c, t, g, unknown or other
  misc_feature (183)..(207): n is a, c, g, or t
tcagcgcagtacgacacgaccggtgctcgatttagatagatagacaggggtcgaccgaagggcccatcggtcttccccctggcaccctcctccaagagcacctcgtggggcacagcggccctggctgcctggtcaaggactacttcctatacgatcgctgagcgggctggcaaggcgcatagnnnnnnnnnnnnnnnnnnnnnnnnn

SEQ ID NO: 259038 - DNA, 182 bp, Homo sapiens
  misc_feature: GYAE6OF01B9XPI.52.5.A05.1.454.CMB.1.raw
  modified_base (178)..(182): a, c, t, g, unknown or other
  misc_feature (178)..(182): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctatacgatcgctgagcgggctggcaaggcgcatagnnnnn

SEQ ID NO: 259039 - DNA, 178 bp, Homo sapiens; identical to SEQ ID NO: 258897
  misc_feature: GYAE6OF01BCL81.52.5.A05.1.454.CMB.1.raw
  modified_base (178)..(178): a, c, t, g, unknown or other
  misc_feature (178)..(178): n is a, c, g, or t

SEQ ID NO: 259040 - DNA, 189 bp, Homo sapiens
  misc_feature: GYAE6OF01AJKS7.52.5.A05.1.454.CMB.1.raw
  modified_base (179)..(189): a, c, t, g, unknown or other
  misc_feature (179)..(189): n is a, c, g, or t
tcagcgcagtacgacacgaccggtgctcgatttagatagatagacagggcaccaagggcccatcggtcttccccctggcaccctcctccaagagcacctctggggcacagcggccctgggctgcctggtcaaggactacttcctatacgatcgctgagcgggctggcaaggcgcatagnnnnnnnnnnn

SEQ ID NO: 259041 - DNA, 206 bp, Homo sapiens
  misc_feature: GYAE6OF01C1YM7.52.5.A05.1.454.CMB.1.raw
  modified_base (148)..(148): a, c, t, g, unknown or other
  misc_feature (148)..(148): n is a, c, g, or t
  modified_base (151)..(151): a, c, t, g, unknown or other
  misc_feature (151)..(151): n is a, c, g, or t
  modified_base (168)..(168): a, c, t, g, unknown or other
  misc_feature (168)..(168): n is a, c, g, or t
  modified_base (174)..(206): a, c, t, g, unknown or other
  misc_feature (174)..(206): n is a, c, g, or t
tcagcgcagtacgacacgaccggtgctcgatttagatagatagacagggcaccaaggcccatcggtcttccccctggcaccctcctccaagagcacctctggggcacagcggcctgggctgcctggtcaagctacttctatcgatcgntgngcgggctggacaaggcncatagnnnnnnnnnnnnnnnnnnnnnnnnnnnnnnnnn

SEQ ID NO: 259042 - DNA, 182 bp, Homo sapiens
  misc_feature: GYAE6OF01DSJ0R.52.5.A05.1.454.CMB.1.raw
  modified_base (179)..(182): a, c, t, g, unknown or other
  misc_feature (179)..(182): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctatacgatcgctgagcgggctgggcaaggcgcatagnnnn

SEQ ID NO: 259043 - DNA, 180 bp, Homo sapiens
  misc_feature: GYAE6OF01BCQ07.52.5.A05.1.454.CMB.1.raw
  modified_base (178)..(180): a, c, t, g, unknown or other
  misc_feature (178)..(180): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctcgtagcactctgagcgggctggcaaggcgcatagnnn

SEQ ID NO: 259044 - DNA, 179 bp, Homo sapiens; identical to SEQ ID NO: 258888
  misc_feature: GYAE6OF01CBROV.52.5.A05.1.454.CMB.1.raw
  modified_base (178)..(179): a, c, t, g, unknown or other
  misc_feature (178)..(179): n is a, c, g, or t

SEQ ID NO: 259045 - DNA, 176 bp, Homo sapiens
  misc_feature: GYAE6OF01EGD19.52.5.A05.1.454.CMB.1.raw
  modified_base (176)..(176): a, c, t, g, unknown or other
  misc_feature (176)..(176): n is a, c, g, or t
tcagcgcagtacgacacgaccggtgctcgatttagatagatagacaggcaccaagggcccatcggtcttcccctggcaccctcctccaagagcacctctggggcacagcggccctgggctgcctggtcaggactacttcctatacgatcgctgagcgggctggcaaggcgcatagn

SEQ ID NO: 259046 - DNA, 518 bp, Homo sapiens
  misc_feature: GYAE6OF01AFL67.52.5.A05.1.454.CMB.1.raw
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgttttcccggatcagcagaagccaggccagtctcctgttctcctcatctataagatgtcaagcgccctgacgggactccctgacgcgtattctctcggctccaattcaggtaaatgcagcctactctgaccatcgacggccggacccacgacctagtggatggaggctagtacttattacgtgtcgagggtcggtgggtactaggtaggtttgtcgtcggtttcggcggtaggacaggtcgtgccgtcgacgtcacgtcccgagcctcgccccgtcggtcc

SEQ ID NO: 259047 - DNA, 180 bp, Homo sapiens; identical to SEQ ID NO: 258883
  misc_feature: GYAE6OF01DMCQ5.52.5.A05.1.454.CMB.1.raw
  modified_base (178)..(180): a, c, t, g, unknown or other
  misc_feature (178)..(180): n is a, c, g, or t

SEQ ID NO: 259048 - DNA, 181 bp, Homo sapiens; identical to SEQ ID NO: 258884
  misc_feature: GYAE6OF01CB9JP.52.5.A05.1.454.CMB.1.raw
  modified_base (178)..(181): a, c, t, g, unknown or other
  misc_feature (178)..(181): n is a, c, g, or t

SEQ ID NO: 259049 - DNA, 182 bp, Homo sapiens
  misc_feature: GYAE6OF01B8IWB.52.5.A05.1.454.CMB.1.raw
  modified_base (177)..(182): a, c, t, g, unknown or other
  misc_feature (177)..(182): n is a, c, g, or t
tcagcgcagtacgacacgaccggtgctcgatttagatagatagacagggcaccaagggcccatcggtcttcccctggcaccctcctccaagagcacctctggggcacagcggcctgggctgcctggtcaaggactacttcctatacgatcgctgagcgggctggcaaggcgcatagnnnnnn

SEQ ID NO: 259050 - DNA, 185 bp, Homo sapiens; identical to SEQ ID NO: 258999
  misc_feature: GYAE6OF01AM2LK.52.5.A05.1.454.CMB.1.raw
  modified_base (178)..(185): a, c, t, g, unknown or other
  misc_feature (178)..(185): n is a, c, g, or t

SEQ ID NO: 259051 - DNA, 181 bp, Homo sapiens; identical to SEQ ID NO: 258884
  misc_feature: GYAE6OF01CGSCL.52.5.A05.1.454.CMB.1.raw
  modified_base (178)..(181): a, c, t, g, unknown or other
  misc_feature (178)..(181): n is a, c, g, or t

SEQ ID NO: 259052 - DNA, 676 bp, Homo sapiens
  misc_feature: GYAE6OF01DO1WK.52.5.A05.1.454.CMB.1.raw
  modified_base (293)..(293): a, c, t, g, unknown or other
  misc_feature (293)..(293): n is a, c, g, or t
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtcccccaggacagacagccaccatcacctgctctggacatcgagttggggatatacattgtttcctggtatcagcagagccaggccagtctcctgttctcctcatctataagntgtacaacgcgccctcgacggactcccgtgacgcgtattcctcgtcggtcctacctaatttccgtaaggtaaacttgaccaaccgtcccgtaaccttccgtaacgtaccctaagttacccgacggacccgggacccctacggacccgttagtcgggtacgtaggacggtacgttacgtaaccttagtttaacgtcggttacggacgggtcgggttacgggtacgttaagggtttagggtttcggttcggttccggttttacggggaccggggtaacgggtaacccgtaacgggtacccgttacggtaccccggttcccgttaacccggtcccgtaaccggtaccccggaacgggtccccgtcccgtccccccggttacccggg

SEQ ID NO: 259053 - DNA, 181 bp, Homo sapiens
  misc_feature: GYAE6OF01EROBZ.52.5.A05.1.454.CMB.1.raw
  modified_base (177)..(181): a, c, t, g, unknown or other
  misc_feature (177)..(181): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggctacttcctatacgatcgctgagcgggctggcaaggcgcatagnnnnn

SEQ ID NO: 259054 - DNA, 200 bp, Homo sapiens
  misc_feature: GYAE6OF01DSD4R.52.5.A05.1.454.CMB.1.raw
  modified_base (196)..(200): a, c, t, g, unknown or other
  misc_feature (196)..(200): n is a, c, g, or t
tcagcgcagtacgacacgaccggtgctcgatttagatagatagacagggcaccaagggccatcggtcttcccctggcaccctcctccaagagcacctcgtggggcacagcggccctgggctgcctggtcaaggactacttcctggtcaaggactacttcctatacgatcgctgagcgggctggcaaggcgcatagnnnnn

SEQ ID NO: 259055 - DNA, 182 bp, Homo sapiens; identical to SEQ ID NO: 259038
  misc_feature: GYAE6OF01AS1OU.52.5.A05.1.454.CMB.1.raw
  modified_base (178)..(182): a, c, t, g, unknown or other
  misc_feature (178)..(182): n is a, c, g, or t

SEQ ID NO: 259056 - DNA, 631 bp, Homo sapiens
  misc_feature: GYAE6OF01DZUO7.52.5.A05.1.454.CMB.1.raw
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagcccaccctcagtgtccgtgtccccaggacagacagccaccatccacctcgctctggacatcgagttggggatatacattgtttcctaggtatcagacagagccgagccagtcctcctgttcctcctactatactataaagatacgtacaacgccgtacccgtagacggtactcccgtgacgtcgtacttccgtcgtcggtcctacctaattccgtagtaagtcgacacgcctactacgtacacctagtaccgacggacccggaacccacgtacccgtaggtacggtacgtacggtagtccgttacgtaacttagttacctgggtacgtacgggtccggtaggtacggttgggttagggtttcgtacggttccggtttacgggacggtacgggaaccgtacggtcggtaccggtacccggttccgtagtacccgtaccggacccgtagcccgttcccgcccccgttacgg

SEQ ID NO: 259057 - DNA, 594 bp, Homo sapiens
  misc_feature: GYAE6OF01EFD96.52.5.A05.1.454.CMB.1.raw
  modified_base (299)..(299): a, c, t, g, unknown or other
  misc_feature (299)..(299): n is a, c, g, or t
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtcgtccccaggacagacagccaccatcacctgctctggacatcgagttggggatatacattgtttcctggtatcagcagaagccaggccagtcctcctgtttcctcctctatctataaagntgtacgaagcgccctgacggactcccgtgacgtcgtattctcgtggtcctacctaattccgtaggtaaatcgacacgccctactctacgaccctataccgacggccggaacccacgtcctagtcggtatagggacgtcgtagtacttagttacgtcggtacgacgggtcgtaggggaacttagggttacgggtttgtcggttcggtttacgggcgggtaacggtacgacggtacgtcggtacccgttcctaccggtacgtaccggaccctaacggtccgtcccgccccggttccg

SEQ ID NO: 259058 - DNA, 181 bp, Homo sapiens; identical to SEQ ID NO: 258884
  misc_feature: GYAE6OF01B1ELT.52.5.A05.1.454.CMB.1.raw
  modified_base (178)..(181): a, c, t, g, unknown or other
  misc_feature (178)..(181): n is a, c, g, or t

SEQ ID NO: 259059 - DNA, 194 bp, Homo sapiens
  misc_feature: GYAE6OF01ESHEV.52.5.A05.1.454.CMB.1.raw
  modified_base (173)..(173): a, c, t, g, unknown or other
  misc_feature (173)..(173): n is a, c, g, or t
  modified_base (179)..(194): a, c, t, g, unknown or other
  misc_feature (179)..(194): n is a, c, g, or t
tcagcgcagtacgacacgaccggtgctcgatttagatagatagacagggcaccaagggcccatcggtcttcccctggcaccctcctccaagacgcacctctggggcacagcggccctgggctgcctggtcaaggactacttcctatacgatcgctgagcgggctggcaaggcncatagnnnnnnnnnnnnnnnn

SEQ ID NO: 259060 - DNA, 696 bp, Homo sapiens
  misc_feature: GYAE6OF01CIC3J.52.5.A05.1.454.CMB.1.raw
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagcccaccctcagtcgtccgtcgtcccgaggacagacagccaccatcacctgctcgtggacatcgtagtggggatatactattcgttcctggtatcagcagacgcgagccagtctcctcgttctcctcactactaataagtatacgtacgaacggccgtaccctacgacgggtactcccgtaggtaacgcgtaacttccgtcgtacggtaccttaccgtaacgtttaccgtaaggtaaacgttcggaacctaccggtacctaaccgttacgtaccggaacctacgtaccgacggtacccgggaaccacggtaccgtagtcggtagtacggacgtcgtacgttaactaccgttaacggtcgtaacggtacgggtacgggtaacgggttaacgttacgggttacggttcggtccggttacgggttttacgggaccggggtaacggtaacccggtaggtacccggacggttacccggttacccgtaacggtaccgtaccggacccgttacggccctacccgggtccccgttaacccggg

SEQ ID NO: 259061 - DNA, 181 bp, Homo sapiens; identical to SEQ ID NO: 258884
  misc_feature: GYAE6OF01AUPB1.52.5.A05.1.454.CMB.1.raw
  modified_base (178)..(181): a, c, t, g, unknown or other
  misc_feature (178)..(181): n is a, c, g, or t

SEQ ID NO: 259062 - DNA, 180 bp, Homo sapiens
  misc_feature: GYAE6OF01AX043.52.5.A05.1.454.CMB.1.raw
  modified_base (178)..(180): a, c, t, g, unknown or other
  misc_feature (178)..(180): n is a, c, g, or t
tcagcgcagtacgacacgaccggtgctcgatttagatagatagacagggcaccaagggcccatcggtcttccccctggcaccctcctccaagagcacctctggggcacagcggccctgggctgcctggtcaaggactactcctatacgatcgctgagcgggctggcaaggcgcatagnnn

SEQ ID NO: 259063 - DNA, 181 bp, Homo sapiens; identical to SEQ ID NO: 258884
  misc_feature: GYAE6OF01AF684.52.5.A05.1.454.CMB.1.raw
  modified_base (178)..(181): a, c, t, g, unknown or other
  misc_feature (178)..(181): n is a, c, g, or t

SEQ ID NO: 259064 - DNA, 187 bp, Homo sapiens
  misc_feature: GYAE6OF01BI8BD.52.5.A05.1.454.CMB.1.raw
  modified_base (171)..(171): a, c, t, g, unknown or other
  misc_feature (171)..(171): n is a, c, g, or t
  modified_base (177)..(187): a, c, t, g, unknown or other
  misc_feature (177)..(187): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaaggctacttccatacgatcgctgagcgggctggcaaggcncatagnnnnnnnnnnn

SEQ ID NO: 259065 - DNA, 184 bp, Homo sapiens
  misc_feature: GYAE6OF01CR781.52.5.A05.1.454.CMB.1.raw
  modified_base (178)..(184): a, c, t, g, unknown or other
  misc_feature (178)..(184): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctatacgatcgctgagcgggctggcaaggcgcatagnnnnnnn

SEQ ID NO: 259066 - DNA, 631 bp, Homo sapiens
  misc_feature: GYAE6OF01BU719.52.5.A05.1.454.CMB.1.raw
tcagcgcagtacgacacgaccggtgctcgatttagatagatagacagggggcctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgagttgggggatatacatgtttcctggtatcagcagaagccaggccagtctcctgttctcctctatctaataaagatgtacaagccggtccctcgacggactccgtgacgtcgtacttctcgtcggcctacctaattcgtagaaatgacacgcctactcgtacgacctagtccgacggaccgggaacccacgtaccttagtacgggagtacggacggtcgtacgtaacctttattacgtcgttaccggagggtccggtagggtacgttagggttaacgggtttggttcggttcggttttaccggggacgggtaacgggaccgtaacggtaccgttaccggtacccgttacccgtacccgtcgaaccggtaccccgtaacggtccccggttcccgcccccggttacccgg

SEQ ID NO: 259067 - DNA, 183 bp, Homo sapiens
  misc_feature: GYAE6OF01E2BNZ.52.5.A05.1.454.CMB.1.raw
  modified_base (178)..(183): a, c, t, g, unknown or other
  misc_feature (178)..(183): n is a, c, g, or t
tcagcgcagtacgacacgaccggtgctcgatttagatagatagacagggcaccaagggcccatcggtcttccccctggcaccctcctccaagagcacctctggggcacagcggccctgggctgcctggtcaaggctacttcctatacgatcgctgagcgggctggcaaggcgcatagnnnnnn

SEQ ID NO: 259068 - DNA, 180 bp, Homo sapiens
  misc_feature: GYAE6OF01BQ362.52.5.A05.1.454.CMB.1.raw
  modified_base (178)..(180): a, c, t, g, unknown or other
  misc_feature (178)..(180): n is a, c, g, or t
tcagcgcagtacgacacgaccggtgctcgatttagatagatagacagggcaccaagggcccatcggtcttccccctggcaccctcctccaagagcacctctggggcacagcggccctgggctgcctggtcaaggatacttcctcgtactgcgctgagcgggctggcaaggcgcatagnnn

SEQ ID NO: 259069 - DNA, 183 bp, Homo sapiens
  misc_feature: GYAE6OF01AV772.52.5.A05.1.454.CMB.1.raw
  modified_base (179)..(183): a, c, t, g, unknown or other
  misc_feature (179)..(183): n is a, c, g, or t
tcagcgcagtacgacacgaccggtgctcgatttagatagatagacagggcaccaagggcccatcggtcttccccctggcaccctcctccaagagcacctctggggcacagcggccctgggctgcctggtcaaggactacttcctatacgatcgctgagcgggctggcaaggcgcatagnnnnn

SEQ ID NO: 259070 - DNA, 744 bp, Homo sapiens
  misc_feature: GYAE6OF01CHXKB.52.5.A05.1.454.CMB.1.raw
  modified_base (171)..(171): a, c, t, g, unknown or other
  misc_feature (171)..(171): n is a, c, g, or t
  modified_base (320)..(320): a, c, t, g, unknown or other
  misc_feature (320)..(320): n is a, c, g, or t
tcagcgcagtacgacacgaccggtgctcgatttagatagatagacaggggctgggcctcaggaagcagcatcggaggtgcctcagccatggcatggatccctctcttcctcggcgtcctgcttactgcacaggttctgtggcctcctatgacttgactcacgccaccctcngtcgtccgtcgcccaggacagacacgccaccatccactgctcgtggacactcgtagttaggggatatacattcgtttccgtaggtatccaggacaacggaacgccgaaggcctaaggtcctcctgtttcctcctcatactaataaagtntacgtacaacgccgtaccgtacgacgggtactccgtagacgtcgtacttcgtcgtacggtacctaaccgtaagttaccgtaaggaaacgttcgaacgtaccggaccctaacgttacgtaacggaaccctaagttacggaaccgggaccccggtaaccgtacggtaaccctagggtaaggtacggtttacgggaacgggttacctaacggttaaacgtttacgtttaacggttaacgggtaccggtaacggggttacgggtaacgggttaaccgttagggtttttaacgggtcgtttaaccggggtttaccggtttaccgggggaaccggtaaacggggttacccaaacggttccgtaccggttaccccgtacggttacccgacgtaacccggaacggtacgtcccccgtgtacccccggtaccg

SEQ ID NO: 259071 - DNA, 185 bp, Homo sapiens
  misc_feature: GYAE6OF01BTWSG.52.5.A05.1.454.CMB.1.raw
  modified_base (179)..(185): a, c, t, g, unknown or other
  misc_feature (179)..(185): n is a, c, g, or t
tcagcgcagtacgacacgaccggtgctcgatttagatagatagacagggcaccaagggcccatcggtcttccccctggcaccctcctccaagagcacctctggggcacagcggccctgggctgcctggtcaaggactacttcctatacgatcgctgagcgggctggcaaggcgcatagnnnnnnn

SEQ ID NO: 259072 - DNA, 242 bp, Homo sapiens
  misc_feature: GYAE6OF01A57WR.52.5.A05.1.454.CMB.1.raw
  modified_base (187)..(242): a, c, t, g, unknown or other
  misc_feature (187)..(242): n is a, c, g, or t
tcagcgcagtacgacacgaccggtgctcgatttagatagatagacagggcaccaagggcccatcggtcttcccctggcaccctcctccgaacgagctacctcttgggggcacagcggccctgggctgcctggtcaaggctacttctatacgatcgctgagcgggtcctgggcaaggtcgacatacgnnnnnnnnnnnnnnnnnnnnnnnnnnnnnnnnnnnnnnnnnnnnnnnnnnnnnnnn

SEQ ID NO: 259073 - DNA, 673 bp, Homo sapiens
  misc_feature: GYAE6OF01D02U8.52.5.A05.1.454.CMB.1.raw
  modified_base (215)..(215): a, c, t, g, unknown or other
  misc_feature (215)..(215): n is a, c, g, or t
  modified_base (219)..(219): a, c, t, g, unknown or other
  misc_feature (219)..(219): n is a, c, g, or t
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagcccacctcagtcgtccgtcgtcccaggacagacacgccaccatccactgctcngacngtcgtagtgggatatagtattcgtttcgtgtactcgagacaagacgtccgagtccctagttcccttccgttcgttcctccttactacttacttaaagtaaaggtacttcgtaacgaacggtcccggtacccgtacggaacggtacctccccgtaggacgtacgttacgttccgttctcggtacctacttaacgttcgtaagtaactcgacctacgacctacgtactcgtaaccgactacggacccgaccggtacccagtacccgtagtacggtagtacgtcgtacgtaacgttaacgtttacttacgtacggtacggtaggtacgggtcggttaagttagggtttaggttcggttcgttaccggtttcgggacggtacggtaacgcggtccgtacgtcccggttaccgtacggacccgtaccgtaccgacggtcccgtcccgtccccgttaccg

SEQ ID NO: 259074 - DNA, 656 bp, Homo sapiens
  misc_feature: GYAE6OF01B5TXD.52.5.A05.1.454.CMB.1.raw
  modified_base (305)..(305): a, c, t, g, unknown or other
  misc_feature (305)..(305): n is a, c, g, or t
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtcgtccccaggacagacacgaccacatcacctgctctgacatcgagttggggatatacattgtttcctggtactacgagacagaacgccgacggcctacgtctctcgttctcctcatctaataaagntcgtacaacgtcgccgtacgacggtactccgtagacgcgtacttcctcgtcggtacctaccgtaattacgtaaggtaacttcgacacgtcctactcgtacgacctacgtacggacgacccgggaacctacggtcctagtacggtactacgggacgtacgtacgttaacttacttacggttcgtaccgtacgggtcggtacgggtaacggttagggttacggtttcggttcggttacggtttacggggccgggtaaacgggaccgtacgggtaccgttaccggtacccggttaccgttaccgtacccgtaaccgacccggtaacggtcccgtcccggtaccccccgtaccgg

SEQ ID NO: 259075 - DNA, 941 bp, Homo sapiens
  misc_feature: GYAE6OF01CY26L.52.5.A05.1.454.CMB.1.raw
  modified_base (170)..(170): a, c, t, g, unknown or other
  misc_feature (170)..(170): n is a, c, g, or t
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtgcctcctatgacttgactcacgccaccctnagtgtccgtcgtccccaggacagacacgccacatcacctgctctggacatcgtagttggggatatacattcgtttcctggtactcgagcgaaggaacgccgacggccgtacgtccttcccttcggtttacccttccctacctacttaccttaaacgtaaaacggtacttacggtaaccgtaaaccggcccgggtacccccgttaccgggaaccgggtacccgttaccccggtaggtaaccggtaccggttaaactttcccgttccggttacggtacccttaacccgtttaaccgtttcggtaaacgggtaaaacgttccggaaccgtaaccgtcccttaaccgttacccggtaaccgtaacccgtaacgtaccccgggaaccggggtacccccggggtaaaccccttaacggtcccccggttaagggttacggggtaacgttacggggtaccgggtaccgttttaacgggaacctttttaacggtttaccgttaccgggttaaccgggtacgggggtttacccggggtagggggttaaccggtttaaggggtttttacggggttttccgggtttaccggggttttaccgggtttttaaccggggggaaaccgggggttacccggggtaaacccggtaacgggttcccgggttaaacccccggggttaacccggtttacccccgggtttaacggtacccccggttaaacccgggacccccggtaacggggttccccccgttcccccgggttcccccccggtttaaccccggg

SEQ ID NO: 259076 - DNA, 184 bp, Homo sapiens
  misc_feature: GYAE6OF01E0S06.52.5.A05.1.454.CMB.1.raw
  modified_base (177)..(184): a, c, t, g, unknown or other
  misc_feature (177)..(184): n is a, c, g, or t
tcagcgcagtacgacacgaccggtgctcgatttagatagatagacagggcaccaaggcccatcggtcttcccctgcaccctcctccaagagcacctcgtggggcacagcggccctgggctgcctggtcaaggactacttcctatacgatcgctgagcgggctggcaaggcgcatagnnnnnnnn

SEQ ID NO: 259077 - DNA, 211 bp, Homo sapiens
  misc_feature: GYAE6OF01D4RVD.52.5.A05.1.454.CMB.1.raw
  modified_base (176)..(176): a, c, t, g, unknown or other
  misc_feature (176)..(176): n is a, c, g, or t
  modified_base (182)..(182): a, c, t, g, unknown or other
  misc_feature (182)..(182): n is a, c, g, or t
  modified_base (184)..(211): a, c, t, g, unknown or other
  misc_feature (184)..(211): n is a, c, g, or t
tcagcgcagtacgacacgaccggtgctcgatttagatagatagacagggcgaccaagggcccatcggtcttccccctggcaccctcctccaagagcacctctggggcacagcggccctgggcctgcctggtcaaggtactacttcctatacgatcgctgagcgggctggcaaggcncatagngnnnnnnnnnnnnnnnnnnnnnnnnnnnn

SEQ ID NO: 259078 - DNA, 777 bp, Homo sapiens
  misc_feature: GYAE6OF01BFVY9.52.5.A05.1.454.CMB.1.raw
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgtagttgggggactatactagttcgttttccgtaggttattccgagccaaggaacgcccaacgggcctacggttccttcccttggtttccctccttacctaacttaccttaagtaaagattacgttaccgaaacggtccccggaccccgttacgaacggggtaccttccccgtaggtaacggtccgtaacgtttccgttccgtacgggtacccttaaccgtaaacgttttccgaaagggttaaactacggtaccgtacgacccctacgttccgtaaccggtaacctacggttacccggaaccgggtaacccggggtaacccctacggtaacccgttaaggttacgggtaacgttacgggtacggtaccttaacggttaactttaacgttacgttcggtacggtacgggtccgggttagggtaaccgttaggttttacgggttcgttccggttacgggtttaccgggaggggtaaccggtaccgtacggtacgtacccggtaccgttcccggtaccgtcgtaacgacccggtaagcccttccccggtcccgttcccgg

SEQ ID NO: 259079 - DNA, 199 bp, Homo sapiens
  misc_feature: GYAE6OF01DW1M2.52.5.A05.1.454.CMB.1.raw
  modified_base (181)..(199): a, c, t, g, unknown or other
  misc_feature (181)..(199): n is a, c, g, or t
tcagcgcagtacgacacgaccggtgctcgatttagatagatagacagggcaccaagggcccatcggtcttccccctggcaccctcctccaagagcacctctggggcacagcggccctgggctgcctggtcaaggactacttcctatacgatcgctgagcgggctggcaaaggcgcaatagnnnnnnnnnnnnnnnnnnn

SEQ ID NO: 259080 - DNA, 177 bp, Homo sapiens; identical to SEQ ID NO: 258960
  misc_feature: GYAE6OF01AEJWS.52.5.A05.1.454.CMB.1.raw

SEQ ID NO: 259081 - DNA, 203 bp, Homo sapiens
  misc_feature: GYAE6OF01AWLTJ.52.5.A05.1.454.CMB.1.raw
  modified_base (182)..(203): a, c, t, g, unknown or other
  misc_feature (182)..(203): n is a, c, g, or t
tcagcgcagtacgacacgaccggtgctcgatttagatagatagacagggcaccaagggcccatcggtcttccccctggcaccctcctccaagagcacctctgggggcacagcggccctgggctgcctggtcaaaggactacttcctcgtactgcgctgagcgggctggcaaggcgcaatagnnnnnnnnnnnnnnnnnnnnnn

SEQ ID NO: 259082 - DNA, 657 bp, Homo sapiens
  misc_feature: GYAE6OF01D35NR.52.5.A05.1.454.CMB.1.raw
  modified_base (407)..(407): a, c, t, g, unknown or other
  misc_feature (407)..(407): n is a, c, g, or t
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgtacttgactcacgccaccctcagtcgtccgtcgtcccaggacagacacgccaccactccacctcgcctctggacatcgtagttagggggatatactattgtttcctaggtactacgagacagaacgccgacggaccacgtcctctcgtttcctcctactatactaataaagtatcgtacgaacggccgaccctacggacggtactaccgtgacgtcgtacttcgtcgtcgtctacctaacgttcgtagaactgacncgacctactactacgacctataccgacggtaccggacctacgaccttaggtaggtacgtacggtacggtacttacgtaacttacgttacgtcggtacgacgggtcgggtaggtacgttagggttaggtttcgtcggtttacggttcggggacgggtaacggtaaccgtacggtacgtacccgggtaaccgtcccgttaacggtccaaccggtccccggtaacggtccccgtcccggtccccgttaaccgg

SEQ ID NO: 259083 - DNA, 180 bp, Homo sapiens
  misc_feature: GYAE6OF01C3TDQ.52.5.A05.1.454.CMB.1.raw
  modified_base (171)..(171): a, c, t, g, unknown or other
  misc_feature (171)..(171): n is a, c, g, or t
  modified_base (176)..(180): a, c, t, g, unknown or other
  misc_feature (176)..(180): n is a, c, g, or t
tcagcgcagtacgacacgaccggtgctcgatttagatagatagacagggcaccaaggcccatcggtcttcccctggcaccctcctccaagagcacctcgtggggcacagcggccctggctgcctggcaaggctacttcctatacgatcgctgagcgggtctggcaaggcgnatagnnnnn

SEQ ID NO: 259084 - DNA, 765 bp, Homo sapiens
  misc_feature: GYAE6OF01C0V0O.52.5.A05.1.454.CMB.1.raw
tcagcgcagtacgacacgaccggtgctcgatttagatagatagacagggggcctgggcctcaggaagcagcatcggaggtgcctcagccatggcatggactccctctcttcctcggcgtccttgcttactgcactaggttctgtcgcctcctatgacttgactcacgccaccctcagtcgtccgtcgtcccaggacagacacgaccacactcacctcgactcgtgacatcggtagtggggtaatatacgtattcgtttccgtgtactcgagacagaacgccgacgccgacgtccttccttacgttcctcctactacttactaacgtaaagtcgtacgtacgaacggtccgtacccgacggtacggacttcccgtagtacgtaccgttagttccgtccgtacggtcctacgttaacttacgttaggtaacgttcgacgtaccgtactaccgtctaccgaaccttacgacccggaaccgggacccggaaccctcggttacccgtaggtaccggagtaaccggtacgtaccgttacgtaaccgtttagtttaaccggtcgggttaaccggtcgggttaaccgggtacgggtaaggtttaacggggtttcggtttagggtccgttttaccggggttaccgggggacgggttaaaccggaccggttaaccgggtcccgtaaccccggtcccggttaacccgtccggaaccggtaccccggttaaacccggcccggtttaccccggtcccccggtacccccggtttcccgg

SEQ ID NO: 259085 - DNA, 680 bp, Homo sapiens
  misc_feature: GYAE6OF01D91VT.52.5.A05.1.454.CMB.1.raw
  modified_base (417)..(417): a, c, t, g, unknown or other
  misc_feature (417)..(417): n is a, c, g, or t
tcagcgcagtacgacacgaccggtgctcgatttagatagatagacagggggcctgggcctcaggaagcagcatcggaggtgcctcagccatggcatggatccctctcttcctcggcgtccttgcttactgcacaggttctgtcggcctctatgacttgactcacgccaccctcagtcgtccgtcgtcccaggacagacacgccaccactccacctcgctctcggactacgtcggtaggttgggggaatatactagttcgtttccgtaggtatcgagacgaagaacgccgaacggcctacgttcctccgttgttcctcctctattactaataagtactgtacgacgccgccctcgacggtactccgtagacgtcgtacttcgtcgtcgtctacctaagttcgagtaactcgacgaccncctactcgtacgactacgtccggaacgggacccggaacctacgaccgttaggtacggagtacggacgtacgtacgtaactttacgtacgtgtaccggtaggtccgggtaaggtacgttaaggtttacgggttggttcggttccggttacggggacgggttaaccgggaccgttaacccgttccgtttaaacccggtccggttaaccgtccgaacccggtacccgtaaccggtcccgtccccggttccccgttcccgggtaccg

SEQ ID NO: 259086 - DNA, 189 bp, Homo sapiens
  misc_feature: GYAE6OF01APEQX.52.5.A05.1.454.CMB.1.raw
  modified_base (181)..(189): a, c, t, g, unknown or other
  misc_feature (181)..(189): n is a, c, g, or t
tcagcgcagtacgacacgaccggtgctcgatttagatagatagacagggcaccaagggcccatcggtcttccccctggcaccctcctccaagagcacctctggggcacagcggccctgggctgcctggtcaaggactacttccctatacgatcgctgagcgggctggcaaggcgcagtagnnnnnnnnn

SEQ ID NO: 259087 - DNA, 185 bp, Homo sapiens
  misc_feature: GYAE6OF01A7MOV.52.5.A05.1.454.CMB.1.raw
  modified_base (178)..(185): a, c, t, g, unknown or other
  misc_feature (178)..(185): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctcgtagcactctgagcgggctggcaaggcgcatagnnnnnnnn

SEQ ID NO: 259088 - DNA, 608 bp, Homo sapiens
  misc_feature: GYAE6OF01B2FSC.52.5.A05.1.454.CMB.1.raw
  modified_base (290)..(290): a, c, t, g, unknown or other
  misc_feature (290)..(290): n is a, c, g, or t
  modified_base (293)..(293): a, c, t, g, unknown or other
  misc_feature (293)..(293): n is a, c, g, or t
tcagcgcagtacgacacgaccggtgctcgatttagatagatagacagggggcctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctanaanatgtcaagcgccctcaggactcccgtgagcgattctctgctcattcgtgaatgcacgccactctacgaccactccgaaggccgggaacccacgtaccttagtcggtagtgacggctagacttaacttacgtgtacgtagggcgttacgggacgtacgggttaggtttcggtacggttcggttttaccgggcgggttaaccggggaacccgtaacggtaccggttacggtaccccggttacccgttaacccgggttaccgaccggttaccccgaaaccgggtcccgttacccgggtcccccccgttaaccccgggg

SEQ ID NO: 259089 - DNA, 885 bp, Homo sapiens
  misc_feature: GYAE6OF01A8ZM0.52.5.A05.1.454.CMB.1.raw
  modified_base (861)..(861): a, c, t, g, unknown or other
  misc_feature (861)..(861): n is a, c, g, or t
tcagcgcagtacgacacgaccggtgctcgatttagatagatagacaggggctgggcctcaggaagcagcatcggaggtgcctcagccatggcatggactccctctcttcctcggcgttccttgtcttactgcacgtaggttctggtcggccttcctatgtacttcgacctcaccgaccctaccctcgtacggtcgtccgtccgtcccgaggacacgacacgcccactactacctactcgtctcgtacgactacgtaggtacggtaggggtattactacgtacgtttcgtttaccgtgttacgtaccgagacgtaacggaaccgtcccggtacggtaccctacgtttccccgttccgtttaccgtttcccttacccgttacgttacttaacgttaaacggtaaacgtcgttaccggtaccggtaaccgggtccccggtacccgtaacgggtacccgggtaccctccggtaacggtacgttaccgttacgttaccgtcgttaccgttacctaacgtttacgtacgtaacgtaacgtaccggtacctaccgtaccctacggtacctacccgtaactaccggtaacccggacccggtaacccggtaccgtaaccggttacgtacgggtacggtaccgtagggtaacgttaccgttacggtttaaccgttcggttaacggtccgggtaacgggttaccggggtacggggtttaacggttacgggttttagggtttaccgggttccgggttagggtttaccgggtccgggtaccgggtaaaccgtacggtaccggttacccggtcccggttacccgttaaccgggtaccgtaaacccggtcccggtaaccggtccccggtttaaccncccccggggttcccttaccccggg

SEQ ID NO: 259090 - DNA, 186 bp, Homo sapiens
  misc_feature: GYAE6OF01EZUJR.52.5.A05.1.454.CMB.1.raw
  modified_base (179)..(186): a, c, t, g, unknown or other
  misc_feature (179)..(186): n is a, c, g, or t
tcagcgcagtacgacacgaccggtgctcgatttagatagatagacagggcaccaagggcccatcggtcttcccctggcaccctcctccaagagcacctcgtggggcacagcggccctgggctgcctggtcaaggactacttcctatacgatcgctgagcgggctggcaaggcgcatagnnnnnnnn

SEQ ID NO: 259091 - DNA, 719 bp, Homo sapiens
  misc_feature: GYAE6OF01BLAOH.52.5.A05.1.454.CMB.1.raw
  modified_base (295)..(295): a, c, t, g, unknown or other
  misc_feature (295)..(295): n is a, c, g, or t
tcagcgcagtacgacacgaccggtgctcgatttagatagatagacagggggcctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgagttgggggatatacatgtttcctggtatcagtcagaagcagccagtctcctgttctcctcattctataagntgtacaaggcgaccctcgagggactcccgtagacgtccgatttccgtctcggtccttaccctaagtttccgtagggtaaaacttcggacgacgtacccctaaccgttccgttacgaaccctaacgttacccgaacgggaccccggggtaacccaaccgggtaccccgtttaacgtacgggtaacgttacggtaacgggtccttaacgggttaacctttaacggtttaacccgttacggttaccgggtaaccgggtaccgggttaccggggtaacggtttaacgggtttacgggttttacgggttcggttacccgggttttacggggtaccggggtaacgggtaacccgtaaggtccgttacggtacccgtccgttaaccgtccgtaccgtacccgaaaggtcccgtaccgtcccccgtacccgg

SEQ ID NO: 259092 - DNA, 749 bp, Homo sapiens
  misc_feature: GYAE6OF01DZR0P.52.5.A05.1.454.CMB.1.raw
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgtacttgactcagccaccctcagtgtccgtcgtccccgaggacaggacacgccaccatcaccgtgctcgtgactagtcgagttagggggactacgtactagttacgtttcctaggttactcgagtccaagaacgaccgaggccacggttcctaccttcgtcctccctctacgttactaagtaaacgtatacgttaccaacggtccggtaccctacggtaacgggactccccgtaggacgtacgtacgttctccgtacggtcttacgtaattacgtaacggtaactcgaccgacgtaccaccttcaccgtaacctacgtaccgtaacccgggaccggtaaccctacggaccgttacgtagggtacgttacgggacggtactacgtaaacgttacgtttactacgggtaccggacgggttcggggtaagggtaccggtttaagggttacgggtttacggttacgggttccggtttaccgggggaccgggttaagggtaacccgtacggttacccggttaccggttacccggtaccggttccgaaccggtaccggtaaccccgtaacggttcccggtcccccggggtccccgttaacccggg

SEQ ID NO: 259093 - DNA, 186 bp, Homo sapiens
  misc_feature: GYAE6OF01CQZ42.52.5.A05.1.454.CMB.1.raw
  modified_base (178)..(186): a, c, t, g, unknown or other
  misc_feature (178)..(186): n is a, c, g, or t
tcagcgcagtacgacacgaccggtgctcgatttagatagatagacagggcaccaagggcccatcggtcttccccctggcaccctcctccaagagcacctctggggcacagcggccctgggctgcctggtcaaggctacttcctatacgatcgctgagcgggctggcaaggcgcatagnnnnnnnnn

SEQ ID NO: 259094 - DNA, 181 bp, Homo sapiens
  misc_feature: GYAE6OF01DP43V.52.5.A05.1.454.CMB.1.raw
  modified_base (179)..(181): a, c, t, g, unknown or other
  misc_feature (179)..(181): n is a, c, g, or t
tcagcgcagtacgacacgaccggtgctcgatttagatagatagacagggcaccaagggcccatcggtcttcccctggcaccctcctccaagagcacctcgtggggcacagcggccctgggctgcctggtcaaggactacttcctatacgatcgctgagcgggctggcaaggcgcatagnnn

SEQ ID NO: 259095 - DNA, 766 bp, Homo sapiens
  misc_feature: GYAE6OF01E4IJI.52.5.A05.1.454.CMB.1.raw
  modified_base (284)..(284): a, c, t, g, unknown or other
  misc_feature (284)..(284): n is a, c, g, or t
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagcccaccctcagtgtccgtcgtcccaggacagacagccaccatcacctgctctggacatcgagttgggggatatactatgttcctggtatcagcagacgccacggcacgtctcctgtctcctnactctaataaacgtatcgtacgaacgccggtccctacgagggtactcccgtagacgtcgtacgttacctcgtcggtccttacctaagtttacccgtagggtaaacgtgaccgtacgtaccctaccgtcgttacgaccccgtaattacccggacggtaccccggggtaaccccgacgtacccgttaacgtacgggtaacgtacgggtaacggtccgtaacgtaccgttaagtttaccgttacggtaccgtaacggggtccgggttaacggggtacggttaacgggttttaagggttttacgggttacgggtttccggggttttacccggggtaaccggggtaaccggggtaaccccgttaaacggtcccgggttaacccggttaacccgggtttaccccgtaaaccgggttacccgtaacccgggtacccccggtaaacgggttccccggtaccccgggttcccccccggtttaaccccgggg

SEQ ID NO: 259096 - DNA, 185 bp, Homo sapiens
  misc_feature: GYAE6OF01CREON.52.5.A05.1.454.CMB.1.raw
  modified_base (182)..(185): a, c, t, g, unknown or other
  misc_feature (182)..(185): n is a, c, g, or t
tcagcgcagtacgacacgaccggtgctcgatttagatagatagacagggcaccaagggcccatcggtcttccccctggcaccctcctccaagagcacctcgtggggcacagcggccctgggctgcctggtcaaggactacttcctcgtagcactctggagcggggctggcaaggcgcatagnnnn

SEQ ID NO: 259097 - DNA, 199 bp, Homo sapiens
  misc_feature: GYAE6OF01A0P5U.52.5.A05.1.454.CMB.1.raw
  modified_base (177)..(199): a, c, t, g, unknown or other
  misc_feature (177)..(199): n is a, c, g, or t
tcagcgcagtacgacacgaccggtgctcgatttagatagatagacagggcgaccaagggcccatcggtcttcccctgcaccctcctccaagagcacctcgtggggcacagcggccctgggctgcctggtcaaggctactcctatacgatcgctgagcgggctggcaaggcgcatagnnnnnnnnnnnnnnnnnnnnnnn

SEQ ID NO: 259098 - DNA, 196 bp, Homo sapiens
  misc_feature: GYAE6OF01CFNAU.52.5.A05.1.454.CMB.1.raw
  modified_base (107)..(107): a, c, t, g, unknown or other
  misc_feature (107)..(107): n is a, c, g, or t
  modified_base (176)..(176): a, c, t, g, unknown or other
  misc_feature (176)..(176): n is a, c, g, or t
  modified_base (181)..(196): a, c, t, g, unknown or other
  misc_feature (181)..(196): n is a, c, g, or t
tcagcgcagtacgacacgaccggtgctcgatttagatagatagacagggcaccaagggcccatcggtcttcccctgcaccctcctcaagagcacctcgtggggcacnggccggcctgggctgcctggacaggtactacttcctatacgatcgctgacggcgggctggcaagggctnatgcnnnnnnnnnnnnnnnn

SEQ ID NO: 259099 - DNA, 195 bp, Homo sapiens
  misc_feature: GYAE6OF01ETI0U.52.5.A05.1.454.CMB.1.raw
  modified_base (182)..(195): a, c, t, g, unknown or other
  misc_feature (182)..(195): n is a, c, g, or t
tcagcgcagtacgacacgaccggtgctcgatttagatagatagacagggcaccaagggcccatcggtcttcccctggcaccctcctccaagagcacctcgtggggcacagcggccctgggctgcctggtcaaggactacttcctatacggatcgctggagcgggctggacaaggcgcatagnnnnnnnnnnnnnn

SEQ ID NO: 259100 - DNA, 204 bp, Homo sapiens
  misc_feature: GYAE6OF01CXANB.52.5.A05.1.454.CMB.1.raw
  modified_base (153)..(153): a, c, t, g, unknown or other
  misc_feature (153)..(153): n is a, c, g, or t
  modified_base (179)..(204): a, c, t, g, unknown or other
  misc_feature (179)..(204): n is a, c, g, or t
tcagcgcagtacgacacgaccggtgctcgatttagatagatagacagggcaccaagggcccatcggtcttccccgtggcaccctcctccaagagcacctcgtggggcacagcggcctgggctgcctggtcaaggctacttcctatacgatcgntgagcggctggcaaggccgtcatagnnnnnnnnnnnnnnnnnnnnnnnnnn

SEQ ID NO: 259101 - DNA, 208 bp, Homo sapiens
  misc_feature: GYAE6OF01D0COJ.52.5.A05.1.454.CMB.1.raw
  modified_base (163)..(163): a, c, t, g, unknown or other
  misc_feature (163)..(163): n is a, c, g, or t
  modified_base (180)..(208): a, c, t, g, unknown or other
  misc_feature (180)..(208): n is a, c, g, or t
tcagcgcagtacgacacgaccggtgctcgatttagatagatagacagggcaccaagggcccatcggtcttccccctggcaccctcctccaagagcacctctggggcacagcggccctgggctgcctggtcaaggactacttcctatacgatcgctgagcgggntggcaaggcgcataggnnnnnnnnnnnnnnnnnnnnnnnnnnnnn

SEQ ID NO: 259102 - DNA, 796 bp, Homo sapiens
  misc_feature: GYAE6OF01CDJAD.52.5.A05.1.454.CMB.1.raw
tcagcgcagtacgacacgaccggtgctcgatttagatagatagacagggggcctgggcctcaggaagcagcatcggaggtgcctcagccatggcatggactccctctcttcctcggcgtccttgcttactgcacgtaggttctgtcggccttcctatgtacttcgactcacgccctaccctcgtacgttcgttcccgtacgtacccccgaaggacacgacgacgcccacctactaccgaccgtgtccttcgtacggaactacgtacggtagggttacggggaattacgttaaccgtagttttcgtttccgttaggttataacggacgtagaaacggaccggaacgtacggccgtacgttaccgttcccgtttacttcccgttacctcttaaccttaacttaaaggtaaacgttacgttacgaacccgtacggtccccggacctacgggtacggtcccttaccgtcggaagtcggtacttccgttacggtcgacctttaactaacgttcgtaacgtaagttcgaaccaccgtcgtaccttccgtacacctcgaccgaccggtaaccgaacccgtacgtaccggtacgacggtaacgtcggtacgtacttacgtacgttaccgttcgtagaccgggtagtaccgggttaggtacggttagggttaggttcggttcggttacgggttaccgggtacggggtaaccgtacggtaccggtcggttacccggtacccggttaccgaaccggtacgtaccggaacccggtaccgttccccgggtcccggttccccggtacccg

SEQ ID NO: 259103 - DNA, 900 bp, Homo sapiens
  misc_feature: GYAE6OF01BE0WE.52.5.A05.1.454.CMB.1.raw
  modified_base (714)..(714): a, c, t, g, unknown or other
  misc_feature (714)..(714): n is a, c, g, or t
tcagcgcagtacgacacgaccggtgctcgatttagatagatagacgaggggctgggcctcaggaagcagcatcggaggtgcctcagccagtggcatggactcctctcttccgtcggcgtccttgacttactggctaacgtggttcgtgtcggtccttccgtatcggtactttacggactacgaccgaccctacccgtacgtacggtccgtccgttccgaccccggaagggacctacggaccgaccggcctaaccgtactccgacctcggcttccggacgtacgagttacggtagggttaggggtaactacgtacgttagttccggtttaccgtaggtactaccgagtacgacggacgtaccgcggtactacgtaccgttccgttacgtccctaccgttactaaccgttagttaacgtaaacgtcgttaacgggtaccaccgggtacccggtaccgttaacgggaccggtaccgtccggtaacggtacgtaccgttagttccgtaacggtaccgtacccgttaacgtacggttaccggtaagggtaacctacggaccgtacgttacccgtacgttaccggtaaccgtacggaaccgttaacccgggacccgggtttaaccgaacccgtttacggaacgttacgggtacgtaacgggtacggtacgtaaccgttaggttaaccgtttaacggttaccggtaggggttaaacccggnggggttaacccgggttacgggtttaaccgggttagggtttaccggtttaccggggtacgtttacggggttacggggaaaccgggtttacgtaaccgtcggtaaccggttaccggtcccggtttaaccggcgttaaaccggacccggtaccggttacgtccccggtttaaccggccccgtttaaccg

SEQ ID NO: 259104 - DNA, 718 bp, Homo sapiens
  misc_feature: GYAE6OF01AN364.52.5.A05.1.454.CMB.1.raw
  modified_base (94)..(94): a, c, t, g, unknown or other
  misc_feature (94)..(94): n is a, c, g, or t
tcagcgcagtacgacacgaccggtgctcgatttagatagatagacagggggcctgggcctcaggaagcagcatcggaggtgcctcagccatggnatggatccctctcttcctcggcgtccttgcttactgcacgaggttctggtggcctcctatcgaccttgacttcacgcccaccctcagtcgtccgtgtcccccgaggacagacgacgaccaccatccacctggtcctctcggactacgtcggtagttagggggattaatacagttggtttcccgtggtactcgaagcgaacgtaacggccgaaccggccgtacggtcctccgttcggttacctccctcacttctaagtaaacgtatacgtacgaagtccgccctagtacgggtacctccgtgaccgtcgtacttcctcgtcgtacgtacctaacgttcgtaaggtaaatcgactaccgacctaacgtctacgtaacccagttacccgacggacccgggtaaccctagacccgtaagggtcgtaacgtcggaagggttacctaacggttaacgttacgttaactcgggttacgacgggtggacgggttaaccgtgggtttaacggttcggttcggttcggttcggggaaccggaagggttaacctacgggtaccgtaccgtcccgttaccggtacgttccggaaccgtaccccggaacggtcctacccccgggtcccgtaccccgg

SEQ ID NO: 259105 - DNA, 178 bp, Homo sapiens; identical to SEQ ID NO: 258897
  misc_feature: GYAE6OF02H4FOB.52.5.A05.1.454.CMB.1.raw
  modified_base (178)..(178): a, c, t, g, unknown or other
  misc_feature (178)..(178): n is a, c, g, or t

SEQ ID NO: 259106 - DNA, 179 bp, Homo sapiens
  misc_feature: GYAE6OF02J03US.52.5.A05.1.454.CMB.1.raw
  modified_base (176)..(179): a, c, t, g, unknown or other
  misc_feature (176)..(179): n is a, c, g, or t
tcagcgcagtacgacacgaccggtgctcgatttagatagatagacagggcaccaaggccatcggtcttcccctggcaccctcctccaagagcacctctggggcacagcggccctgggctgcctggtcaaggactacttcctatacgatcgctgagcgggctggcaaggcgcatagnnnn

SEQ ID NO: 259107 - DNA, 175 bp, Homo sapiens
  misc_feature: GYAE6OF02FYPBY.52.5.A05.1.454.CMB.1.raw
  modified_base (175)..(175): a, c, t, g, unknown or other
  misc_feature (175)..(175): n is a, c, g, or t
tcagcgcagtacgacacgaccggtgctcgatttagatagatagacaggcaccaaggcccatcggtcttccctggcaccctcctccaagagcacctctggggcacagcggccctgggctgcctggtcaaggactacttcctcgtagcactctgagcgggctggcaaggcgcatagn

SEQ ID NO: 259108 - DNA, 177 bp, Homo sapiens
  misc_feature: GYAE6OF02IK5J9.52.5.A05.1.454.CMB.1.raw
  modified_base (176)..(177): a, c, t, g, unknown or other
  misc_feature (176)..(177): n is a, c, g, or t
tcagcgcagtacgacacgaccggtgctcgatttagatagatagacagggcaccaagggccatcggtcttccctggcaccctcctccaagagcacctctggggcacagcggccctgggctgcctggtcaaggactacttcctatacgatcgctgagcgggctggcaaggcgcatagnn

SEQ ID NO: 259109 - DNA, 177 bp, Homo sapiens
  misc_feature: GYAE6OF02GN6XS.52.5.A05.1.454.CMB.1.raw
  modified_base (177)..(177): a, c, t, g, unknown or other
  misc_feature (177)..(177): n is a, c, g, or t
tcagcgcagtacgacacgaccggtgctcgatttagatagatagacagggcaccaagggcccatcggtcttccctggcaccctcctccaagagcacctctggggcacagcggccctgggctgcctggtcaaggactacttcctcgtagcactctgagcgggctggcaaggcgcatagn

SEQ ID NO: 259110 - DNA, 176 bp, Homo sapiens
  misc_feature: GYAE6OF02HQH89.52.5.A05.1.454.CMB.1.raw
  modified_base (153)..(153): a, c, t, g, unknown or other
  misc_feature (153)..(153): n is a, c, g, or t
  modified_base (172)..(176): a, c, t, g, unknown or other
  misc_feature (172)..(176): n is a, c, g, or t
tcagcgcagtacgacacgaccggtgctcgatttagatagatagacagggcaccgaaggcccgatcggtcttcccctggcaccctctccaagagcacctctggggcacagcgcctggctgcctggtcaaggctacttcctatacgatcgctgancggctggcaaggcgcatgnnnnn

SEQ ID NO: 259111 - DNA, 178 bp, Homo sapiens; identical to SEQ ID NO: 258897
  misc_feature: GYAE6OF02JAM0Q.52.5.A05.1.454.CMB.1.raw
  modified_base (178)..(178): a, c, t, g, unknown or other
  misc_feature (178)..(178): n is a, c, g, or t

SEQ ID NO: 259112 - DNA, 178 bp, Homo sapiens; identical to SEQ ID NO: 258897
  misc_feature: GYAE6OF02HT8ZN.52.5.A05.1.454.CMB.1.raw
  modified_base (178)..(178): a, c, t, g, unknown or other
  misc_feature (178)..(178): n is a, c, g, or t

SEQ ID NO: 259113 - DNA, 177 bp, Homo sapiens
  misc_feature: GYAE6OF02FXZX7.52.5.A05.1.454.CMB.1.raw
  modified_base (176)..(177): a, c, t, g, unknown or other
  misc_feature (176)..(177): n is a, c, g, or t
tcagcgcagtacgacacgaccggtgctcgatttagatagatagacaggcaccaaggcccatcggtcttcccctggcaccctcctccaagagcacctctggggcacagcggccctgggctgcctggtcaaggactacttcctatacgatcgctgagcgggctggcaaggcgcatagnn

SEQ ID NO: 259114 - DNA, 179 bp, Homo sapiens; identical to SEQ ID NO: 258888
  misc_feature: GYAE6OF02H31MN.52.5.A05.1.454.CMB.1.raw
  modified_base (178)..(179): a, c, t, g, unknown or other
  misc_feature (178)..(179): n is a, c, g, or t

SEQ ID NO: 259115 - DNA, 202 bp, Homo sapiens
  misc_feature: GYAE6OF02IUMWC.52.5.A05.1.454.CMB.1.raw
  modified_base (183)..(202): a, c, t, g, unknown or other
  misc_feature (183)..(202): n is a, c, g, or t
tcagcgcagtacgacacgaccggtgctcgatttagatagatagacagggcgaccaagggcccatcggtcttcccctggcaccctcctccaagagcacctctgggggcacgacgcggccctgggctgccgtggtcaaggactacttcctcgtagcactctgagcgggctggcaaggcgcatagnnnnnnnnnnnnnnnnnnnn

SEQ ID NO: 259116 - DNA, 180 bp, Homo sapiens; identical to SEQ ID NO: 258883
  misc_feature: GYAE6OF02HSANQ.52.5.A05.1.454.CMB.1.raw
  modified_base (178)..(180): a, c, t, g, unknown or other
  misc_feature (178)..(180): n is a, c, g, or t

SEQ ID NO: 259117 - DNA, 180 bp, Homo sapiens; identical to SEQ ID NO: 259043
  misc_feature: GYAE6OF02GV1UP.52.5.A05.1.454.CMB.1.raw
  modified_base (178)..(180): a, c, t, g, unknown or other
  misc_feature (178)..(180): n is a, c, g, or t

SEQ ID NO: 259118 - DNA, 180 bp, Homo sapiens; identical to SEQ ID NO: 258883
  misc_feature: GYAE6OF02HG6V5.52.5.A05.1.454.CMB.1.raw
  modified_base (178)..(180): a, c, t, g, unknown or other
  misc_feature (178)..(180): n is a, c, g, or t

SEQ ID NO: 259119 - DNA, 178 bp, Homo sapiens; identical to SEQ ID NO: 258897
  misc_feature: GYAE6OF02GKX2R.52.5.A05.1.454.CMB.1.raw
  modified_base (178)..(178): a, c, t, g, unknown or other
  misc_feature (178)..(178): n is a, c, g, or t

SEQ ID NO: 259120 - DNA, 239 bp, Homo sapiens
  misc_feature: GYAE6OF02IFJEI.52.5.A05.1.454.CMB.1.raw
  modified_base (182)..(183): a, c, t, g, unknown or other
  misc_feature (182)..(183): n is a, c, g, or t
  modified_base (185)..(190): a, c, t, g, unknown or other
  misc_feature (185)..(190): n is a, c, g, or t
  modified_base (192)..(239): a, c, t, g, unknown or other
  misc_feature (192)..(239): n is a, c, g, or t
tcagcgcagtacgacacgaccggtgctcgatttagatagatagacagggcgaccaagggcccatcggtctttcccctggcacccgtcctccaagagccaccgtctggggcacagcggccctggctgcctggtcaaggacctattcctatacgatcgctgagcgggctggcaaggcgcatagnngnnnnnngnnnnnnnnnnnnnnnnnnnnnnnnnnnnnnnnnnnnnnnnnnnnnnnn

SEQ ID NO: 259121 - DNA, 222 bp, Homo sapiens
  misc_feature: GYAE6OF02GJSLO.52.5.A05.1.454.CMB.1.raw
  modified_base (179)..(222): a, c, t, g, unknown or other
  misc_feature (179)..(222): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctcgtactgcgctgagcgggctggcaaggcgcatacgnnnnnnnnnnnnnnnnnnnnnnnnnnnnnnnnnnnnnnnnnnnn

SEQ ID NO: 259122 - DNA, 184 bp, Homo sapiens; identical to SEQ ID NO: 259065
  misc_feature: GYAE6OF02JPIR4.52.5.A05.1.454.CMB.1.raw
  modified_base (178)..(184): a, c, t, g, unknown or other
  misc_feature (178)..(184): n is a, c, g, or t

SEQ ID NO: 259123 - DNA, 179 bp, Homo sapiens; identical to SEQ ID NO: 258888
  misc_feature: GYAE6OF02FT0SF.52.5.A05.1.454.CMB.1.raw
  modified_base (178)..(179): a, c, t, g, unknown or other
  misc_feature (178)..(179): n is a, c, g, or t

SEQ ID NO: 259124 - DNA, 178 bp, Homo sapiens
  misc_feature: GYAE6OF02F5YKP.52.5.A05.1.454.CMB.1.raw
  modified_base (176)..(178): a, c, t, g, unknown or other
  misc_feature (176)..(178): n is a, c, g, or t
tcagcgcagtacgacacgaccggtgctcgatttagatagatagacagggcaccaagggccatcggtcttccctggcaccctcctccaagagcacctctggggcacagcggccctgggctgcctggtcaaggactacttcctatacgatcgctgagcgggctggcaaggcgcatagnnn

SEQ ID NO: 259125 - DNA, 179 bp, Homo sapiens; identical to SEQ ID NO: 258947
  misc_feature: GYAE6OF02IMFMZ.52.5.A05.1.454.CMB.1.raw
  modified_base (178)..(179): a, c, t, g, unknown or other
  misc_feature (178)..(179): n is a, c, g, or t

SEQ ID NO: 259126 - DNA, 180 bp, Homo sapiens; identical to SEQ ID NO: 258883
  misc_feature: GYAE6OF02JCBF8.52.5.A05.1.454.CMB.1.raw
  modified_base (178)..(180): a, c, t, g, unknown or other
  misc_feature (178)..(180): n is a, c, g, or t

SEQ ID NO: 259127 - DNA, 183 bp, Homo sapiens; identical to SEQ ID NO: 258901
  misc_feature: GYAE6OF02GY0TV.52.5.A05.1.454.CMB.1.raw
  modified_base (178)..(183): a, c, t, g, unknown or other
  misc_feature (178)..(183): n is a, c, g, or t

SEQ ID NO: 259128 - DNA, 177 bp, Homo sapiens
  misc_feature: GYAE6OF02F846B.52.5.A05.1.454.CMB.1.raw
  modified_base (177)..(177): a, c, t, g, unknown or other
  misc_feature (177)..(177): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctctagcactctgagcgggctggcaaggcgcatagn

SEQ ID NO: 259129 - DNA, 179 bp, Homo sapiens; identical to SEQ ID NO: 258888
  misc_feature: GYAE6OF02GXNGZ.52.5.A05.1.454.CMB.1.raw
  modified_base (178)..(179): a, c, t, g, unknown or other
  misc_feature (178)..(179): n is a, c, g, or t

SEQ ID NO: 259130 - DNA, 179 bp, Homo sapiens
  misc_feature: GYAE6OF02HT7FH.52.5.A05.1.454.CMB.1.raw
  modified_base (177)..(179): a, c, t, g, unknown or other
  misc_feature (177)..(179): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctatacgatcgctgagcggctggcaaggcgcatagnnn

SEQ ID NO: 259131 - DNA, 180 bp, Homo sapiens; identical to SEQ ID NO: 258894
  misc_feature: GYAE6OF02HUAGZ.52.5.A05.1.454.CMB.1.raw
  modified_base (178)..(180): a, c, t, g, unknown or other
  misc_feature (178)..(180): n is a, c, g, or t

SEQ ID NO: 259132 - DNA, 184 bp, Homo sapiens; identical to SEQ ID NO: 259065
  misc_feature: GYAE6OF02INGVM.52.5.A05.1.454.CMB.1.raw
  modified_base (178)..(184): a, c, t, g, unknown or other
  misc_feature (178)..(184): n is a, c, g, or t

SEQ ID NO: 259133 - DNA, 178 bp, Homo sapiens; identical to SEQ ID NO: 258897
  misc_feature: GYAE6OF02IQWRY.52.5.A05.1.454.CMB.1.raw
  modified_base (178)..(178): a, c, t, g, unknown or other
  misc_feature (178)..(178): n is a, c, g, or t

SEQ ID NO: 259134 - DNA, 180 bp, Homo sapiens; identical to SEQ ID NO: 258883
  misc_feature: GYAE6OF02HISEA.52.5.A05.1.454.CMB.1.raw
  modified_base (178)..(180): a, c, t, g, unknown or other
  misc_feature (178)..(180): n is a, c, g, or t

SEQ ID NO: 259135 - DNA, 180 bp, Homo sapiens; identical to SEQ ID NO: 258883
  misc_feature: GYAE6OF02I5VW4.52.5.A05.1.454.CMB.1.raw
  modified_base (178)..(180): a, c, t, g, unknown or other
  misc_feature (178)..(180): n is a, c, g, or t

SEQ ID NO: 259136 - DNA, 179 bp, Homo sapiens; identical to SEQ ID NO: 258888
  misc_feature: GYAE6OF02GENDK.52.5.A05.1.454.CMB.1.raw
  modified_base (178)..(179): a, c, t, g, unknown or other
  misc_feature (178)..(179): n is a, c, g, or t

SEQ ID NO: 259137 - DNA, 179 bp, Homo sapiens; identical to SEQ ID NO: 258888
  misc_feature: GYAE6OF02HSM30.52.5.A05.1.454.CMB.1.raw
  modified_base (178)..(179): a, c, t, g, unknown or other
  misc_feature (178)..(179): n is a, c, g, or t

SEQ ID NO: 259138 - DNA, 180 bp, Homo sapiens
  misc_feature: GYAE6OF02HU86Y.52.5.A05.1.454.CMB.1.raw
  modified_base (179)..(180): a, c, t, g, unknown or other
  misc_feature (179)..(180): n is a, c, g, or t
tcagcgcagtacgacacgaccggtgctcgatttagatagatagacagggcaccaagggcccatcggtcttcccctggcaccctcctccaagagcacctctgggggcacagcggccctgggctgcctggtcaaggactacttcctatacgatcgctgagcgggctggcaaggcgcatagnn

SEQ ID NO: 259139 - DNA, 178 bp, Homo sapiens; identical to SEQ ID NO: 258897
  misc_feature: GYAE6OF02HGDBR.52.5.A05.1.454.CMB.1.raw
  modified_base (178)..(178): a, c, t, g, unknown or other
  misc_feature (178)..(178): n is a, c, g, or t

SEQ ID NO: 259140 - DNA, 179 bp, Homo sapiens; identical to SEQ ID NO: 258888
  misc_feature: GYAE6OF02GM0DE.52.5.A05.1.454.CMB.1.raw
  modified_base (178)..(179): a, c, t, g, unknown or other
  misc_feature (178)..(179): n is a, c, g, or t

SEQ ID NO: 259141 - DNA, 172 bp, Homo sapiens
  misc_feature: GYAE6OF02GR414.52.5.A05.1.454.CMB.1.raw
  modified_base (172)..(172): a, c, t, g, unknown or other
  misc_feature (172)..(172): n is a, c, g, or t
tcagcgcagtacgacacgaccggtgctcgatttagatagatagacaggcaccaaggccatcggtcttccctggcaccctcctccaagagcacctctgggcacagcggccctggctgcctggtcaaggactacttcctatacgatcgctgagcgggctggcaaggcgcatagn

SEQ ID NO: 259142 - DNA, 181 bp, Homo sapiens; identical to SEQ ID NO: 258884
  misc_feature: GYAE6OF02JHPFS.52.5.A05.1.454.CMB.1.raw
  modified_base (178)..(181): a, c, t, g, unknown or other
  misc_feature (178)..(181): n is a, c, g, or t

SEQ ID NO: 259143 - DNA, 185 bp, Homo sapiens
  misc_feature: GYAE6OF02JG6EO.52.5.A05.1.454.CMB.1.raw
  modified_base (178)..(185): a, c, t, g, unknown or other
  misc_feature (178)..(185): n is a, c, g, or t
tcagcgcagtacgacacgaccggtgctcgatttagatagatagacagggcaccaagggcccatcggtcttcccctggcaccctcctccaagagcacctcgtggggcacagcggcctgggctgcctggtcaaggactacttcctatacgatcgctgagcgggctggcaaggcgcatagnnnnnnnn

SEQ ID NO: 259144 - DNA, 179 bp, Homo sapiens; identical to SEQ ID NO: 258888
  misc_feature: GYAE6OF02FSRKA.52.5.A05.1.454.CMB.1.raw
  modified_base (178)..(179): a, c, t, g, unknown or other
  misc_feature (178)..(179): n is a, c, g, or t

SEQ ID NO: 259145 - DNA, 182 bp, Homo sapiens; identical to SEQ ID NO: 259038
  misc_feature: GYAE6OF02G5C14.52.5.A05.1.454.CMB.1.raw
  modified_base (178)..(182): a, c, t, g, unknown or other
  misc_feature (178)..(182): n is a, c, g, or t

SEQ ID NO: 259146 - DNA, 181 bp, Homo sapiens; identical to SEQ ID NO: 259030
  misc_feature: GYAE6OF02I4IA6.52.5.A05.1.454.CMB.1.raw
  modified_base (179)..(181): a, c, t, g, unknown or other
  misc_feature (179)..(181): n is a, c, g, or t

SEQ ID NO: 259147 - DNA, 182 bp, Homo sapiens; identical to SEQ ID NO: 259038
  misc_feature: GYAE6OF02G8J3M.52.5.A05.1.454.CMB.1.raw
  modified_base (178)..(182): a, c, t, g, unknown or other
  misc_feature (178)..(182): n is a, c, g, or t

SEQ ID NO: 259148 - DNA, 178 bp, Homo sapiens; identical to SEQ ID NO: 258934
  misc_feature: GYAE6OF02F4VLD.52.5.A05.1.454.CMB.1.raw
  modified_base (178)..(178): a, c, t, g, unknown or other
  misc_feature (178)..(178): n is a, c, g, or t

SEQ ID NO: 259149 - DNA, 183 bp, Homo sapiens
  misc_feature: GYAE6OF02JXFAQ.52.5.A05.1.454.CMB.1.raw
  modified_base (175)..(183): a, c, t, g, unknown or other
  misc_feature (175)..(183): n is a, c, g, or t
tcagcgcagtacgacacgaccggtgctcgatttagatagatagacaggcacaaggccatcggtcttcccctggcaccctcctccaagacgcacctctggggcacagcggcctggctgcctggtccaaggactacttcctatacgatcgctgagcggctaggcaaggcgcattagnnnnnnnnn

SEQ ID NO: 259150 - DNA, 179 bp, Homo sapiens
  misc_feature: GYAE6OF02HCVKT.52.5.A05.1.454.CMB.1.raw
  modified_base (178)..(179): a, c, t, g, unknown or other
  misc_feature (178)..(179): n is a, c, g, or t
tcagcgcagtacgacacgaccggtgctcgatttagatagatagacagggcaccaagtgcccatcggtcttcccctggcaccctcctccaagagcacctctggggcacagcggccctgggctgcctggtcaaggactacttcctatacgatcgctgagcgggctggcaaggcgcatagnn

SEQ ID NO: 259151 - DNA, 180 bp, Homo sapiens; identical to SEQ ID NO: 258883
  misc_feature: GYAE6OF02HTXFG.52.5.A05.1.454.CMB.1.raw
  modified_base (178)..(180): a, c, t, g, unknown or other
  misc_feature (178)..(180): n is a, c, g, or t

SEQ ID NO: 259152 - DNA, 181 bp, Homo sapiens
  misc_feature: GYAE6OF02FUYFM.52.5.A05.1.454.CMB.1.raw
  modified_base (178)..(181): a, c, t, g, unknown or other
  misc_feature (178)..(181): n is a, c, g, or t
tcagcgcagtacgacacgaccggtgctcgatttagatagatagacagggcaccaagggcccatcggtcttcccctgtcaccctcctccaagagcacctctggggcacagcggccctgggctgcctggtcaaggactacttcctcgtagcactctgagcgggctggcaaggcgcatagnnnn

SEQ ID NO: 259153 - DNA, 179 bp, Homo sapiens
  misc_feature: GYAE6OF02IIKGV.52.5.A05.1.454.CMB.1.raw
  modified_base (179)..(179): a, c, t, g, unknown or other
  misc_feature (179)..(179): n is a, c, g, or t
tcagcgcagtacgacacgaccggtgctcgatttagatagatagacagggcaccaagggcccatcggtcttccccctggcaccctcctccaagagcacctctggggcacagcggccctgggctgcctggtcaaggactacttcctatacgatcgctgagcgggctggcaaggcgcatagn

SEQ ID NO: 259154 - DNA, 179 bp, Homo sapiens; identical to SEQ ID NO: 258888
  misc_feature: GYAE6OF02H01RQ.52.5.A05.1.454.CMB.1.raw
  modified_base (178)..(179): a, c, t, g, unknown or other
  misc_feature (178)..(179): n is a, c, g, or t

SEQ ID NO: 259155 - DNA, 178 bp, Homo sapiens
  misc_feature: GYAE6OF02I4BI0.52.5.A05.1.454.CMB.1.raw
  modified_base (177)..(178): a, c, t, g, unknown or other
  misc_feature (177)..(178): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctctactgcgctgagcgggctggcaaggcgcatagnn

SEQ ID NO: 259156 - DNA, 178 bp, Homo sapiens; identical to SEQ ID NO: 258897
  misc_feature: GYAE6OF02GNVT4.52.5.A05.1.454.CMB.1.raw
  modified_base (178)..(178): a, c, t, g, unknown or other
  misc_feature (178)..(178): n is a, c, g, or t

SEQ ID NO: 259157 - DNA, 179 bp, Homo sapiens; identical to SEQ ID NO: 258888
  misc_feature: GYAE6OF02GSUIX.52.5.A05.1.454.CMB.1.raw
  modified_base (178)..(179): a, c, t, g, unknown or other
  misc_feature (178)..(179): n is a, c, g, or t

SEQ ID NO: 259158 - DNA, 178 bp, Homo sapiens; identical to SEQ ID NO: 258897
  misc_feature: GYAE6OF02FWMXP.52.5.A05.1.454.CMB.1.raw
  modified_base (178)..(178): a, c, t, g, unknown or other
  misc_feature (178)..(178): n is a, c, g, or t

SEQ ID NO: 259159 - DNA, 179 bp, Homo sapiens; identical to SEQ ID NO: 258888
  misc_feature: GYAE6OF02G9PJL.52.5.A05.1.454.CMB.1.raw
  modified_base (178)..(179): a, c, t, g, unknown or other
  misc_feature (178)..(179): n is a, c, g, or t

SEQ ID NO: 259160 - DNA, 180 bp, Homo sapiens; identical to SEQ ID NO: 259138
  misc_feature: GYAE6OF02IC00G.52.5.A05.1.454.CMB.1.raw
  modified_base (179)..(180): a, c, t, g, unknown or other
  misc_feature (179)..(180): n is a, c, g, or t

SEQ ID NO: 259161 - DNA, 180 bp, Homo sapiens; identical to SEQ ID NO: 258894
  misc_feature: GYAE6OF02FQ29S.52.5.A05.1.454.CMB.1.raw
  modified_base (178)..(180): a, c, t, g, unknown or other
  misc_feature (178)..(180): n is a, c, g, or t

SEQ ID NO: 259162 - DNA, 180 bp, Homo sapiens; identical to SEQ ID NO: 258883
  misc_feature: GYAE6OF02IQB3H.52.5.A05.1.454.CMB.1.raw
  modified_base (178)..(180): a, c, t, g, unknown or other
  misc_feature (178)..(180): n is a, c, g, or t

SEQ ID NO: 259163 - DNA, 178 bp, Homo sapiens
  misc_feature: GYAE6OF02G2QHZ.52.5.A05.1.454.CMB.1.raw
  modified_base (177)..(178): a, c, t, g, unknown or other
  misc_feature (177)..(178): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttctatacgatcgctgagcgggctggcaaggcgcatagnn

SEQ ID NO: 259164 - DNA, 180 bp, Homo sapiens
  misc_feature: GYAE6OF02HWALX.52.5.A05.1.454.CMB.1.raw
  modified_base (177)..(180): a, c, t, g, unknown or other
  misc_feature (177)..(180): n is a, c, g, or t
tcagcgcagtacgacacgaccggtgctcgatttagatagatagacagggcaccaagggcccatcggtcttcccctggcaccctcctccaagagcacctctggggcacagcggcctgggctgcctggtcaaggactacttcctatacgatcgctgagcgggctggcaaggcgcatagnnnn

SEQ ID NO: 259165 - DNA, 190 bp, Homo sapiens; identical to SEQ ID NO: 258906
  misc_feature: GYAE6OF02HUXXS.52.5.A05.1.454.CMB.1.raw
  modified_base (179)..(190): a, c, t, g, unknown or other
  misc_feature (179)..(190): n is a, c, g, or t

SEQ ID NO: 259166 - DNA, 187 bp, Homo sapiens
  misc_feature: GYAE6OF02HJ42X.52.5.A05.1.454.CMB.1.raw
  modified_base (178)..(187): a, c, t, g, unknown or other
  misc_feature (178)..(187): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctatacgatcgctgagcgggctggcaaggcgcatagnnnnnnnnnn

SEQ ID NO: 259167 - DNA, 182 bp, Homo sapiens
  misc_feature: GYAE6OF02F0UCR.52.5.A05.1.454.CMB.1.raw
  modified_base (179)..(182): a, c, t, g, unknown or other
  misc_feature (179)..(182): n is a, c, g, or t
tcagcgcagtacgacacgaccggtgctcgatttagatagatagacagggcaccaagggcccatcggtcttccccctggcaccctcctccaagagcacctctggggcacagcggccctgggctgcctggtcaaggactacttcctatacgatcgctgagcgggctggcaaggcgcatagnnnn

SEQ ID NO: 259168 - DNA, 178 bp, Homo sapiens; identical to SEQ ID NO: 258897
  misc_feature: GYAE6OF02G1JWU.52.5.A05.1.454.CMB.1.raw
  modified_base (178)..(178): a, c, t, g, unknown or other
  misc_feature (178)..(178): n is a, c, g, or t

SEQ ID NO: 259169 - DNA, 184 bp, Homo sapiens
  misc_feature: GYAE6OF02JWAEE.52.5.A05.1.454.CMB.1.raw
  modified_base (177)..(184): a, c, t, g, unknown or other
  misc_feature (177)..(184): n is a, c, g, or t
tcagcgcagtacgacacgaccggtgctcgatttagatagatagacagggcaccaaggcccatcggtcttcccctggcaccctcctccaagagcacctctggggcacagcggccctgggctgcctggtcaaggactacttcctatacgatcgctgagcgggctggcaaggcgcatagnnnnnnnn

SEQ ID NO: 259170 - DNA, 180 bp, Homo sapiens
  misc_feature: GYAE6OF02IHGYC.52.5.A05.1.454.CMB.1.raw
  modified_base (178)..(180): a, c, t, g, unknown or other
  misc_feature (178)..(180): n is a, c, g, or t
tcagcgcagtacgacacgaccggtgctcgatttagatagatagacagggcaccaagggcccatcggtcttccccctggcaccctcctccaagagcacctctggggcacagcggccctgggctgcctggtcaaggctacttcctatacgatcgctgagcgggctggcaaggcgcatagnnn

SEQ ID NO: 259171 - DNA, 180 bp, Homo sapiens; identical to SEQ ID NO: 258883
  misc_feature: GYAE6OF02HPAQA.52.5.A05.1.454.CMB.1.raw
  modified_base (178)..(180): a, c, t, g, unknown or other
  misc_feature (178)..(180): n is a, c, g, or t

SEQ ID NO: 259172 - DNA, 179 bp, Homo sapiens; identical to SEQ ID NO: 258888
  misc_feature: GYAE6OF02FRU4Q.52.5.A05.1.454.CMB.1.raw
  modified_base (178)..(179): a, c, t, g, unknown or other
  misc_feature (178)..(179): n is a, c, g, or t

SEQ ID NO: 259173 - DNA, 182 bp, Homo sapiens
  misc_feature: GYAE6OF02HD09E.52.5.A05.1.454.CMB.1.raw
  modified_base (179)..(182): a, c, t, g, unknown or other
  misc_feature (179)..(182): n is a, c, g, or t
tcagcgcagtacgacacgaccggtgctcgatttagatagatagacagggcaccaagggcccatcggtcttcccctggcaccctcctccaagagcacctctgggggcacagcggccctgggctgcctggtcaaggactacttcctatacgatcgctgagcgggctggcaaggcgcatagnnnn

SEQ ID NO: 259174 - DNA, 180 bp, Homo sapiens
  misc_feature: GYAE6OF02I4EOD.52.5.A05.1.454.CMB.1.raw
  modified_base (180)..(180): a, c, t, g, unknown or other
  misc_feature (180)..(180): n is a, c, g, or t
tcagcgcagtacgacacgaccggtgctcgatttagatagatagacagggcaccaagggcccatcggtcttccccctggcaccctcctccaagagcacctctgggggcacagcggccctgggctgcctggtcaaggactacttcctatacgatcgctgagcgggctggcaaggcgcatagn

SEQ ID NO: 259175 - DNA, 209 bp, Homo sapiens
  misc_feature: GYAE6OF02I8LLV.52.5.A05.1.454.CMB.1.raw
  modified_base (178)..(184): a, c, t, g, unknown or other
  misc_feature (178)..(184): n is a, c, g, or t
  modified_base (186)..(209): a, c, t, g, unknown or other
  misc_feature (186)..(209): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctatacgatcgctgagcgggctggcaaggcgcatagnnnnnnngnnnnnnnnnnnnnnnnnnnnnnnn

SEQ ID NO: 259176 - DNA, 179 bp, Homo sapiens; identical to SEQ ID NO: 258888
  misc_feature: GYAE6OF02G06U5.52.5.A05.1.454.CMB.1.raw
  modified_base (178)..(179): a, c, t, g, unknown or other
  misc_feature (178)..(179): n is a, c, g, or t

SEQ ID NO: 259177 - DNA, 183 bp, Homo sapiens
  misc_feature: GYAE6OF02IJW00.52.5.A05.1.454.CMB.1.raw
  modified_base (179)..(183): a, c, t, g, unknown or other
  misc_feature (179)..(183): n is a, c, g, or t
tcagcgcagtacgacacgaccggtgctcgatttagatagatagacagggcaccaagggcccatcggtcttcccctggcaccctcctccaagagcacctctgggggcacagcggccctgggctgcctggtcaaggactacttcctatacgatcgctgagcgggctggcaaggcgcatagnnnnn

SEQ ID NO: 259178 - DNA, 200 bp, Homo sapiens
  misc_feature: GYAE6OF02HN9X8.52.5.A05.1.454.CMB.1.raw
  modified_base (184)..(200): a, c, t, g, unknown or other
  misc_feature (184)..(200): n is a, c, g, or t
tcagcgcagtacgacacgaccggtgctcgatttagatagatagacgagggcgacccaagggcccatcggtcttccccctggcaccctcctccaagagcacctctggggcacagcggccctgggcctggcctggtcaaggactacttcctcgtactgcgctgagcgggctggcaaggcgcatagnnnnnnnnnnnnnnnnn

SEQ ID NO: 259179 - DNA, 183 bp, Homo sapiens
  misc_feature: GYAE6OF02JRY4Z.52.5.A05.1.454.CMB.1.raw
  modified_base (177)..(183): a, c, t, g, unknown or other
  misc_feature (177)..(183): n is a, c, g, or t
tcagcgcagtacgacacgaccggtgctcgatttagatagatagacagggcaccaagggccatcggtcttcccctggcaccctcctccaagagcacctctggggcacagcggccctgggctgcctggtcaaggactacttcctatacgatcgctgagcgggctggcaaggcgcatagnnnnnnn

SEQ ID NO: 259180 - DNA, 181 bp, Homo sapiens; identical to SEQ ID NO: 258884
  misc_feature: GYAE6OF02I0TRT.52.5.A05.1.454.CMB.1.raw
  modified_base (178)..(181): a, c, t, g, unknown or other
  misc_feature (178)..(181): n is a, c, g, or t

SEQ ID NO: 259181 - DNA, 188 bp, Homo sapiens
  misc_feature: GYAE6OF02IL08Z.52.5.A05.1.454.CMB.1.raw
  modified_base (181)..(188): a, c, t, g, unknown or other
  misc_feature (181)..(188): n is a, c, g, or t
tcagcgcagtacgacacgaccggtgctcgatttagatagatagacagggcaccgaagggcccatcggtcttcccctggcaccctcctccaagagcacctctgggggcacagcggccctcgggctgcctggtcaaggactacttcctatacgatcgctgagcgggctggcaaggcgcatagnnnnnnnn

SEQ ID NO: 259182 - DNA, 179 bp, Homo sapiens
  misc_feature: GYAE6OF02IJCU1.52.5.A05.1.454.CMB.1.raw
  modified_base (179)..(179): a, c, t, g, unknown or other
  misc_feature (179)..(179): n is a, c, g, or t
tcagcgcagtacgacacgaccggtgctcgatttagatagatagacagggcaccaagggcccatcggtcttccccctggcaccctcctccaagagcacctctggggcacagcggccctgggctgcctggtcaaggactacttcctcgtactgcgctgagcgggctggcaaggcgcatagn

SEQ ID NO: 259183 - DNA, 180 bp, Homo sapiens; identical to SEQ ID NO: 258883
  misc_feature: GYAE6OF02F2W46.52.5.A05.1.454.CMB.1.raw
  modified_base (178)..(180): a, c, t, g, unknown or other
  misc_feature (178)..(180): n is a, c, g, or t

SEQ ID NO: 259184 - DNA, 195 bp, Homo sapiens
  misc_feature: GYAE6OF02H0GN0.52.5.A05.1.454.CMB.1.raw
  modified_base (180)..(195): a, c, t, g, unknown or other
  misc_feature (180)..(195): n is a, c, g, or t
tcagcgcagtacgacacgaccggtgctcgatttagatagatagacagggcaccaaggggcccatcggtcttcccctggcaccctcctccaagagcacctctgggggcacagcggccctgggctgcctggtcaaggactacttcctatacgatcgctgagcgggctggcaaggcgcatagnnnnnnnnnnnnnnnn

SEQ ID NO: 259185 - DNA, 178 bp, Homo sapiens; identical to SEQ ID NO: 258897
  misc_feature: GYAE6OF02G0BGF.52.5.A05.1.454.CMB.1.raw
  modified_base (178)..(178): a, c, t, g, unknown or other
  misc_feature (178)..(178): n is a, c, g, or t

SEQ ID NO: 259186 - DNA, 184 bp, Homo sapiens
  misc_feature: GYAE6OF02I4VTL.52.5.A05.1.454.CMB.1.raw
  modified_base (178)..(184): a, c, t, g, unknown or other
  misc_feature (178)..(184): n is a, c, g, or t
tcagcgcagtacgacacgaccggtgctcgatttagatagatagacagggcaccaagggcccatcggtcttcccctcggcaccctcctccaagagcacctctggggcacagcggcctgggctgcctggtcaaggactacttcctatacgatcgctgagcgggctggcaaggcgcatagnnnnnnn

SEQ ID NO: 259187 - DNA, 179 bp, Homo sapiens; identical to SEQ ID NO: 258888
  misc_feature: GYAE6OF02HHKWU.52.5.A05.1.454.CMB.1.raw
  modified_base (178)..(179): a, c, t, g, unknown or other
  misc_feature (178)..(179): n is a, c, g, or t

SEQ ID NO: 259188 - DNA, 179 bp, Homo sapiens; identical to SEQ ID NO: 258888
  misc_feature: GYAE6OF02F83GJ.52.5.A05.1.454.CMB.1.raw
  modified_base (178)..(179): a, c, t, g, unknown or other
  misc_feature (178)..(179): n is a, c, g, or t

SEQ ID NO: 259189 - DNA, 182 bp, Homo sapiens; identical to SEQ ID NO: 258931
  misc_feature: GYAE6OF02H127E.52.5.A05.1.454.CMB.1.raw
  modified_base (178)..(182): a, c, t, g, unknown or other
  misc_feature (178)..(182): n is a, c, g, or t

SEQ ID NO: 259190 - DNA, 232 bp, Homo sapiens
  misc_feature: GYAE6OF02H5MPV.52.5.A05.1.454.CMB.1.raw
  modified_base (157)..(157): a, c, t, g, unknown or other
  misc_feature (157)..(157): n is a, c, g, or t
  modified_base (177)..(177): a, c, t, g, unknown or other
  misc_feature (177)..(177): n is a, c, g, or t
  modified_base (183)..(183): a, c, t, g, unknown or other
  misc_feature (183)..(183): n is a, c, g, or t
  modified_base (185)..(232): a, c, t, g, unknown or other
  misc_feature (185)..(232): n is a, c, g, or t
tcagcgcagtacgacacgaccggtgctcgatttagatagatagacaggggcaccaagggcccatcggtcttcccctggcaccctcctccaagagcacctctgggggcaccagcggccctgggctgccgtggtcaaggctacttcctatacgatccgntgagcgggctgggcaaggcncatagncnnnnnnnnnnnnnnnnnnnnnnnnnnnnnnnnnnnnnnnnnnnnnnnn

SEQ ID NO: 259191 - DNA, 546 bp, Homo sapiens
  misc_feature: GYAE6OF02JZWAY.52.5.A05.1.454.CMB.1.raw
  modified_base (294)..(294): a, c, t, g, unknown or other
  misc_feature (294)..(294): n is a, c, g, or t
  modified_base (321)..(321): a, c, t, g, unknown or other
  misc_feature (321)..(321): n is a, c, g, or t
  modified_base (446)..(446): a, c, t, g, unknown or other
  misc_feature (446)..(446): n is a, c, g, or t
tcagcgcagtacgacacgaccggtgctcgatttagatagatagacaggggccgtgggccgtcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagagccaggccagtctcctgtctcctcatctataaagntgtcaagcggcctcgagggtactcccngagcgtattctcgtggctccaatttctaggaaatcgcacgtccactctgaaccatcgagcggacccagccctagtggatgacggtctgactattactggtcagggcgtgggactagttggtttgngttcgttttcgggacgggtaggtacccgaaggtcctacggtacccgttccgttaccggtacgacggtacccgtaaggccgttaccggccccccttacggg

SEQ ID NO: 259192 - DNA, 180 bp, Homo sapiens; identical to SEQ ID NO: 259138
  misc_feature: GYAE6OF02H5Y9A.52.5.A05.1.454.CMB.1.raw
  modified_base (179)..(180): a, c, t, g, unknown or other
  misc_feature (179)..(180): n is a, c, g, or t

SEQ ID NO: 259193 - DNA, 179 bp, Homo sapiens; identical to SEQ ID NO: 259153
  misc_feature: GYAE6OF02FJMM1.52.5.A05.1.454.CMB.1.raw
  modified_base (179)..(179): a, c, t, g, unknown or other
  misc_feature (179)..(179): n is a, c, g, or t

SEQ ID NO: 259194 - DNA, 560 bp, Homo sapiens
  misc_feature: GYAE6OF02IYQL3.52.5.A05.1.454.CMB.1.raw
  modified_base (306)..(306): a, c, t, g, unknown or other
  misc_feature (306)..(306): n is a, c, g, or t
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggcagtctcctgttctcctcatctataaagatgtcaagcgccctnagggatccctgagcgattctctcggctccgtaattccgtaggtaaactgcaagcccaacgtctgaccatccgaggtccgggacccagccctatgagtgaaggctagactagttactgttacagggcgtagggactaggttacggttgtggtcgtttcggacgggtagggacctaaggtccgtacggtacccgtccgttaaccggtaccgtacggaaccccgtaacgggtcctacccggtaccccgttacccggg

SEQ ID NO: 259195 - DNA, 226 bp, Homo sapiens
  misc_feature: GYAE6OF02HO43P.52.5.A05.1.454.CMB.1.raw
  modified_base (184)..(189): a, c, t, g, unknown or other
  misc_feature (184)..(189): n is a, c, g, or t
  modified_base (191)..(226): a, c, t, g, unknown or other
  misc_feature (191)..(226): n is a, c, g, or t
tcagcgcagtacgacacgaccggtgctcgatttagatagatagacagggtcgaccaagggcccatcggtcttccccctggcacccgtcctccaagagccacctctggggcacagcggccctgggctgccctggtcaaggactacttccatacgatcgcttgagcgggctggcaaggcgcatagnnnnnngnnnnnnnnnnnnnnnnnnnnnnnnnnnnnnnnnnnn

SEQ ID NO: 259196 - DNA, 182 bp, Homo sapiens
  misc_feature: GYAE6OF02IRLPR.52.5.A05.1.454.CMB.1.raw
  modified_base (179)..(182): a, c, t, g, unknown or other
  misc_feature (179)..(182): n is a, c, g, or t
tcagcgcagtacgacacgaccggtgctcgatttagatagatagacagggcaccaagggcccatcggtcttccccctggcaccctcctccaagagcacctctggggcacagcggccctgggctgcctggtcaaggactacttcctcgtactgcgctgagcgggctggcaaggcgcatagnnnn

SEQ ID NO: 259197 - DNA, 181 bp, Homo sapiens
  misc_feature: GYAE6OF02G7V2E.52.5.A05.1.454.CMB.1.raw
  modified_base (177)..(181): a, c, t, g, unknown or other
  misc_feature (177)..(181): n is a, c, g, or t
tcagcgcagtacgacacgaccggtgctcgatttagatagatagacagggcaccaagggcccatcggtcttcccctggcaccctcctccaagagcacctctggggcacagcggcctgggttgcctggtcaaggactacttcctatacgatcgctgagcgggctggcaaggcgcatagnnnnn

SEQ ID NO: 259198 - DNA, 208 bp, Homo sapiens
  misc_feature: GYAE6OF02GXXY2.52.5.A05.1.454.CMB.1.raw
  modified_base (182)..(208): a, c, t, g, unknown or other
  misc_feature (182)..(208): n is a, c, g, or t
tcagcgcagtacgacacgaccggtgctcgatttagatagatagacagggcgaccaagggcccatcggtcttccccctggcaccctcctccaagacgcacctctgggggcacagcggccctgggctgcctggtcaaggactacttcctatacgatcgctgagcgggctggcaaggcgcatagnnnnnnnnnnnnnnnnnnnnnnnnnnn

SEQ ID NO: 259199 - DNA, 185 bp, Homo sapiens
  misc_feature: GYAE6OF02ID4KC.52.5.A05.1.454.CMB.1.raw
  modified_base (179)..(185): a, c, t, g, unknown or other
  misc_feature (179)..(185): n is a, c, g, or t
tcagcgcagtacgacacgaccggtgctcgatttagatagatagacagggcaccaagggcccatcggtcttccccctggcaccctcctccaagagcacctctgggggcacagcggcctgggctgcctggtcaaggactacttcctatacgatcgctgagcgggctggcaaggcgcatagnnnnnnn

SEQ ID NO: 259200 - DNA, 211 bp, Homo sapiens
  misc_feature: GYAE6OF02FT7E9.52.5.A05.1.454.CMB.1.raw
  modified_base (181)..(211): a, c, t, g, unknown or other
  misc_feature (181)..(211): n is a, c, g, or t
tcagcgcagtacgacacgaccggtgctcgatttagatagatagacagggcaaccaagggcccatcggtcttccccctggcaccctcctccaagagcacctctggggcacagcggccctgggctgcctggtcaaggactacttcctatacgatcgctgagcgggctgggcaaggcgcatagnnnnnnnnnnnnnnnnnnnnnnnnnnnnnnn

SEQ ID NO: 259201 - DNA, 179 bp, Homo sapiens
  misc_feature: GYAE6OF02H9OSH.52.5.A05.1.454.CMB.1.raw
  modified_base (179)..(179): a, c, t, g, unknown or other
  misc_feature (179)..(179): n is a, c, g, or t
tcagcgcagtacgacacgaccggtgctcgatttagatagatagacagggcaccaagggcccatcggtcttcccctggcaccctcctccaagagcacctctgggggcacagcggccctgggctgcctggtcaaggactacttcctatacgatcgctgagcgggctggcaaggcgcatagn

SEQ ID NO: 259202 - DNA, 180 bp, Homo sapiens
  misc_feature: GYAE6OF02IP6BE.52.5.A05.1.454.CMB.1.raw
  modified_base (179)..(180): a, c, t, g, unknown or other
  misc_feature (179)..(180): n is a, c, g, or t
tcagcgcagtacgacacgaccggtgctcgatttagatagatagacagggcaccaagggcccatcggtcttccccctggcaccctcctccaagagcacctctggggcacagcggccctgggctgcctggtcaaggactacttcctatacgatcgctgagcgggctggcaaggcgcatagnn

SEQ ID NO: 259203 - DNA, 177 bp, Homo sapiens
  misc_feature: GYAE6OF02FUVKN.52.5.A05.1.454.CMB.1.raw
  modified_base (177)..(177): a, c, t, g, unknown or other
  misc_feature (177)..(177): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtaaggactacttcctatacgatcgctgagcgggctggcaaggcgcatagn

SEQ ID NO: 259204 - DNA, 180 bp, Homo sapiens; identical to SEQ ID NO: 259202
  misc_feature: GYAE6OF02GKCB0.52.5.A05.1.454.CMB.1.raw
  modified_base (179)..(180): a, c, t, g, unknown or other
  misc_feature (179)..(180): n is a, c, g, or t

SEQ ID NO: 259205 - DNA, 180 bp, Homo sapiens; identical to SEQ ID NO: 259202
  misc_feature: GYAE6OF02I5G6Y.52.5.A05.1.454.CMB.1.raw
  modified_base (179)..(180): a, c, t, g, unknown or other
  misc_feature (179)..(180): n is a, c, g, or t

SEQ ID NO: 259206 - DNA, 181 bp, Homo sapiens; identical to SEQ ID NO: 258884
  misc_feature: GYAE6OF02F2T1O.52.5.A05.1.454.CMB.1.raw
  modified_base (178)..(181): a, c, t, g, unknown or other
  misc_feature (178)..(181): n is a, c, g, or t

SEQ ID NO: 259207 - DNA, 179 bp, Homo sapiens
  misc_feature: GYAE6OF02FH75O.52.5.A05.1.454.CMB.1.raw
  modified_base (179)..(179): a, c, t, g, unknown or other
  misc_feature (179)..(179): n is a, c, g, or t
tcagcgcagtacgacacgaccggtgctcgatttagatagatagacagggcaccaagggcccatcggtcttcccctggcaccctcctccaagagcacctcgtggggcacagcggccctgggctgcctggtcaaggactacttcctcgtagcactctgagcgggctggcaaggcgcatagn

SEQ ID NO: 259208 - DNA, 181 bp, Homo sapiens
  misc_feature: GYAE6OF02G41I8.52.5.A05.1.454.CMB.1.raw
  modified_base (180)..(181): a, c, t, g, unknown or other
  misc_feature (180)..(181): n is a, c, g, or t
tcagcgcagtacgacacgaccggtgctcgatttagatagatagacagggcaccaagggcccatcggtcttccccctggcaccctcctccaagagcacctctgggggcacagcggccctgggctgcctggtcaaggactacttcctatacgatcgctgagcgggctggcaaggcgcatagnn

SEQ ID NO: 259209 - DNA, 180 bp, Homo sapiens; identical to SEQ ID NO: 259138
  misc_feature: GYAE6OF02IL2L9.52.5.A05.1.454.CMB.1.raw
  modified_base (179)..(180): a, c, t, g, unknown or other
  misc_feature (179)..(180): n is a, c, g, or t

SEQ ID NO: 259210 - DNA, 179 bp, Homo sapiens; identical to SEQ ID NO: 258888
  misc_feature: GYAE6OF02FOJIH.52.5.A05.1.454.CMB.1.raw
  modified_base (178)..(179): a, c, t, g, unknown or other
  misc_feature (178)..(179): n is a, c, g, or t

SEQ ID NO: 259211 - DNA, 180 bp, Homo sapiens
  misc_feature: GYAE6OF02HCGZV.52.5.A05.1.454.CMB.1.raw
  modified_base (179)..(180): a, c, t, g, unknown or other
  misc_feature (179)..(180): n is a, c, g, or t
tcagcgcagtacgacacgaccggtgctcgatttagatagatagacagggcaccaagggcccatcggtcttcccctggcaccctcctccaagagcacctctgggggcacagcggccctgggctgcctggtcaaggactacttcctcgtactgcgctgagcgggctggcaaggcgcatagnn

SEQ ID NO: 259212 - DNA, 179 bp, Homo sapiens
  misc_feature: GYAE6OF02HEFLP.52.5.A05.1.454.CMB.1.raw
  modified_base (177)..(179): a, c, t, g, unknown or other
  misc_feature (177)..(179): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtaaggactacttcctatacgatcgctgagcgggctggcaaggcgcatagnnn

SEQ ID NO: 259213 - DNA, 182 bp, Homo sapiens
  misc_feature: GYAE6OF02F3DD3.52.5.A05.1.454.CMB.1.raw
  modified_base (180)..(182): a, c, t, g, unknown or other
  misc_feature (180)..(182): n is a, c, g, or t
tcagcgcagtacgacacgaccggtgctcgatttagatagatagacagggcaccaagggcccatcggtcttccccctggcaccctcctccaagagcacctctgggggcacagcggccctgggctgcctggtcaaggactacttcctatacgatcgctgagcgggctggcaaggcgcatagnnn

SEQ ID NO: 259214 - DNA, 180 bp, Homo sapiens; identical to SEQ ID NO: 259138
  misc_feature: GYAE6OF02F6ORS.52.5.A05.1.454.CMB.1.raw
  modified_base (179)..(180): a, c, t, g, unknown or other
  misc_feature (179)..(180): n is a, c, g, or t

SEQ ID NO: 259215 - DNA, 182 bp, Homo sapiens
  misc_feature: GYAE6OF02GXATV.52.5.A05.1.454.CMB.1.raw
  modified_base (180)..(182): a, c, t, g, unknown or other
  misc_feature (180)..(182): n is a, c, g, or t
tcagcgcagtacgacacgaccggtgctcgatttagatagatagacagggcaccaagggcccatcggtcttccccctggcaccctcctccaagagcacctctgggggcacagcggccctgggctgcctggtcaaggactacttcctcgtactgcgctgagcgggctggcaaggcgcatagnnn

SEQ ID NO: 259216 - DNA, 180 bp, Homo sapiens; identical to SEQ ID NO: 258883
  misc_feature: GYAE6OF02FVJCQ.52.5.A05.1.454.CMB.1.raw
  modified_base (178)..(180): a, c, t, g, unknown or other
  misc_feature (178)..(180): n is a, c, g, or t

SEQ ID NO: 259217 - DNA, 179 bp, Homo sapiens; identical to SEQ ID NO: 259153
  misc_feature: GYAE6OF02FJ8XQ.52.5.A05.1.454.CMB.1.raw
  modified_base (179)..(179): a, c, t, g, unknown or other
  misc_feature (179)..(179): n is a, c, g, or t

SEQ ID NO: 259218 - DNA, 499 bp, Homo sapiens
  misc_feature: GYAE6OF02FND4B.52.5.A05.1.454.CMB.1.raw
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcggccctcagggatccctgagcgattctctggctccaattctggaaatgcagccactctgaccatcagcggacccagcctagtggatgaggctagactattactgtacaggcgtggactagtaggtttgtgtcgtttcggcggaggaccgaagcctgacccgttctacgtcgacgcccgaaggcctacgccccgtccgg

SEQ ID NO: 259219 - DNA, 188 bp, Homo sapiens
  misc_feature: GYAE6OF02GN2YS.52.5.A05.1.454.CMB.1.raw
  modified_base (180)..(188): a, c, t, g, unknown or other
  misc_feature (180)..(188): n is a, c, g, or t
tcagcgcagtacgacacgaccggtgctcgatttagatagatagacagggcaccaagggcccatcggtcttccccctggcaccctcctccaagagcacctctgggggcacagcggccctgggctgcctggtcaaggactacttcctcgtagcactctgagcgggctggcaaggcgcatagnnnnnnnnn

SEQ ID NO: 259220 - DNA, 179 bp, Homo sapiens
  misc_feature: GYAE6OF02FTTG1.52.5.A05.1.454.CMB.1.raw
  modified_base (179)..(179): a, c, t, g, unknown or other
  misc_feature (179)..(179): n is a, c, g, or t
tcagcgcagtacgacacgaccggtgctcgatttagatagatagacagggcaccaagggcccatcggtcttccccctggcaccctcctccaagagcacctctgggggcacagcggccctgggctgcctggtcaaggactacttcctatacatcgctgagcgggctggcaaggcgcatagn

SEQ ID NO: 259221 - DNA, 206 bp, Homo sapiens
  misc_feature: GYAE6OF02FHLQU.52.5.A05.1.454.CMB.1.raw
  modified_base (177)..(206): a, c, t, g, unknown or other
  misc_feature (177)..(206): n is a, c, g, or t
tcagcgcagtacgacacgaccggtgctcgatttagatagatagacagggcgaccaagggcccatcggtcttcccctggcaccctcctccaagagcacctctggggcacagcggccctgggctgcctggtcaaggctactcctatacgatcgctgagcgggctggcaaggcgcatagnnnnnnnnnnnnnnnnnnnnnnnnnnnnnn

SEQ ID NO: 259222 - DNA, 562 bp, Homo sapiens
  misc_feature: GYAE6OF02ITDCG.52.5.A05.1.454.CMB.1.raw
  modified_base (298)..(298): a, c, t, g, unknown or other
  misc_feature (298)..(298): n is a, c, g, or t
  modified_base (444)..(444): a, c, t, g, unknown or other
  misc_feature (444)..(444): n is a, c, g, or t
tcagcgcagtacgacacgaccggtgctcgatttagatagatagacagggggcctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgagttggggatatacattgtttcctggtatcagcagaacgccaggccagtctcctgttctcctcatctaataaagntgtacaagcggcctcgagggactccctgagcgattcctctcggcctaccaatttcgtaggtaaatcgacacgtacccacctctcgaaccactcgaacggccgggacccagaccctagtggatggacggctagacttatactgtacngggcgtagggacgtaggttaggttgtggtcgtttcggcgggtacgggaccgaggtaccgtacggtacccgttccgtacgtaccgacggacccgaaggcccgtaccgcccccttaccgg

SEQ ID NO: 259223 - DNA, 181 bp, Homo sapiens
  misc_feature: GYAE6OF02HS8Y0.52.5.A05.1.454.CMB.1.raw
  modified_base (179)..(181): a, c, t, g, unknown or other
  misc_feature (179)..(181): n is a, c, g, or t
tcagcgcagtacgacacgaccggtgctcgatttagatagatagacagggcaccaagggcccatcggtcttcccctggcaccctcctccaagagcacctctgggggcacagcggccctgggctgcctggtcaaggactacttcctatacgatcgctgagcgggctggcaaggcgcatagnnn

SEQ ID NO: 259224 - DNA, 182 bp, Homo sapiens; identical to SEQ ID NO: 259167
  misc_feature: GYAE6OF02GP6UX.52.5.A05.1.454.CMB.1.raw
  modified_base (179)..(182): a, c, t, g, unknown or other
  misc_feature (179)..(182): n is a, c, g, or t

SEQ ID NO: 259225 - DNA, 181 bp, Homo sapiens; identical to SEQ ID NO: 259223
  misc_feature: GYAE6OF02FG16Y.52.5.A05.1.454.CMB.1.raw
  modified_base (179)..(181): a, c, t, g, unknown or other
  misc_feature (179)..(181): n is a, c, g, or t

SEQ ID NO: 259226 - DNA, 183 bp, Homo sapiens
  misc_feature: GYAE6OF02I00Y7.52.5.A05.1.454.CMB.1.raw
  modified_base (174)..(183): a, c, t, g, unknown or other
  misc_feature (174)..(183): n is a, c, g, or t
tcagcgcagtacgacacgaccggtgctcgatttagatagatagacagggcaccaagggcccatcggtcttcccctggcaccctcctccaagagcacctctggggcacagcggcctggctgcctggtcaaggactacttcctcgtactgcgctgagcggctggcaagtcgcatgnnnnnnnnnn

SEQ ID NO: 259227 - DNA, 557 bp, Homo sapiens
  misc_feature: GYAE6OF02IKBVN.52.5.A05.1.454.CMB.1.raw
tcagcgcagtacgacacgaccggtgctcgatttagatagatagacagggggcctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattggggatatacatgttcctggtatcagcagaagccaggccagtctcctgttctcctcatctataagatgtcaagcggccctacgagggtactcccgtgacgcgtacttcctcgtggcctcctaaatttcgtaggaaatcgcacgccctactctagaccctactcgacggccgggacccagccctagtggatggaggctgtacttattactgtcgaggtcgtagggacgtaggttaggttgtcgtcgtttccgggacgggacgggtaccgaaggtcgtacggtaccgttaccgtacgtacgacggacccgacggtccgtccgaccccgtccgg

SEQ ID NO: 259228 - DNA, 596 bp, Homo sapiens
  misc_feature: GYAE6OF02JFGZV.52.5.A05.1.454.CMB.1.raw
tcagcgcagtacgacacgaccggtgctcgatttagatagatagacagggggcctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgagttgggggatatacattgtttcctggtatcagcagaagccaggccagtctcctgttctcctcatctaataaagatgtcaagccggccctcgagggactcccgtgacgcgtacttcctcgtcggtcctacctaatttccgtaggaaactgacacgccactctcgacctatcgacggccggacccacgcctagtggatgacggtctagtacttattacgtgtacgacgggtcggtgggacgtaggttaggtttggttcggttcggtttccgggacgggtacgggaccgtaacggtccgtacggtacccggttaccgttaccggtccgaccggtaccccgtaacggcccgttacccggtccccccgttacccggg

SEQ ID NO: 259229 - DNA, 222 bp, Homo sapiens
  misc_feature: GYAE6OF02GMK9K.52.5.A05.1.454.CMB.1.raw
  modified_base (182)..(190): a, c, t, g, unknown or other
  misc_feature (182)..(190): n is a, c, g, or t
  modified_base (192)..(222): a, c, t, g, unknown or other
  misc_feature (192)..(222): n is a, c, g, or t
tcagcgcagtacgacacgaccggtgctcgatttagatagatagacagggcgaccaagggcccatcggtcttccccctggcaccctcctccaagagcacctctgggggcacagcggccctgggctgcctggtcaaggactacttccgtatacgatcgctgagcgggctggcaaggcgcatagnnnnnnnnngnnnnnnnnnnnnnnnnnnnnnnnnnnnnnnn

SEQ ID NO: 259230 - DNA, 182 bp, Homo sapiens; identical to SEQ ID NO: 259038
  misc_feature: GYAE6OF02HHP43.52.5.A05.1.454.CMB.1.raw
  modified_base (178)..(182): a, c, t, g, unknown or other
  misc_feature (178)..(182): n is a, c, g, or t

SEQ ID NO: 259231 - DNA, 183 bp, Homo sapiens
  misc_feature: GYAE6OF02FS1W0.52.5.A05.1.454.CMB.1.raw
  modified_base (180)..(183): a, c, t, g, unknown or other
  misc_feature (180)..(183): n is a, c, g, or t
tcagcgcagtacgacacgaccggtgctcgatttagatagatagacagggcaccaagggcccatcggtcttccccctggcaccctcctccaagagcacctctgggggcacagcggccctgggctgcctggtcaaggactacttcctatacgatcgctgagcgggctggcaaggcgcatagnnnn

SEQ ID NO: 259232 - DNA, 564 bp, Homo sapiens
  misc_feature: GYAE6OF02I1VBW.52.5.A05.1.454.CMB.1.raw
tcagcgcagtacgacacgaccggtgctcgatttagatagatagacagggggcctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattggggatatacatgtttcctggtatcagcagaagccaggccagtctcctgttcctcctcatctataaagatgtacaacgccggccctacgagggtactccccgtgacgcgtattcctcgtcggcttacctaaatttcgtaggaaatcgacacgcctactcctgaaccatcgacggccggacccaggtccctagtcggatggacggctgtactagttactgtcgaggtcgtgggacgtaggttaggttgttcgttcgtttcgggacgggtacgggaccgtaaggtcgtacggaccgttccgtacgtccgacgaccgtaggcctacccgccccgttaccgg

SEQ ID NO: 259233 - DNA, 216 bp, Homo sapiens
  misc_feature: GYAE6OF02I76UH.52.5.A05.1.454.CMB.1.raw
  modified_base (176)..(176): a, c, t, g, unknown or other
  misc_feature (176)..(176): n is a, c, g, or t
  modified_base (182)..(182): a, c, t, g, unknown or other
  misc_feature (182)..(182): n is a, c, g, or t
  modified_base (184)..(216): a, c, t, g, unknown or other
  misc_feature (184)..(216): n is a, c, g, or t
tcagcgcagtacgacacgaccggtgctcgatttagatagatagacaggggccaccgaagggcccatcggtcttcccctggcaccctcctccaagagcacctctgggggcactagcggccctgggctgcctggtcaaggctacttccatacgatccgctgagcgggctggcaaggcncatagngnnnnnnnnnnnnnnnnnnnnnnnnnnnnnnnnn

SEQ ID NO: 259234 - DNA, 139 bp, Homo sapiens
  misc_feature: GYAE6OF02I84BD.52.5.A05.1.454.CMB.1.raw
tcagcgcagtacgacacgaccggtgctcgatttagatagatagacagggcaccaagggcccatcggtcttccccctggcaccctcctccaagagcacctctggggcacagcggccctgggctgcctggtcaaggactac

SEQ ID NO: 259235 - DNA, 183 bp, Homo sapiens; identical to SEQ ID NO: 259231
  misc_feature: GYAE6OF02FJCI3.52.5.A05.1.454.CMB.1.raw
  modified_base (180)..(183): a, c, t, g, unknown or other
  misc_feature (180)..(183): n is a, c, g, or t

SEQ ID NO: 259236 - DNA, 181 bp, Homo sapiens; identical to SEQ ID NO: 259208
  misc_feature: GYAE6OF02I9WTW.52.5.A05.1.454.CMB.1.raw
  modified_base (180)..(181): a, c, t, g, unknown or other
  misc_feature (180)..(181): n is a, c, g, or t

SEQ ID NO: 259237 - DNA, 562 bp, Homo sapiens
  misc_feature: GYAE6OF02F8MDM.52.5.A05.1.454.CMB.1.raw
tcagcgcagtacgacacgaccggtgctcgatttagatagatagacagggggcctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacattgtttcctggtatcagcagaagccaggccagtctcctgttctcctcatctataaagatgtcaagcggccctcgagggactccctagacgcgattcctcgtggctccaaatttctaggaaatgcacgccactctcgacactcgagccggacccagcctagtggtatggacggctagtactattactgtacgaggtcggtgggtacgtaggttaggttgtcgtcgttttcgggacggtacgggtaccgtaaggccgtacggtacccgttaccgttacggtccgtacggtacccgaacggtcccgtaccgtcccccgttacccggg

SEQ ID NO: 259238 - DNA, 661 bp, Homo sapiens
  misc_feature: GYAE6OF02I66MJ.52.5.A05.1.454.CMB.1.raw
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgagttggggatatacattgttcctggtatcagcagaacgccaggcagtctctgttctctcatactataaagatgtacaacgcggcctcgagggactcccgtgacgacgtaacttccgacttcgggacttacctaagttacctaagggtaaacttggacctaacggcccttaacctaccgttaccgaacctaagtaccgaacgggcccgggtaacccgacgtacccgtacgttacgggaagtacgggacgtaccgtacgtaacttacgttaaacgtcgtacgacgggtacggtacggtaaccgttaggttaaggtttcggttacggttacggttttacgggacgggtacgggtaacgttaacggaaccgttaccgggtaacccgttaccgttaccggttacaccggtacccgaacggtccgtacccgtacccccgttaccgg

SEQ ID NO: 259239 - DNA, 620 bp, Homo sapiens
  misc_feature: GYAE6OF02IWOMO.52.5.A05.1.454.CMB.1.raw
  modified_base (474)..(474): a, c, t, g, unknown or other
  misc_feature (474)..(474): n is a, c, g, or t
tcagcgcagtacgacacgaccggtgctcgatttagatagatagacagggggcctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattggggatatacattgtttcctggttatcagcagaagccaggccagtctcctcgttctcctctatctaataaagatgtacaacggccgtccgtacgagggactcccgtgacgtcgtattctcgtcggtcttacctaactttcgtacggtaaatcgaccacgtcctaacctccgtacgacctatacgacggccgggacccacgtcctagtcggatcggagtctacgtacttagttacgtcgtacggacggnggttacgggacgttacggtttagggtttggttcggttacggtttccgggaccggggtaagggtacccgtaaggtccgttacggtaacccggttccgtaacggttccgaccggtaaccccgagggtccctacccggtcccctcccgg

SEQ ID NO: 259240 - DNA, 186 bp, Homo sapiens
  misc_feature: GYAE6OF02HC1JJ.52.5.A05.1.454.CMB.1.raw
  modified_base (179)..(186): a, c, t, g, unknown or other
  misc_feature (179)..(186): n is a, c, g, or t
tcagcgcagtacgacacgaccggtgctcgatttagatagatagacaggccaccaagggcccatcggtcttccccctggcaccctcctccaagagcacctctggggcacagcggccctgggctgcctggtcaaggactacttcctcgtactgcgctgagcgggctggcaaggcgcatagnnnnnnnn

SEQ ID NO: 259241 - DNA, 182 bp, Homo sapiens; identical to SEQ ID NO: 259167
  misc_feature: GYAE6OF02HNETB.52.5.A05.1.454.CMB.1.raw
  modified_base (179)..(182): a, c, t, g, unknown or other
  misc_feature (179)..(182): n is a, c, g, or t

SEQ ID NO: 259242 - DNA, 180 bp, Homo sapiens
  misc_feature: GYAE6OF02H4B2G.52.5.A05.1.454.CMB.1.raw
  modified_base (177)..(180): a, c, t, g, unknown or other
  misc_feature (177)..(180): n is a, c, g, or t
tcagcgcagtacgacacgaccggtgctcgatttagatagatagacaggcaccaaggcccatcggtcttcccctggcaccctcctccaagagcacctctgggggcacagcggccctgggctgcctggtcaaggactacttcctatacgatcgctgagcgggctggcaaggcgcatagnnnn

SEQ ID NO: 259243 - DNA, 182 bp, Homo sapiens; identical to SEQ ID NO: 259213
  misc_feature: GYAE6OF02GB8DC.52.5.A05.1.454.CMB.1.raw
  modified_base (180)..(182): a, c, t, g, unknown or other
  misc_feature (180)..(182): n is a, c, g, or t

SEQ ID NO: 259244 - DNA, 185 bp, Homo sapiens
  misc_feature: GYAE6OF02HP7I0.52.5.A05.1.454.CMB.1.raw
  modified_base (180)..(185): a, c, t, g, unknown or other
  misc_feature (180)..(185): n is a, c, g, or t
tcagcgcagtacgacacgaccggtgctcgatttagatagatagacagggcaccaagggcccatcggtcttccccctggcaccctcctccaagagcacctctgggggcacagcggccctgggctgcctggtcaaggactacttcctatacgatcgctgagcgggctggcaaggcgcatagnnnnnn

SEQ ID NO: 259245 - DNA, 181 bp, Homo sapiens; identical to SEQ ID NO: 259208
  misc_feature: GYAE6OF02F56HN.52.5.A05.1.454.CMB.1.raw
  modified_base (180)..(181): a, c, t, g, unknown or other
  misc_feature (180)..(181): n is a, c, g, or t

SEQ ID NO: 259246 - DNA, 179 bp, Homo sapiens; identical to SEQ ID NO: 258888
  misc_feature: GYAE6OF02FNYHK.52.5.A05.1.454.CMB.1.raw
  modified_base (178)..(179): a, c, t, g, unknown or other
  misc_feature (178)..(179): n is a, c, g, or t

SEQ ID NO: 259247 - DNA, 121 bp, Homo sapiens
  misc_feature: GYAE6OF02IQIP3.52.5.A05.1.454.CMB.1.raw
  modified_base (120)..(121): a, c, t, g, unknown or other
  misc_feature (120)..(121): n is a, c, g, or t
tcagcgcagtacgacacgaccggtgctcgatttagatagatagacagggcaccaagggcccatcggtcttcccctggcaccctcctccaagagcacctcgtgggggcacagcggcccgtnn

SEQ ID NO: 259248 - DNA, 640 bp, Homo sapiens
  misc_feature: GYAE6OF02IUD2U.52.5.A05.1.454.CMB.1.raw
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgagttgggggatatacatgtttcctggtatcagcagagccagcagtctcctgttctcctcatctaataaagatgtacacgcggccctacgagggactccctgacgcgtacttcctcgtcggctacctaacttcgtaggaaatcgaccgacgaccacctccgtacgaccacgtccgaacggaccgggaaccccacgtccctaaggtcggtaacgtaggacgggtcttacggtacttacgttcgttcggtacgtagggtacggtagggtaccggtaagggttttacgggtttcggttcggtttccgggttttacggggaccggggtaacggggtacccgtaacggtccgtaccgggtaaccccgttcccgtaacggttccaccgggtaccccacgggtccctacccggtccccgttacccgg

SEQ ID NO: 259249 - DNA, 182 bp, Homo sapiens
  misc_feature: GYAE6OF02HW296.52.5.A05.1.454.CMB.1.raw
  modified_base (178)..(182): a, c, t, g, unknown or other
  misc_feature (178)..(182): n is a, c, g, or t
tcagcgcagtacgacacgaccggtgctcgatttagatagatagacagggcaccaagggcccatcggtcttcccctggcaccctcctccaagagcacctctgggggcacagcggcctgggctgcctggtcaaggactacttcctatacgatcgctgagcgggctggcaaggcgcatagnnnnn

SEQ ID NO: 259250 - DNA, 185 bp, Homo sapiens
  misc_feature: GYAE6OF02H2U5Z.52.5.A05.1.454.CMB.1.raw
  modified_base (181)..(185): a, c, t, g, unknown or other
  misc_feature (181)..(185): n is a, c, g, or t
tcagcgcagtacgacacgaccggtgctcgatttagatagatagacagggcaccaagggcccgatcggtcttccccctggcaccctcctccaagagcacctctgggggcacagcggccctgggctgcctggtcaaggactacttcctatacgatcgctgagcgggctggcaaggcgcatagnnnnn

SEQ ID NO: 259251 - DNA, 628 bp, Homo sapiens
  misc_feature: GYAE6OF02ILK0K.52.5.A05.1.454.CMB.1.raw
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcactgctctggacatcgattggggatatacatgttcctgtatcagcagaagcagccagtctcctgttctcctcatctataaagatgtcaagccgcctcgagggactcctgagactattctcgtcggcctaccgtaattcgtaggaaattcgacgacgtcccaacgttcctacggaacccaagttaccgaggacccgggaacccgacgtaccgtacgtagggtacgtcggtacggtcgttacgacttaagtttactacggttacgacgggtacggtacggtaacgttacggtttacgggtttagttcggttaccggtttttaccggggacgggtaacgggtaccgtaaggtccgtaccggtaccggttaccgtaaccggtccgtacgtaccccggaacgggtcccttcccggccccgttacccggg

SEQ ID NO: 259252 - DNA, 183 bp, Homo sapiens; identical to SEQ ID NO: 259069
  misc_feature: GYAE6OF02FLA10.52.5.A05.1.454.CMB.1.raw
  modified_base (179)..(183): a, c, t, g, unknown or other
  misc_feature (179)..(183): n is a, c, g, or t

SEQ ID NO: 259253 - DNA, 498 bp, Homo sapiens
  misc_feature: GYAE6OF02GJC7V.52.5.A05.1.454.CMB.1.raw
  modified_base (343)..(343): a, c, t, g, unknown or other
  misc_feature (343)..(343): n is a, c, g, or t
  modified_base (374)..(374): a, c, t, g, unknown or other
  misc_feature (374)..(374): n is a, c, g, or t
  modified_base (380)..(380): a, c, t, g, unknown or other
  misc_feature (380)..(380): n is a, c, g, or t
  modified_base (424)..(424): a, c, t, g, unknown or other
  misc_feature (424)..(424): n is a, c, g, or t
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattggggatatacatgtttcctggtatcagcagaagccaggccagtctcctgttctcctcatctataaagatgtcaagcggccctcagggactccctgagcgattctctggctccaatttcnggaatgcagccatctgacatcagcggacccngcctancggatgagctagctatactgactaggcgtggatagtaggtttgngtcgtttgggcggtagggaccgaaggtctcggaccgtcctacgtcacggaccgaggtcctcggccccttaccgg

SEQ ID NO: 259254 - DNA, 183 bp, Homo sapiens; identical to SEQ ID NO: 259069
  misc_feature: GYAE6OF02F1BC1.52.5.A05.1.454.CMB.1.raw
  modified_base (179)..(183): a, c, t, g, unknown or other
  misc_feature (179)..(183): n is a, c, g, or t

SEQ ID NO: 259255 - DNA, 193 bp, Homo sapiens
  misc_feature: GYAE6OF02FIEO5.52.5.A05.1.454.CMB.1.raw
  modified_base (178)..(193): a, c, t, g, unknown or other
  misc_feature (178)..(193): n is a, c, g, or t
tcagcgcagtacgacacgaccggtgctcgatttagatagatagacagggcaccaagggcccatcggtcttccccctggcaccctcctccaagagcacctctggggcacagcggccctgggctgcctggtcaaggactactcctatacgatcgctgagcgggctggcaaggcgcatagnnnnnnnnnnnnnnnn

SEQ ID NO: 259256 - DNA, 671 bp, Homo sapiens
  misc_feature: GYAE6OF02IURE9.52.5.A05.1.454.CMB.1.raw
tcagcgcagtacgacacgaccggtgctcgatttagatagatagacagggggcctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgagttggggatatacattgtttcctggtactcgagcagaacgccgaggccacgtctcctgttcctcctctatactaataaagtatgtacgaacgccggtccctacggacggacctccgtagacgcgtacttctacgtcggtcctacctaagttacgtaggtaaactgacctaacgtccctacttccgtacgtaaccctagtaccggaccggtacccgggaacccgacgtacccgtaggtacggaacgttacggacggtacgttacgtaaccttattacgtcggtacggtacgggtacgggtacgggtaacgttacgggtttacgggtttcggttacggttccggttttccgggacgggtaaccggtaccgtaacggtaccggttacggtacccgttaccgtaccgtaccgaccggtacccgaccggtcccgtcccggtccccgtaccgg

SEQ ID NO: 259257 - DNA, 201 bp, Homo sapiens
  misc_feature: GYAE6OF02HM2W8.52.5.A05.1.454.CMB.1.raw
  modified_base (181)..(201): a, c, t, g, unknown or other
  misc_feature (181)..(201): n is a, c, g, or t
tcagcgcagtacgacacgaccggtgctcgatttagatagatagacagggcaccaagggcccatcggtcttcccctggcaccctcctccaagagcacctcgtgggggcacagcggccctgggctgcctggtcaaggactacttcctataccgatcgctgagcgggctggcaaggcgcatagnnnnnnnnnnnnnnnnnnnnn

SEQ ID NO: 259258 - DNA, 209 bp, Homo sapiens
  misc_feature: GYAE6OF02GQ5LI.52.5.A05.1.454.CMB.1.raw
  modified_base (179)..(209): a, c, t, g, unknown or other
  misc_feature (179)..(209): n is a, c, g, or t
tcagcgcagtacgacacgaccggtgctcgatttagatagatagacagggcaccaagggcccatcggtcttccccctggcaccctcctccaagagcacctctggggcacagcggccctgggctgcctggtcaaggactacttcctatacgatcgctgagcgggctggcaaggcgcatagnnnnnnnnnnnnnnnnnnnnnnnnnnnnnnn

SEQ ID NO: 259259 - DNA, 185 bp, Homo sapiens; identical to SEQ ID NO: 259244
  misc_feature: GYAE6OF02GZPCE.52.5.A05.1.454.CMB.1.raw
  modified_base (180)..(185): a, c, t, g, unknown or other
  misc_feature (180)..(185): n is a, c, g, or t

SEQ ID NO: 259260 - DNA, 185 bp, Homo sapiens; identical to SEQ ID NO: 259244
  misc_feature: GYAE6OF02G99EK.52.5.A05.1.454.CMB.1.raw
  modified_base (180)..(185): a, c, t, g, unknown or other
  misc_feature (180)..(185): n is a, c, g, or t

SEQ ID NO: 259261 - DNA, 180 bp, Homo sapiens; identical to SEQ ID NO: 259174
  misc_feature: GYAE6OF02FMYT2.52.5.A05.1.454.CMB.1.raw
  modified_base (180)..(180): a, c, t, g, unknown or other
  misc_feature (180)..(180): n is a, c, g, or t

SEQ ID NO: 259262 - DNA, 563 bp, Homo sapiens
  misc_feature: GYAE6OF02GIDGC.52.5.A05.1.454.CMB.1.raw
  modified_base (187)..(187): a, c, t, g, unknown or other
  misc_feature (187)..(187): n is a, c, g, or t
  modified_base (189)..(189): a, c, t, g, unknown or other
  misc_feature (189)..(189): n is a, c, g, or t
  modified_base (191)..(191): a, c, t, g, unknown or other
  misc_feature (191)..(191): n is a, c, g, or t
  modified_base (193)..(194): a, c, t, g, unknown or other
  misc_feature (193)..(194): n is a, c, g, or t
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
  modified_base (214)..(215): a, c, t, g, unknown or other
  misc_feature (214)..(215): n is a, c, g, or t
  modified_base (225)..(225): a, c, t, g, unknown or other
  misc_feature (225)..(225): n is a, c, g, or t
  modified_base (227)..(227): a, c, t, g, unknown or other
  misc_feature (227)..(227): n is a, c, g, or t
  modified_base (231)..(231): a, c, t, g, unknown or other
  misc_feature (231)..(231): n is a, c, g, or t
  modified_base (237)..(237): a, c, t, g, unknown or other
  misc_feature (237)..(237): n is a, c, g, or t
  modified_base (240)..(240): a, c, t, g, unknown or other
  misc_feature (240)..(240): n is a, c, g, or t
  modified_base (242)..(242): a, c, t, g, unknown or other
  misc_feature (242)..(242): n is a, c, g, or t
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (278)..(278): a, c, t, g, unknown or other
  misc_feature (278)..(278): n is a, c, g, or t
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
  modified_base (301)..(301): a, c, t, g, unknown or other
  misc_feature (301)..(301): n is a, c, g, or t
tcagcgcagtacgacacgaccggtgctcgatttagatagatagacagggcgaccaagggcccatcggtcttccccctggcacccgtcctccaagagcaacctctggggcacagcggccctgggctgcctggtcaaggactacttccatacgaagtccgctgagcgggctggcaaggcgcgactagcngnancnncncgctncgnctgcngcncnncgcgctcgcncngacngctgtngcnangcgntcgagcngcctnacgtgtcngtacnctcgatncgacgngtacnccgtngacttcnctaccgagaccgtcgactcaacgcttaccgatgccgagtccaacgtcagtactccgacgtcgactcggacgtcgtcaccggtccacgcgtaccgcgttacacggttccagaaccggtcggtcctacgggtactccggtaactccgttagaacctacgggttcaaccggttcgaaccttcggtacccgtaaccgggaaccttcggaccttacgttaacccggacggttaccggtacggtaccgtaccggtaccgtacgtaccg

SEQ ID NO: 259263 - DNA, 705 bp, Homo sapiens
  misc_feature: GYAE6OF02GKHDI.52.5.A05.1.454.CMB.1.raw
  modified_base (288)..(288): a, c, t, g, unknown or other
  misc_feature (288)..(288): n is a, c, g, or t
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattggggatatacatgtttcctggtatcagcagagcagcagtctcctgttctcctcatctataaagntgtcaagcggccctacgacgggtactccccgtgacggcgtatttctcgtcggccttacctaaatttccgtaggtaaaattcgacctaacgaccctaccttccgtacggaccctaacgtaccgaacggacccggggtaccccaacggtacccttaacggtacgggtaacgttacgggtaaacgggtccgttaacggtaaccgtttaacgtttaacgttacgggttaccgtaacggggtccgggttacgggggtaacgttaaccgggtttaaggggttttcggttacggtttccgggtttttaccggggaccgggttacgggtaaccggtaaacggtccgttaccgggtacccggttacccgttaccggtaccgtacggtaccccgtacggtaccgttccccggcccccgtttacccgg

SEQ ID NO: 259264 - DNA, 179 bp, Homo sapiens
  misc_feature: GYAE6OF02H79ON.52.5.A05.1.454.CMB.1.raw
tcagcgcagtacgacacgaccggtgctcgatttagatagatagacagggcaccaagggcccatcggtcttccccctggcaccctcctccaagagcacctctgggggcacagcggccctgggctgcctggtcaaggactacttcctatacgatcgctgagcgggctggcaaggcgcatag

SEQ ID NO: 259265 - DNA, 181 bp, Homo sapiens; identical to SEQ ID NO: 259223
  misc_feature: GYAE6OF02IJ0I8.52.5.A05.1.454.CMB.1.raw
  modified_base (179)..(181): a, c, t, g, unknown or other
  misc_feature (179)..(181): n is a, c, g, or t

SEQ ID NO: 259266 - DNA, 180 bp, Homo sapiens; identical to SEQ ID NO: 259174
  misc_feature: GYAE6OF02G6B9U.52.5.A05.1.454.CMB.1.raw
  modified_base (180)..(180): a, c, t, g, unknown or other
  misc_feature (180)..(180): n is a, c, g, or t

SEQ ID NO: 259267 - DNA, 503 bp, Homo sapiens
  misc_feature: GYAE6OF02G24RO.52.5.A05.1.454.CMB.1.raw
tcagcgcagtacgacacgaccggtgctcgatttagatagatagacagggggcctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcgccctcagggatccctgagcgattctctggcttccaattctggaaatgcagccactctgaccatcacgcggacccagcccatgatgaggctagctaacttactgtcaggcgtgggacgagttggttgtgtcgtttcggcggaggaccgaagctacggaccgtcctacgtcacggcccaaggccgtacgccccgttaccgg

SEQ ID NO: 259268 - DNA, 827 bp, Homo sapiens
  misc_feature: GYAE6OF02IO6A7.52.5.A05.1.454.CMB.1.raw
tcagcgcagtacgacacgaccggtgctcgatttagatagatagacaggggcgtgggccgtcaggaagcagcatcggaggtggctcagccatggcatggatcctctcttcctcggcgtccttcgtcttactgcacaggttctgtggcctcctatgacttgctcagccaccctcacgtgtccgtcgtcccgacggacagacacgaccaccaatcacctcgctctggacagtcgtagtgggggatagtacgtattcgtttccgttaggtactcacgtacgaacgaacgccgacggccgacgtccgtccttcgttccttcctaccttactaccttaagtaaaacgtacgttacgttacgaacggtaccggtacccgtaccgaacggggtaacctcccgtacggtaaccggtccgttaacgttccgttacggttcggtacctttacctaacgtttacgtaacgggttaaaacttcggaccgtacgtacccgtaacttacctacggtaaccctacgtaccgaccggtaccgggtaaccctaccggtaccgtaacggtacggtaacgtacgggtaacgggcgttaacgtaaccgttaacgttacggtacgttacggtaacgggtacgggttacgggtaacgttacgggtttaaggtttcgggtttacggttaccccggttttagggggacccggggttaaaccgggtaccggtaaacggttaccggttaccgggttaaccccggtttaccgggttacccggttacggtaaacccgggttaccccgtaaacggggtcccccgttttacccgggaccccccggttttaacccgggg

SEQ ID NO: 259269 - DNA, 193 bp, Homo sapiens
  misc_feature: GYAE6OF02G0ALW.52.5.A05.1.454.CMB.1.raw
  modified_base (181)..(193): a, c, t, g, unknown or other
  misc_feature (181)..(193): n is a, c, g, or t
tcagcgcagtacgacacgaccggtgctcgatttagatagatagacagggcaccaagggcccatcggtcttccccctggcaccctcctccaagagcacctctgggggcacagcggccctgggctgcctggtcaaggactacttcctatacgatcgctgagcgggctggcaaggcgcgatagnnnnnnnnnnnnn

SEQ ID NO: 259270 - DNA, 184 bp, Homo sapiens
  misc_feature: GYAE6OF02J0DBJ.52.5.A05.1.454.CMB.1.raw
  modified_base (178)..(184): a, c, t, g, unknown or other
  misc_feature (178)..(184): n is a, c, g, or t
tcagcgcagtacgacacgaccggtgctcgatttagatagatagacaggtcaccaaggcccatcggtcttccccctcggcaccctcctccaacgagcacctctggggcacagcggcctgggctgcctggtcaaggactacttcctatacgatcgctgagcgggctggcaggcgcatagnnnnnnn

SEQ ID NO: 259271 - DNA, 611 bp, Homo sapiens
  misc_feature: GYAE6OF02HEXA0.52.5.A05.1.454.CMB.1.raw
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgagttggggatatacattgtttcctggtatcagcagaacgccaggccagtctcctgttcctccgtcatctaataaagatagtcaacgcggccctacgacgggactcccgtagacgtcgtattctcgtcggtctccgtaattccgtaggaatcgacacgtcctactctacgacctactcgacggaccggacccgacgtaccctagtcggtagtcggagtcgtagtactagttacgtcgtacgacggtcggtaggtaacgtagtttaacgggttgttgtccggttttcggggacggtaacgggtaccgtaacggtccgtacggtacccgttaccgttaccggtaccgtaccggtacccgtaacggcccgttacccggtcccccgttacccggg

SEQ ID NO: 259272 - DNA, 656 bp, Homo sapiens
  misc_feature: GYAE6OF02HNMDV.52.5.A05.1.454.CMB.1.raw
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagcccaccctcagtgtccgtgtccccaggacagacacgccaccatcacctgctctggacatcgagttggggatatacatgtttcctggtactcagcagaacgcaggccagtcctctcgttctcctctatactaataagatgtacgaacggccggaccctcggagggtacctccgtacggacgtcgtacttctcgtacggtcctacctaattccgtaggtaacgtcgacgacgtcctactacctacgaccgtacgtaccgaaccgggaccggtaacccgtacgtacccgtacgtacgggtacgtacggtacgtacgtacgttacttacgttacgttcgtacggtacggtaccggtagggtacgttaggtttaagggttcgttacggttacgggtttcgggacgggtaacgggtaccgtaacggtaccggttaccggacccgttacccggtacgtaccgaccggacccgtaccggtaccgtcccgtcccccggtccgg

SEQ ID NO: 259273 - DNA, 686 bp, Homo sapiens
  misc_feature: GYAE6OF02JTU8T.52.5.A05.1.454.CMB.1.raw
tcagcgcagtacgacacgaccggtgctcgatttagatagatagacagggggccgtgggcctcaggaagcagcatcggaggtgcctcagccatggcatggatccctctcttcctcggcgtccttgcttactgcacaggttctgtggcctcctatgacttgactcacgccaccctcagtgtccgtcgtccccaggacagacacgccaccactccacctcgctctcggacagtcgaggttggggatactactagttcgtttcctggtatcagacagtacgacctacgggcctaggtctccgttcgttcctcctactattacgtaataaagagttcgacgaacggtccgaccgtaccggtaggtacctccgtagacggtacgttacttccgtcgtacgtaccgtacctacttacgtaacggtaactacgtccgtacgtacctacgtcctacggtactaacgtacggaccgggaccggtaccgtaaccgtacgtacgtacggtagtacggacgtacgtaagtactacgttagtccggtacgtcgggtagtacggtacggttacgggttggttaggtcgttacgggttaccggtacgggtaccggtacgtaacggtcggttaccgtaaccggttaccgtacgtacccggtacggtcccgtaaggtcccgggtccccgtacccggttacccgg

SEQ ID NO: 259274 - DNA, 191 bp, Homo sapiens
  misc_feature: GYAE6OF02GFUZ7.52.5.A05.1.454.CMB.1.raw
  modified_base (180)..(191): a, c, t, g, unknown or other
  misc_feature (180)..(191): n is a, c, g, or t
tcagcgcagtacgacacgaccggtgctcgatttagatagatagacagggcaccaagggcccatcggtcttccccctggcaccctcctccaagagcacctctgggggcacagcggccctgggctgcctggtcaaggactacttcctatacgatcgctgagcgggctggcaaggcgcatagnnnnnnnnnnnn

SEQ ID NO: 259275 - DNA, 185 bp, Homo sapiens
  misc_feature: GYAE6OF02JBXNS.52.5.A05.1.454.CMB.1.raw
  modified_base (180)..(185): a, c, t, g, unknown or other
  misc_feature (180)..(185): n is a, c, g, or t
tcagcgcagtacgacacgaccggtgctcgatttagatagatagacagggcaccaagggcccatcggtcttccccctggcaccctcctccaagagcacctctgggggcacagcggccctgggctgcctggtcaaggactacttcctcgtactgcgctgagcgggctggcaaggcgcatagnnnnnn

SEQ ID NO: 259276 - DNA, 859 bp, Homo sapiens
  misc_feature: GYAE6OF02JY69H.52.5.A05.1.454.CMB.1.raw
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacacgccacctactcacctgcctctaggaccatcgagttggggattagtactatcgttttccgtaggttactaccagccaaggaacgacccgacggccgtacgttcctcccgttgttacctcctctaactacttaactaaaggtactagttaccaaacggtccgttccccgttacggacgggtaaccttcccgttaggaaccggtaccgttaagtttcccgttccgttaccgggtaacctttaacccgtaaggttttacgtaaaccgggtaaaagttcccgtaacgttaccgtaccccgtaaccgttacctaccggtaaacccttacggtttaccgaacccggggtaacccgggaaacccccgttaacgggtaccccgtttaacggtacggttaacggttacgggtaaccgggtcgttaacgttaaccggttttaactttacccggttacggttaccggaccggtttacggggtacggttaaccggtttaaacggttttcgggttttacgtttaccgggttaccggttttacggggaccgggtaacggggttaacccctaacgggttaccggttaccggtaaccccggtttaccggttaaccggtacccgttaaccggtaacccggtaaccggttccccgttacccggaaccccccggttttcccgg

SEQ ID NO: 259277 - DNA, 711 bp, Homo sapiens
  misc_feature: GYAE6OF02H0275.52.5.A05.1.454.CMB.1.raw
  modified_base (272)..(272): a, c, t, g, unknown or other
  misc_feature (272)..(272): n is a, c, g, or t
  modified_base (325)..(325): a, c, t, g, unknown or other
  misc_feature (325)..(325): n is a, c, g, or t
tcagcgcagtacgacacgaccggtgctcgatttagatagatagacagggggctgggcctcaggaagcagcatcggaggtgcctcagccatggcatggatccctctcttcctcggcgtccttgcttactgcacaggttctgtggcctcctatgacttgactcagcccaccctcagtgtccgtcgtcccaggacagacacgccaccatccactcgctcgtggacatcgtagttggggtatatacattgtttctggtatcagcagaagccaggcngtactctgttctcctcatctaataagatgtctaacgcgacctcgacgggtacnccgtaggacgacgttacttcgtctacgggtaccttacctaacgttaccgtaaggaaacgtggtaccacggtaccctcttaccgtagaacccctagtacgacgggtaacccgggaaccctagggtacccttaaggtcggtaacgtcggaacgggtaccttagaccgttttaactttaacggtcggttaaccggtaggggttcggtaacggggtacgtttacgggtttaaagggttttccggtgggttttaaccgggtttcccggggaacggggttacgggtaaacccgaaaggtttcccgggtacggttaccccgttaacccgttacggacccgtaaccggtaccggtaacccggtaaccgtttccccccgaacccgtttacccggg

SEQ ID NO: 259278 - DNA, 191 bp, Homo sapiens
  misc_feature: GYAE6OF02HZZB9.52.5.A05.1.454.CMB.1.raw
  modified_base (179)..(191): a, c, t, g, unknown or other
  misc_feature (179)..(191): n is a, c, g, or t
tcagcgcagtacgacacgaccggtgctcgatttagatagatagacagggcaccgagggcccatcggtcttcccctggcaccctcctccaagagcacctctgggggcacagcggccctgggctgcctggtcaaggactacttcctatacgatcgctgagcgggctggcaaggcgcatagnnnnnnnnnnnnn

SEQ ID NO: 259279 - DNA, 192 bp, Homo sapiens
  misc_feature: GYAE6OF02F7GR9.52.5.A05.1.454.CMB.1.raw
  modified_base (180)..(192): a, c, t, g, unknown or other
  misc_feature (180)..(192): n is a, c, g, or t
tcagcgcagtacgacacgaccggtgctcgatttagatagatagacagggcaccaagggcccatcggtcttccccctggcaccctcctccaagagcacctctgggggcacagcggccctgggctgcctggtcaaggactacttcctatacgatcgctgagcgggctggcaaggcgcatagnnnnnnnnnnnnn

SEQ ID NO: 259280 - DNA, 636 bp, Homo sapiens
  misc_feature: GYAE6OF02GQR26.52.5.A05.1.454.CMB.1.raw
  modified_base (522)..(522): a, c, t, g, unknown or other
  misc_feature (522)..(522): n is a, c, g, or t
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccacctcagtgtccgtgtccccaggacagacagccaccatcacctgctctgacatcgattggggatagtacatagtttcctggtatcagcagaagccaggccagtctcctgttctcctcatctataaagatcgtacaacgcggccctacgaggatcccctagacgtacgaacttctcgttacggccttaccgtaaatttctaaggtaaaacgttcgaccgtaaggtacccaccgttactacggaccctaaatcctaacgggacccgggtaacccgtaacgaccccgttaagtcgggaacgtaggacggtctagtaacttagttaactcgtacgaggtcggtacggtacgagttagggttntggttcgttcgggacgggtaacgggtaaccgaaggttccgacggttacccggtaccttacggtaccgaaccggtaccccaaacggttccggtacccgtacccccgttacccggg

SEQ ID NO: 259281 - DNA, 603 bp, Homo sapiens
  misc_feature: GYAE6OF02GKGIO.52.5.A05.1.454.CMB.1.raw
tcagcgcagtacgacacgaccggtgctcgatttagatagatagacagggggcctgggcctcaggaagcagcatcggaggtgcctcagccatggcatggatccctctcttcctcggcgtccttgcttactgcacaggttctgtggcctcctatgacttgactcagccaccctcagtgtccttgtccccaggacagacagccacatcactgctactggacatcgattggggatatacatagttcctggtatcagctagaagccaggccagtctcctgttctcctcatctataaagatgtcaagcgccctgacggactcctgagtcgtacttctctacggcttaccaatttctaagtaaagtcgacacgtccacctctgaacctatcgacgccggaacccagaccctaagtcggatggacgcgtagacttacttaactgtaccagggaccgttgggaacgttaggttaggtttggtacggtttccggtttacggggaccgggtaacgggtaaccgtaaacgggttcccgtttaacccggtcccgttacgttaccgaaccgtacccggtaaaccggtctccccggtaccccccgtagggttaccccg

SEQ ID NO: 259282 - DNA, 652 bp, Homo sapiens
  misc_feature: GYAE6OF02JMPXG.52.5.A05.1.454.CMB.1.raw
  modified_base (302)..(302): a, c, t, g, unknown or other
  misc_feature (302)..(302): n is a, c, g, or t
  modified_base (461)..(461): a, c, t, g, unknown or other
  misc_feature (461)..(461): n is a, c, g, or t
tcagcgcagtacgacacgaccggtgctcgatttagatagatagacagggggcctgggcctcaggaagcagcatcggaggtgcctcagccatggcatggatccctctcttcctcggcgtccttgcttactgcacaggttctgtggcctcctatgacttgactcagccaccctcagtcgtccgtgtccccaggacagacagccaccatcacctgctctggacatcgagttggggatatacattgtttccgtaggtatctagcaagaagccaggccagtctcctagttctctctatctaagtaanactgtacgaagcgccgtacacgggtcttccctaggacgacgtattcgtacgtaggccctacgtagttaccgaggttaaacgtcgcgtaacgacctactaccgtacggacctactaccgacgggtccgacccgacgtacctagtggtaacgtcggtacgngttactaaccgtttaagtacgttcgtacggacggtacggtaccgggtacgttacgggttaggtttcggtcgtttaccggttcggggacggtacgggtaaccgtaacggtaccgtacggtaccccgttacggttaccgttaaccggaccgtacccggtacggtaccccttcccgggtacccccgttaccggg

SEQ ID NO: 259283 - DNA, 701 bp, Homo sapiens
  misc_feature: GYAE6OF02JYHOF.52.5.A05.1.454.CMB.1.raw
  modified_base (130)..(130): a, c, t, g, unknown or other
  misc_feature (130)..(130): n is a, c, g, or t
  modified_base (308)..(308): a, c, t, g, unknown or other
  misc_feature (308)..(308): n is a, c, g, or t
  modified_base (323)..(323): a, c, t, g, unknown or other
  misc_feature (323)..(323): n is a, c, g, or t
  modified_base (559)..(559): a, c, t, g, unknown or other
  misc_feature (559)..(559): n is a, c, g, or t
tcagcgcagtacgacacgaccggtgctcgatttagatagatagacaggggctgggcctcaggaagcagcatcggaggtgcctcagccatggcatggatccctctcttcctcggcgtccttgcttactgcncaggttctgtggcctcctatgacttgactcagccaccctcagtgtccgtcgtccccaggaccaggaccacgcccaccatccacctgcctccgtggaccagtccgagttcggggatagtactatcgttcctggtacttcagctaagacgccgaggccagtccttcctggttcctccttnattactaataaacgnttcgtacaacgtccgtcctacgagggtctaccgtggaacgtgtaacttcacggtcggtacctactaacgttccgtagggtaaacttcggaaccgtaccgtacctaaccggtaccttaccggaaaccccgtaggttacccgacccggggttaacccggaaccccgtggtaaaccccgttagtacgggtacccgtttagggaacggtacccgttagtaaacccggttattttaaccgnggtttaacaccgggggtccgttaacggggtaggttaacgtttcgggttgttaaccgggtcgtttacggggcggtaaccggacgtagtccgtacggtacgtacccgtagccgtacgaccgtacggtctacccggtcccgtcgg

SEQ ID NO: 259284 - DNA, 657 bp, Homo sapiens
  misc_feature: GYAE6OF02I8H01.52.5.A05.1.454.CMB.1.raw
tcagcgcagtacgacacgaccggtgctcgatttagatagatagacaggggctgggcctcaggaagcagcatcggaggtgccccagccatggcatggatccctctcttcctcggcgtccttgcttactgcacaggttctgtggcctcctatgacttgactcagccaccctcagtcgtccgtcgtcccacgacagacagccaccatcactgctctcgacatcgagttggggatactactatcgtttcctggtatcgagcgaagtaacgccgacggcctacgtcttccttcgttcctcctactacgtactaagtaagtatcgtacaacggtccggcctacgacggtactccgtgaacgcgtattcctccgtcggtcctacctaacgttccgtaggtaaatcgaccgtaccgtaccctacgttccgtaccgaaccgtactaccggacggtacccgggaccgaccgtccgttacgtaggtaacgtcggtacggtacgtacgttaaccttactaccgttacgtacggtaccgggtcgggtacgggtaacggtcgggtttagttcggttacggttcggtttcgggacggtacgggaccgtaggtcgtccggaccgtcgtacgtcgtaccggacccgacggtcccgtcggtcccccgtgtacccg

SEQ ID NO: 259285 - DNA, 180 bp, Homo sapiens
  misc_feature: GYAE6OF02IB3XW.52.5.A05.1.454.CMB.1.raw
  modified_base (177)..(180): a, c, t, g, unknown or other
  misc_feature (177)..(180): n is a, c, g, or t
tcagcgcagtacgacacgaccggtgctcgatttagatagatagacagggcaccaagggcccatcggtcttcccctggcaccctcctccaagagcacctctggggcacagcggccctgggctgcctggtcaaggactacttcctatacgatcgctgagcgggctggcaaggcgcatgnnnn

SEQ ID NO: 259286 - DNA, 195 bp, Homo sapiens
  misc_feature: GYAE6OF02GBBXI.52.5.A05.1.454.CMB.1.raw
  modified_base (180)..(195): a, c, t, g, unknown or other
  misc_feature (180)..(195): n is a, c, g, or t
tcagcgcagtacgacacgaccggtgctcgatttagatagatagacagggcaccaagggcccatcggtcttccccctggcaccctcctccaagagcacctctgggggcacagcggccctgggctgcctggtcaaggactacttcctatacgatcgctgagcgggctggcaaggcgcatagnnnnnnnnnnnnnnnn

SEQ ID NO: 259287 - DNA, 622 bp, Homo sapiens
  misc_feature: GYAE6OF02FH6U9.52.5.A05.1.454.CMB.1.raw
tcagcgcagtacgacacgaccggtgctcgatttagatagatagacagggggcctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatccacctgctctggacatcgagttggggatatacattgtttcctggtatctagcagtaacgcccgaggccagttctccttgttcctcctctattctaataaagatgtacaaggccgccctcgagggctccctgagtcgacttctcgtcggctcctaattcgtaggtaaatcgactacgcctacttcgacgaaccataccgacggtaccgggaacccgacgtacctagttgggacttggaacgggtctacgtacttagtttacgtcggttacggacgggtcgggtagggtaacgttacgggttaggtttcggttgttcgtttcgggtacgggtacgggacgtaacggtccgtacggtacccggttaccgtacggtaccgtacgtacccggaacggtcctacccggtccccgttacccgg

SEQ ID NO: 259288 - DNA, 857 bp, Homo sapiens
  misc_feature: GYAE6OF02FRZB1.52.5.A05.1.454.CMB.1.raw
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagcccaccctcagtcgtccgtcgtaccccgaggacagacacgccaccatccactgctctcggacatcgtagttggggatatacattgtttcctggtactacacgcaagaacgccaggccacgtctcctcgttcctccgtctactactaagtaaacgtattcgtacgaacgtccggtaccctacggaacgggtaccttacccgtaggtaaccggtcgtaacgtttcgtccgttacggaccttacctaacgttaccgtaagggtaaacttcggaccaaccggtaccctaccgttaccgtacgtaaaccccgaacgttaccccggtaaccggggaccccgggggtaaacccctaaccgggtacccggtttaacgttaccggggtacttaacggggtacggtacccgggtttaaacgttaccgtttaaaccgttttaaccggttaccggttaaccggaccggggtttaccgggggtaacgggtaaccggtttaacggggttttacggggtttaccgggttttaccggttttccgggggttttaaccgggggtacgggggtaaaccgggttacccgggtaaacggttaccccggttaacccgggtttaaacccccggttacccgtttaccgggttacccttaacccggggacccggttaaacccgggtccccggtccccgggttccccccggttacccgggg

SEQ ID NO: 259289 - DNA, 695 bp, Homo sapiens
  misc_feature: GYAE6OF02G4ENZ.52.5.A05.1.454.CMB.1.raw
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (305)..(305): a, c, t, g, unknown or other
  misc_feature (305)..(305): n is a, c, g, or t
tcagcgcagtacgacacgaccggtgctcgatttagatagatagacagggggcctgggcctcaggaagcagcatcggaggtgcctcagccatggcatggatccctctcttcctcggcgtccttgcttactgcacaggttctgtggcctcctatgacttgactcagccaaccctcagtgtccgtgtccccaggacagacagccaccatcacctgctactggaacatcgagttggggatagtacattgttcctggtatcagcagaagcaggccagtctctgtctcctcatctanaaaagntgtacaancggacctgagggactccctggacgacgtattccgtctaggacctacctaaacgtttccgtaggtaaaacgttcggacctaacggccctaacgttaccgtcggaacctaacggtacgaacggaccggggaaccctaacggtacccgtaaggttacggtaaccgtaggtaacgggtaccgttacgaaaccgtttaaacgttaccgttacggttaccgtaaggggtaccgggtaggggttaaccgtaaggttttaacgggttacgtacggttacgttttccgggacgggaacggggttaacccgaacgggtacttaaccggtaccggttaccgtaccggtacgtaacccggtacccgaaacggcccggttaccgtacccccccggttaccggg

SEQ ID NO: 259290 - DNA, 196 bp, Homo sapiens
  misc_feature: GYAE6OF02J15SS.52.5.A05.1.454.CMB.1.raw
  modified_base (177)..(196): a, c, t, g, unknown or other
  misc_feature (177)..(196): n is a, c, g, or t
tcagcgcagtacgacacgaccggtgctcgatttagatagatagacagggcaccaagggcccatcgtcttcccctggcaccctcctccaagagcacctctgggggcacagcggcctgggctgcctggtcaaggactacttcctatacgatcgctgagcgggctggcaaggcgcatagnnnnnnnnnnnnnnnnnnnn

SEQ ID NO: 259291 - DNA, 181 bp, Homo sapiens
  misc_feature: GYAE6OF02IL6VG.52.5.A05.1.454.CMB.1.raw
  modified_base (178)..(181): a, c, t, g, unknown or other
  misc_feature (178)..(181): n is a, c, g, or t
tcagcgcagtacgacacgaccggtgctcgatttagatagatagacagggcaccaagggcccatcggtcttccccctggcaccctcctccaagagcacctctgggggcacagcggccctgggctgcctggtcaaggactacttcctatacgatcgctgagcggctggcaaggcgcatgnnnn

SEQ ID NO: 259292 - DNA, 799 bp, Homo sapiens
  misc_feature: GYAE6OF02FGFQU.52.5.A05.1.454.CMB.1.raw
tcagcgcagtacgacacgaccggtgctcgatttagatagatagacaggggctgggcctcaggaagcagcatcggaggtgcctcagccatggcatggatccctctcttcctcggcgtccttgcttacctgcacaggttctgtggcctcctatgacttgactcagccaccctcagtgtccgtgtccccaggacagacagccaccatccacctgctctggacatcgagttggggatatacagttcgttcctggtatcgagactaagaacgccgacggtccacggtacctccgttgttccctcctacctaacttacctaagtaaacgtacgttggtaccgtaacgggccggtaccccgttacgaacgggtacttacccgtcggaacgtacggtactttccgtacgttcggtacctacctaacgtttaccgtaaggtaaacgtcggaccgtacggaacctacgttaccgtacgtaacctaacgttacgaaccgggaccggggaacccctaacggaccttaacggtcgggttaagtacgggtaacggtaccttacgtaacgtttaacctttaacggttaccgttacgggtacggggttaccgggttagggaacccgtttaaggggtttaacggttttcggttaccgggtttaccgggtttttaacccggggaccggggttaaacgggtaacccggtaaacgggttacccggtacccgggtaaccggtttaacccgtaccggttacggaaccccggtaacccggtaaccgggttccccgtaccccggtccccccggtttaacccgg

SEQ ID NO: 259293 - DNA, 194 bp, Homo sapiens
  misc_feature: GYAE6OF02F4GSA.52.5.A05.1.454.CMB.1.raw
  modified_base (180)..(194): a, c, t, g, unknown or other
  misc_feature (180)..(194): n is a, c, g, or t
tcagcgcagtacgacacgaccggtgctcgatttagatagatagacagggcaccaagggcccatcggtcttccccctggcaccctcctccaagagcacctctgggggcacagcggccctgggctgcctggtcaaggactacttcctatacgatcgctgagcgggctggcaaggcgcatagnnnnnnnnnnnnnnn

SEQ ID NO: 259294 - DNA, 674 bp, Homo sapiens
  misc_feature: GYAE6OF02I1GM2.52.5.A05.1.454.CMB.1.raw
  modified_base (214)..(214): a, c, t, g, unknown or other
  misc_feature (214)..(214): n is a, c, g, or t
  modified_base (388)..(388): a, c, t, g, unknown or other
  misc_feature (388)..(388): n is a, c, g, or t
  modified_base (400)..(400): a, c, t, g, unknown or other
  misc_feature (400)..(400): n is a, c, g, or t
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcacgccacctcagtgtccgtgtacccaggacagacacgccaccatcacctcgtcnctaggacatcggtagtagggggtatacgtacagttacgtttccgtaggttacgtcgtagtacgaagaacggtacgacggtacctacggtcctccgttcgttcctaccgttcaacttactaactaaagtactacgtactaaccggtcggtacctacgacgggtactcctgaccgngtacgtcttcgngtactaccgtacttaccgtaagaactcgacgactaccactacgtacacctagtacgacggtaaccggcctacgtccttacgtaggtaccgagtaacgtcgtagtacgtattacgtaacgtacggtacgtcggtacgggtaacgttacgttaacgggttggttaacgttccggggtttacggtacggggtaaggtaacccggtacggtacggtcccggtaccttacccgtacgtaaccgtccggaaccgccggttacctcccgtacccggtacgg

SEQ ID NO: 259295 - DNA, 181 bp, Homo sapiens; identical to SEQ ID NO: 259223
  misc_feature: GYAE6OF02F4IF5.52.5.A05.1.454.CMB.1.raw
  modified_base (179)..(181): a, c, t, g, unknown or other
  misc_feature (179)..(181): n is a, c, g, or t

SEQ ID NO: 259296 - DNA, 716 bp, Homo sapiens
  misc_feature: GYAE6OF02HYJYJ.52.5.A05.1.454.CMB.1.raw
tcagcgcagtacgacacgaccggtgctcgatttagatagatagacaggggctgggcctcaggaagcagcatcggaggtgcctcagccatggcatggactccctctcttcctcggcgtccttgcttactgcacgtaggttctggtggcctctatgacttgactcagccaccctcagtcgtcgtcgtcccgaggacagacacgccaccactcacctcgctctcgacagtcgtaggttaggggtataagtactagttcgtttccgtaggtactacgagacaaggaacgcgacggtaccctacgttccttaccttcgtttacctccttactaactacttaaacgtaaagtacttacgtaccgaaacggcccggtaccctacggtacgggtaccttccgtacggacgtaccgttacttaccgtcgtcggtacctaaccgtaagttcgtacggaaacgttcggacgaccgtaccctacttacgtcgtaccaacgtaccggacgggacccggacccagggtaccctaggtaacggtaggtacggacggtcttaagaccttttaaactacggttagtaccgggaagggtcggtacggggtaaggtttacggtttgggtttacgtggtttacgggttacgggtacggacggtaccgaagttccggtacggtccttaccgcgtaccggacggtacccgtacggttcccgacccggttcccgtacgg

SEQ ID NO: 259297 - DNA, 832 bp, Homo sapiens
  misc_feature: GYAE6OF02IH1H5.52.5.A05.1.454.CMB.1.raw
tcagcgcagtacgacacgaccggtgctcgatttagatagatagacaggggctgggcctcaggaagcagcatcggaggtgcctcagccatggcatggatccctctcttcctcggcgtccttgcttactgcactaggttctgtcggccttacctatcgtacttcgacttcacgcccaccctcagtcgtccgtcgtccccaggacacgacacgaccaccactccaccgtgtcctcgtacgactacgtcgtaggttggggaatactactagtttcgtttaccgtggttactcgaacgtacctaacggaacggacccgacggaccctacggttaccctttccttcgtttacccttcccgttactaacttaacgttaaataaacgtagttcgtaaccgaacgtcccggtaccgtacggacgtaccgtccgtacgacgtacgtaccttcgtacgtcggtacttaccgttaacgtttacggtaacgtaacgttccgaaccgtaccggttaccctaaccgtaccgttaccgtaacccgtacgtacccggtacccggggaacccgggaccccgttaaccgtaaccgttacgggtaccgtagttaccgggacgtagttacccgtactttaaaccggttcgtaccggtttacggtacggtaccgggtacggttaacggttacgggttttacgggtttacgttcggtttaccggggttccgggaacgggtaaccggtacggttaaccggtaccggttaccggttaaccccgtaccggttaacccggtaccgaaccggtacccggtaaccggtaccccggttaccccggttccccggttaacccgg

SEQ ID NO: 259298 - DNA, 202 bp, Homo sapiens
  misc_feature: GYAE6OF02FLTGU.52.5.A05.1.454.CMB.1.raw
  modified_base (180)..(202): a, c, t, g, unknown or other
  misc_feature (180)..(202): n is a, c, g, or t
tcagcgcagtacgacacgaccggtgctcgatttagatagatagacagggcaccaagggcccatcggtcttccccctggcaccctcctccaagagcacctctgggggcacagcggccctgggctgcctggtcaaggactacttcctatacgatcgctgagcgggctggcaaggcgcatagnnnnnnnnnnnnnnnnnnnnnnn

SEQ ID NO: 259299 - DNA, 761 bp, Homo sapiens
  misc_feature: GYAE6OF02FHWZW.52.5.A05.1.454.CMB.1.raw
tcagcgcagtacgacacgaccggtgctcgatttagatagatagacagggggcctgggcctcaggaagcagcatcggaggtgcctcagccatggcatgggatccctctcttcctcggcgtccttgcttactgcacaggttctgtggcctcctatgacttgactcagccaccctcagtgtccgtcgtcccaggacagacacgccaccatccacctcgctctggacatcgagttggggactatactagtcgtttacgtaggtactacagacgagaacgccgacggacctaagttctcccttgttcctacccttcgaacttactaataaacgtagttcgacgtaacggccgtcccgtacgaagggtccgttacccgtagacggtccgtactttcgtccggtacgtccgttaaccgtaactttcgtaacggtaatcggacaacgtcccgtaaccttcgtacgtaacccgtacgtaccgaccgggtacccggaaccccgtaacgtacccggttaggtccggaaaggtcggtacggtaccgttacgggttaaccttaacgtttacgttagggtaaccggtcgggggtacgttaacgggggtacttaggggtttacggtttttcgtccgggtttacggttttccggggggaccggttaacggggtaacccgtagggttcccgtaaccggtaacccccgtttacggtaaccgttacccggaccggttaacccggccggttaccgtaccccggttcccccgttaacccggg

SEQ ID NO: 259300 - DNA, 195 bp, Homo sapiens
  misc_feature: GYAE6OF02FRZHI.52.5.A05.1.454.CMB.1.raw
  modified_base (183)..(195): a, c, t, g, unknown or other
  misc_feature (183)..(195): n is a, c, g, or t
tcagcgcagtacgacacgaccggtgctcgatttagatagatagacagggcaccaagggcccatcggtcttccccctggcaccctcctccaagagccacctctgggggcacagcggccctgggctgcctggtcaaggactaacttcctcgtactgcgctgagcgggctggcaaaggcgcatagnnnnnnnnnnnnn

SEQ ID NO: 259301 - DNA, 190 bp, Homo sapiens
  misc_feature: GYAE6OF02FE9T1.52.5.A05.1.454.CMB.1.raw
  modified_base (178)..(190): a, c, t, g, unknown or other
  misc_feature (178)..(190): n is a, c, g, or t
tcagcgcagtacgacacgaccggtgctcgatttagatagatagacagggcaccaagggcccatcggtcttccccctggcaccctcctccaagagcacctctggggcacagcggcctgggctgcctggtcaaggactacttcctatacgatcgctgagcgggctggcaaggcgcatagnnnnnnnnnnnnn

SEQ ID NO: 259302 - DNA, 239 bp, Homo sapiens
  misc_feature: GYAE6OF02F6TG3.52.5.A05.1.454.CMB.1.raw
  modified_base (147)..(147): a, c, t, g, unknown or other
  misc_feature (147)..(147): n is a, c, g, or t
  modified_base (186)..(239): a, c, t, g, unknown or other
  misc_feature (186)..(239): n is a, c, g, or t
tcagcgcagtacgacacgaccggtgctcgatttagatagatagacaggggcaccgaagggcccatcggtcttccccctggcaccctcctccaagagcacctctgggggcacagcggccctgggctgcctggtcaaggactacttccnggtagcactctggagcgggctggacaagggccacatagnnnnnnnnnnnnnnnnnnnnnnnnnnnnnnnnnnnnnnnnnnnnnnnnnnnnnn

SEQ ID NO: 259303 - DNA, 183 bp, Homo sapiens
  misc_feature: GYAE6OF01DJEXH.13.80.H03.1.454.CMB.1.raw
  modified_base (156)..(183): a, c, t, g, unknown or other
  misc_feature (156)..(183): n is a, c, g, or t
tcagtcacgtactacacgaccggtgctcgatttagctgtgcgtcgaagggaaaggggacacgactggagattaaacgaactgtggctgcaccatctgtcttcatcttcccgccatctgatagtacgtgactgagcgggctggcaaggtcgcatagnnnnnnnnnnnnnnnnnnnnnnnnnnnn

SEQ ID NO: 259304 - DNA, 156 bp, Homo sapiens
  misc_feature: GYAE6OF01BLWJZ.13.80.H03.1.454.CMB.1.raw
  modified_base (154)..(156): a, c, t, g, unknown or other
  misc_feature (154)..(156): n is a, c, g, or t
tcagtcacgtactacacgaccggtgctcgatttagctgtgcgtcgaagggaaagggacacgactggagattaaacgaactgtggctgcaccatctgtcttcatcttcccgccatctgatagtacgtgactgagcgggctggcaaggcgcatagnnn

SEQ ID NO: 259305 - DNA, 155 bp, Homo sapiens
  misc_feature: GYAE6OF02GOFN6.13.80.H03.1.454.CMB.1.raw
  modified_base (154)..(155): a, c, t, g, unknown or other
  misc_feature (154)..(155): n is a, c, g, or t
tcagtcacgtactacacgaccggtgctcgatttagctgtgcgtcgaagggaaagggacacgactggagattaaacgaactgtggctgcaccatctgtcttcatcttcccgccatctgatagtacgtgactgagcgggctggcaaggcgcatagnn

SEQ ID NO: 259306 - DNA, 154 bp, Homo sapiens
  misc_feature: GYAE6OF02F81EP.13.80.H03.1.454.CMB.1.raw
  modified_base (154)..(154): a, c, t, g, unknown or other
  misc_feature (154)..(154): n is a, c, g, or t
tcagtcacgtactacacgaccggtgctcgatttagctgtgcgtcgaagggaaagggacacgactggagattaaacgaactgtggctgcaccatctgtcttcatcttcccgccatctgatagtacgtgactgagcgggctggcaaggcgcatagn

SEQ ID NO: 259307 - DNA, 167 bp, Homo sapiens
  misc_feature: GYAE6OF02F7VMC.13.80.H03.1.454.CMB.1.raw
  modified_base (155)..(167): a, c, t, g, unknown or other
  misc_feature (155)..(167): n is a, c, g, or t
tcagtcacgtactacacgaccggtgctcgatttagctgtgcgtcgaagggaagggacgacgactggagattaaacgaactgtggctgcaccatcctgtcttcatcttcccgccatctgatagtacgtgactgagcgggctggcaaggcgcatagnnnnnnnnnnnnn

SEQ ID NO: 259308 - DNA, 157 bp, Homo sapiens
  misc_feature: GYAE6OF02H9G5S.13.80.H03.1.454.CMB.1.raw
  modified_base (154)..(157): a, c, t, g, unknown or other
  misc_feature (154)..(157): n is a, c, g, or t
tcagtcacgtactacacgaccggtgctcgatttagctgtgcgtcgaagggaaagggacacgactggagattaaacgaactgtggctgcaccatctgtcttcatcttcccgccatctgatagtacgtgactgagcgggctggcaaggcgcatagnnnn

SEQ ID NO: 259309 - DNA, 542 bp, Homo sapiens
  misc_feature: GYAE6OF01DTQSZ.39.72.G06.1.454.CMB.1.raw
  modified_base (333)..(333): a, c, t, g, unknown or other
  misc_feature (333)..(333): n is a, c, g, or t
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaatttgtgttgacgcagtctccaggcaccctgtctttgtctccaggggatagagccaccctctcctgcagggccagtcagagtgttagcacctccttagcctggtaccagcagaaatttggccaggctcccaggctcctcatctttgatttcatccagcagggccactggcactcccagacnggttcagtggcaggtgggtctgggacagtacttcagtctcaccatacagcagactggacgtctggtaagtattttgctagttgttaattagttgtactagtactaagttataggtacgtccctaccccccgtagtaccgttcggaccgacgggaccagtggtaggaatacgaaacgtacgtagtggactgacaccatctgtcttctacg

SEQ ID NO: 259310 - DNA, 903 bp, Homo sapiens
  misc_feature: GYAE6OF01EC39H.39.72.G06.1.454.CMB.1.raw
tcagtcgcactagtcacgaccggtgctcgatttagctacgactgcaaggaaaggggaagaaggctgctcagttaggacccagaggaaccatggaaaccccagcgcagcgttcctcttcctcctgcctacgtctggctcccagataccgaccggagaattttgtgttgacgcagtctccaggcaccctgtcctttgtcctccgacggggacttagagccaccctctcctgacagggccaggtcagacgtgttacgcctaccgtccgttaagccgttggtaacccaggcctaaggtaaaacgttttcgggaccctaagggtaccttaccccgaaggtcctccctcaacgttaccgttttaggaaacttttcccaactttccccgaaggtaccgaacggggtaccctaaccgttcgggacctaaacttcccccgtaaggtaaccgaacgggttttaccgaacggggtttcgggactaacgggtttacggggtaccgttagggggaaccgtaacgggtaaccgttttaccggaaaggtttcccgttaccggaaaccctaaacgtttcccgttaacggtacccgtaaacggttaacccgttacgggtaaacggtaccccgttaaaggtaaacggttaacgttttttcggaacccgttaagggtttacggtttaagtttaacgttttacggtttacgtaacggttaacctaaagtttaacgttaacggttaacgtacccgttaccccccgtaaggtaacccggtttaccgggtaccccggtaaacggggtaaccccgtaaggttaccgggtaacgggtaaaacggttaccggtaaaaaccggtaaccgttacgggtacggtaccgttacgaaccgtaacccgtagttaccgtacgttccgttcgtaacc

SEQ ID NO: 259311 - DNA, 525 bp, Homo sapiens
  misc_feature: GYAE6OF01EP0X3.39.72.G06.1.454.CMB.1.raw
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaatttgtgttgacgcagtctccaggcaccctgtctttgtctccaggggatagagccaccctctcctgcagggccagtcagagtgttagcacctcttagcctggtaccagcagaaatttggccaggctccaggctctcatctttgattcatccagcagggccactggcatcccagacaggttcagtggcaggtgggtctgggacagacttcagtctcaccatcagcagactgggagcctgaagtattttgctagtgttattattgtcagctaatagtggtacgtcctcccccgtagtaccgttcggaccgaacgggaccagtggtaggaaatacgaaacgtaacgtgtcggctgactaccatactgtccgtctac

SEQ ID NO: 259312 - DNA, 517 bp, Homo sapiens
  misc_feature: GYAE6OF01EDXW6.39.72.G06.1.454.CMB.1.raw
  modified_base (368)..(368): a, c, t, g, unknown or other
  misc_feature (368)..(368): n is a, c, g, or t
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaattttgtgttgacgcagtctccaggcaccctgtctttgtctccaggggatagagccaccctctcctgcagggccagtcagagtgttagcacctcttagcctggtaccagcagaaatttggccaggctcccaggctcctcatctttgattcatccagcagggccactggcatcccagacaggttcagtggcagtggtctgggacagacttcaatctnaccatcagcagactggagcctagaagtattttgctagtgtattattgtcagacaatatggtagtcctcccccgagtaccgttcggaccgaagggaccagtaggtacggaaatacgaaacgtaactggtgactgacacatctgtctctac

SEQ ID NO: 259313 - DNA, 516 bp, Homo sapiens
  misc_feature: GYAE6OF01EPVOP.39.72.G06.1.454.CMB.1.raw
  modified_base (505)..(505): a, c, t, g, unknown or other
  misc_feature (505)..(505): n is a, c, g, or t
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaattttgtgttgacgcagtctccaggcaccctgtctttgtctccaggggatagagccaccctctcctgcagggccagtcagagtgttagcacctccttagcctggtaccagcagaaatttggccaggctccaggctcctcatctttgattcatccagcagggccactggcatccccagacaggttcagtggcaggtggtctgggacagacttcagtctcacctatcagcagactggagcctagaagtatttgctagtgtattattgtcagtctatatgtagcctccccgagtacgttcgccgaacggaccagtaggtaggaaatacgaaacgaatacggtggctgacgactatntgtcttctacg

SEQ ID NO: 259314 - DNA, 686 bp, Homo sapiens
  misc_feature: GYAE6OF01CQFRG.39.72.G06.1.454.CMB.1.raw
  modified_base (286)..(286): a, c, t, g, unknown or other
  misc_feature (286)..(286): n is a, c, g, or t
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaatttgtgttgacgcagtctccaggcaccctgtctttgtctccgaggggatagacgccaccctctcctgcgagggccagtcagagtgttagcaccgtctagctggtaccagcagaattgccaggctccagcctcncatcttgatcatccagcacggccactggcatcccagacaggttcagtcggcaggtgggtctgggaccagtactcgtacgtcctacgactacgtcgacgtacgaacgtacgtacggacggtaccgtaggtaaacggttagttttacggacgttaagggtttgtttaagtttacggtttacgttacgtaacggtaacttaaattacggttacggtaaccgttaccccgtacccccccgtaaggtacccggtttaccgggaacccgtaacggggtaacccgtagttacgggggtaaacgtaaaaccggtaacgtaaaaccggtaaccgttagggttaccggtaccgttacggacccgttaacccgtacgtttaccgttacgttcccgtttacgtttaaccccg

SEQ ID NO: 259315 - DNA, 674 bp, Homo sapiens
  misc_feature: GYAE6OF01DJUXL.39.72.G06.1.454.CMB.1.raw
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaatttgtgttgacgcagtctccaggcaccctgtctttgtctccgaggggatagacgccacccctcgtcctgcacgggccagtcagagtgttagcacctctagccgtggtaccagcagtaattggcagctccaggctctcattcttgattcatccagcgtacgggactacgtggtcactccccagtaccgtaggttcaggtcggacgtaggttcggggtcgtaggggaacacggtacttcgtacgtcctaccgtaacccattcgacgacgaacgtacgtacgggacgtcccgttaggtaaaggttacgtttcgacgtaggttattagttaagtttcgtacgtaacgactaaagttacgttcggtaacccgccccttacccccgaagggttacccgggttacccggaaccggtaacggaaccgttacggtacgggtacggtaaaacgttacccggaaaacggtaacttcgggcggtaccctacgacccgtaacctacgttcgttcgttacccgttaccttacccg

SEQ ID NO: 259316 - DNA, 619 bp, Homo sapiens
  misc_feature: GYAE6OF01CMS3G.39.72.G06.1.454.CMB.1.raw
  modified_base (289)..(289): a, c, t, g, unknown or other
  misc_feature (289)..(289): n is a, c, g, or t
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaattttgtgttgacgcagtctccaggcaccctgtctttgtctccaggggatagagcccaccctctcctgcagggccagtcagagtgttagcacctcttagcctggtaccagcagaattggcaggctcccaggctcctnatcttgattcatccagcagggccacgtggccactccccagactaggttcaggtggctaggtgggtcgtgggacagacttcagttctcacatcagcagacgtggacgccgtagtaagttagtttagactagttacggttattagttgtacagtactaaagttagttacgggtaacgtcccgttaccccccgtaggtacccggttaccggtaacccgaacggggtaacctaggtacgggtaacgggtaaaactaaccggtaaaaccggtaacgttacggtacggtaccgtacgaccgtaaccgtacgttaccgttccgttcgttctaacccg

SEQ ID NO: 259317 - DNA, 848 bp, Homo sapiens
  misc_feature: GYAE6OF01C6DT5.39.72.G06.1.454.CMB.1.raw
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaatttgtgttgacgcagtctccaggcaccctgtctttgtctccaggggatagagccaccctctcctgtacgggccagtcagagtgttacgcaccttctacgccgtggtaccagacaagtaagtttcggaccaggtcctacccgaggtccttccgtactatttctttgtacttcgactccgacgccgacgggaccctacggtcggacctaaccgtccccgaaggtaccgtaacgggtttccgagggttcggacggtaaggggttcggggttaccggtacggggaacctaacggttaccttaccgtacggttacccttaccgaaccctagttaccaacggtcgaacgggtaccgtacgggtaaccgtcccgtaaggtaaacggtttacgttttcggaaccgttaggtttagtttaattttacgtttcgtaccgtaagttaactaaagtttaggtacgggttaaccgtcccccttaaccccccggtagggttacccgggttaccgggaaccccgggttaaaccggggtacccgttaagggttaaccggggtaaacggtaaaaacccgttaaccggtaaaaaacccgggttaccggttagggttaaccggggtacccttaccggaaccccgttaaacccgttaccgtttacccgtttaccggttttaccctttaccgttaccccgttttaacccccccggg

SEQ ID NO: 259318 - DNA, 651 bp, Homo sapiens
  misc_feature: GYAE6OF01EJUYB.39.72.G06.1.454.CMB.1.raw
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaatttgtgttgacgcagtctccaggcaccctgtctttgtctccaggggatagagccaccctctcctgcagggccagtcagagtgtagcacctcttagcctgtaccagcagaaattggcaggctccaggctcctcatctttgattcgatccagcgtagggccacgtggcactcccagacgtagttcagtggcaggtcgggtctgggactaggtacttcgacggtctacgacctagtccgagtcgaacgacgtgggacgccgtagaagtagttttgactaggttagttaatttagttgtacagtactaaagttacgtacggttaacgtccccgttaccccccgtaaggttacccggtttaccgggacccgtaaacggggtacccgtaagttacgggtaacggtaaaacgttaaccggaaaaccggttaacgttacggttacggtaccgttaacggacccgtaacctaacgttaccttacggttcccttaccgttaaccccgg

SEQ ID NO: 259319 - DNA, 587 bp, Homo sapiens
  misc_feature: GYAE6OF01DBPPK.39.72.G06.1.454.CMB.1.raw
  modified_base (387)..(387): a, c, t, g, unknown or other
  misc_feature (387)..(387): n is a, c, g, or t
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaatttgtgttgacgcagtctccaggcaccctgtctttgtctccaggggatagagcccaccctctcctgcagggccagtcagagtgttagcacctccttagcctggtaccagcagaaatttggccaggcctccaggctcctcatctttgattcatccagcagggccacgtggcatcccagacaggttcagtggcagtgggcgtgggacagcttcagtctcacatcagcagactggancctagaagtatttgctagtgttattatgtactagactaagttagtggttacgcccttacccccgtaggtaccggttcggaccccgaaggggtaccctaagtagggtacggtaaagtacccgtaaaacggtaaaccgttggttacgggtccgttacggacctaacccgtacttaccggttacgttccgttccgttaacccg

SEQ ID NO: 259320 - DNA, 702 bp, Homo sapiens
  misc_feature: GYAE6OF01D5B95.39.72.G06.1.454.CMB.1.raw
  modified_base (233)..(233): a, c, t, g, unknown or other
  misc_feature (233)..(233): n is a, c, g, or t
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagtaatttgtgttgacgcagtctccaggcaccctgtcttgtctccgagggatagacgccaccctctcctgcgaggccagtcagngtgttagccaccttcttagccgtaggtaccagcaagttaaagttcggccaggtcctaccgaggtcctcctacattccgttttgactttccgattacccgaggccgacgggaccctacgtcggacaacctcccgtaagacgttacggtcaaggtcggactagggtcgggtcgtagggtacaacggtaccttacgaacgtccttaccgaaccgtactaccgacgtacgaacgtaccggtagggacgtaccgttaggaaacgtttagtttcgacgttagttacgtttaatttagtcgttactaagtacgtaagttcgtacggtacgtaccccgtaccccgtaaggttacccggttcggaaccgaacgggtaacaaggttaacgggtacgaaaacgttaaccgtaaacgtaacggttcggtccgacgttacacccgtacgtacgttccgttaacgttcccttacgttaacccg

SEQ ID NO: 259321 - DNA, 750 bp, Homo sapiens
  misc_feature: GYAE6OF01CQLVX.39.72.G06.1.454.CMB.1.raw
  modified_base (468)..(468): a, c, t, g, unknown or other
  misc_feature (468)..(468): n is a, c, g, or t
  modified_base (515)..(515): a, c, t, g, unknown or other
  misc_feature (515)..(515): n is a, c, g, or t
  modified_base (530)..(530): a, c, t, g, unknown or other
  misc_feature (530)..(530): n is a, c, g, or t
tcagtcgcactagtcacgaccggtgctcgatttagctacgactgcaaggggaaagggggaagagctgctcagttaggacccagagggaaccatcggaaaccccagcgcagcttctcttcctcctgctactctggcctccagactaccaccggataattttgtgttgacgcagtctccaggccacctgtctttgcctcgaggggatagacgccctaccctctccgtgccgagggtaccaggtcaggtagtgttacgcctaccttcgttacgccgttacggaaccagacctaaagttaaacgtttcggaccgtaacggccgttacccggacggtccttacccgtcgtttaacttccgttttagtaacgttttaccaacgttaccccgaaggccggtaaccgggaacccttacggtaccggtacccaaccggtaccccgaaggtaaccgtacggttaccgaggttaccggngtaacgggttgggaccgtgggaactacggtactacgtacgtccctanaacctgtaccacgtnacgtacgtgggtacacgtaagtaagtttacgttacgtagtaagttagttattagtttacgaacgtaacgtaactaagttacgttaccggaccttcccgtacccccgtaagtacccgggttaacggaaccggaacggtacgtaggtacggtaacgtaaacgtaaccgaaacgttacggtcgtagaccgtagaccgtacgacttacgtcttcttcgtacccg

SEQ ID NO: 259322 - DNA, 668 bp, Homo sapiens
  misc_feature: GYAE6OF01CIOW6.39.72.G06.1.454.CMB.1.raw
  modified_base (294)..(294): a, c, t, g, unknown or other
  misc_feature (294)..(294): n is a, c, g, or t
tcagtcgcactagtcacgaccggtgctcgatttagctacgactgcaagggaaagggggaagagctgctcagttaggacccagagggaaccatggaaaccccagcgcagcttctcttcctcctgctactctggctcccagatacccaccggagaattttgtgttgacgcagtctccaggcaccctgtctttgtctccaggggatagagcccaccctctcctgcagggccagtcagagtgttagcacctccttagcctggtaccagcagtaatttggccaggctcccaggctcctnatctttgattcatccagcagggccacgtggcacgtccccaggacctaggttcaggttcggcgtagggtcgggtcgtaggggaacacggtacttcgacgttcctacgaaccctagtccgaacgacgtacgtaaccgtgggacgtaccgtaggtaaacgttagttttacggacgttaaggttagtttacgtttacgttacgttacgtacgtacttaaagttagtacggttaccgtccccgtacccccgtacggtaccggttccggaccgtaacgggtaaccgtacggtaggttaacggaaaccgtacgtaaaaccggtaacgtaggtcggtaccgtacggacctacgtacgttaccgttcgttaccttcgtacccg

SEQ ID NO: 259323 - DNA, 778 bp, Homo sapiens
  misc_feature: GYAE6OF01AJ79X.39.72.G06.1.454.CMB.1.raw
  modified_base (218)..(218): a, c, t, g, unknown or other
  misc_feature (218)..(218): n is a, c, g, or t
tcagtcgcactagtcacgaccggtgctcgatttagctacgactgcaagggaaagggggaagagctgctcagttaggacccagagggaaccatggaaaccccagcgcagcttctcttcctcctgctactctggctcccagatacccaccggagaatttgtgttgacgcagtctccaggcaccctgtctttgtcctccgaggggatagacgcccaccctntcctgccagggcccagtccagtagtgttagccacctccttagcctggtaccagcagaattggccaggctcccgaggtcctccgtctatctttgactttcgactccgagtcgaagggccctacgtcggaccactccccgagtacaggtttccaggttcggacctagggtcgggtccgtaggggaacctaacggtcctttacgacggttccctaccgtaacccaagtttaccgaacggtaccgtaacggtaaccggttacgggtaaccggtacccggttaacgggtaaaacgttacgtttttaacgggaccgttaacgggtttaacggttaagttttacggttacggttaccgtaaggtacccgttaaagttacgttacgggtaaccgtaccccgttaccccccgtaaggttacccggttaccgggtacccggtaaaccgggacccgttaagttacgggtaaccggtaaaacgtacccggtaaaaccggtacgttacgggtaccggtaccgttacggacccgtaaccgtacgttaccttacggttacccgttcgttaccccg

SEQ ID NO: 259324 - DNA, 652 bp, Homo sapiens
  misc_feature: GYAE6OF01CZTS7.39.72.G06.1.454.CMB.1.raw
  modified_base (153)..(153): a, c, t, g, unknown or other
  misc_feature (153)..(153): n is a, c, g, or t
  modified_base (160)..(160): a, c, t, g, unknown or other
  misc_feature (160)..(160): n is a, c, g, or t
  modified_base (318)..(318): a, c, t, g, unknown or other
  misc_feature (318)..(318): n is a, c, g, or t
  modified_base (337)..(337): a, c, t, g, unknown or other
  misc_feature (337)..(337): n is a, c, g, or t
  modified_base (390)..(390): a, c, t, g, unknown or other
  misc_feature (390)..(390): n is a, c, g, or t
  modified_base (396)..(396): a, c, t, g, unknown or other
  misc_feature (396)..(396): n is a, c, g, or t
tcagtcgcactagtcacgaccggtgctcgatttagctacgactgcaagggaaagggcgaagagctgcttcagttaggacccagagggaaccatggaaaccccagcgcagcttactcttcctcctgctactctggctcccagataccaccgganaatttgngttgacgcagtctccaggcacctgtcttgtctccgaggggataggacgcccacccgtctccgtcgcgacgggcctagtccagagtcgttacgcctacctccttagcctcggtaccagcagaattgccaggcctccagctcctcatcttgacttcatcngcaggccactgcatcccanaccgagttccgagtcggactaggtcgggtctagggacagtacttcgacgttcncaaccngtaccagaccgagacgtaggacgtccgtagtaagtattttagacgtagttagttaacttaagtttgtacgtagtaccgtaaagttagtaacgggtaccggtacccttacccccccgaaggttaacccggtttaccggggtaacccaaacggggtaacccgtaacggtaccgggttaacggaaaacgtaccgtaaaaccggtacgtacggtacggtaccgtacgtaccgaacccgatttccgtggttcctttacccg

SEQ ID NO: 259325 - DNA, 580 bp, Homo sapiens
  misc_feature: GYAE6OF01AZ5QN.39.72.G06.1.454.CMB.1.raw
  modified_base (296)..(297): a, c, t, g, unknown or other
  misc_feature (296)..(297): n is a, c, g, or t
  modified_base (387)..(387): a, c, t, g, unknown or other
  misc_feature (387)..(387): n is a, c, g, or t
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaattttgtgttgacgcagtctccaggcaccctgtctttgtctccgaggggatagagccaccctctcctgcagggccagtcagagtgttagcacctccttagcctggtaccagcagaaatttggcaggctccaggctctcatcttnnttcatccagcgagggccacgtggcactcccagacaggttcagtcggcaggtgggtcgtgggacagcttcagtctcacatcagcagctggngcctagagtatttgctattgttattagttagtcagtactaattgtaggtacgccccttacccccgaggtacccggttaccggacccgtaacgggacctaggtacggtaacggtaaacgtaaccgtaaacggtaaccgttaggtcggccttacggaccgtaacccgtattaccgtcgttccgttcccgttaccg

SEQ ID NO: 259326 - DNA, 729 bp, Homo sapiens
  misc_feature: GYAE6OF01B2ECE.39.72.G06.1.454.CMB.1.raw
  modified_base (364)..(364): a, c, t, g, unknown or other
  misc_feature (364)..(364): n is a, c, g, or t
  modified_base (417)..(417): a, c, t, g, unknown or other
  misc_feature (417)..(417): n is a, c, g, or t
tcagtcgcactagtcacgaccggtgctcgatttagctacgactgcaaggggaaagggggaagagctgctctagttaggacccagagggaaccatggaaacccagcgctagcttctcttcctcctgctactctggctaccagagtaccacggagaatttgtgttgacgcagtctccaggcacctgtctttgctccgaggggatacgacgtccacccgtctccgtgcacgggccaaggtcaggtagtgttaacgctacctcttagccgtggtaccagacaagtaattcggccaggcctaccgaggtcctcgtcattcttgacttcatccagcagggccagtcgactacgtccagacctaacggttnaacggtcggcgtagggtcgggtacgagggacagtactcgacgtcttacacgtntacgacgtacaaggtacgtcggacgtaccgtaagtaacgttacgtttacggacgtttaagggttattttaacgttaacgtttcggaacctaaagggttacttaaacgggttaggtaccgggttaacccgtcccccgtttaaccccggtaagggttacccggttaccgggtaaccggaacgggtacccgtaaagggttaccgggtaaacgttaaaaacgtaccggtaaaaaccggttaggtccggtaccgttaacggaccgtaacccgtaaccgttacgtttcccttacggtttaacccgtcttaaaccccgg

SEQ ID NO: 259327 - DNA, 554 bp, Homo sapiens
  misc_feature: GYAE6OF01BE3TP.39.72.G06.1.454.CMB.1.raw
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaattttgtgttgacgcagtctccaggcaccctgtctttgtctccaggggatagagccaccctctcctgcagggccagtcagagtgttagcacctcttagcctggtaccagcagaaatttggccaggctcccaggctcctcatctttgatttcatccagcagggccactggcatccccagacaggttcagtggcagtgggtctggggacagacttcagtctcaccatcagcagactggacgcctagtaagtattttgctagttagttattagttgtcagtcaatagtaggtacgccgtacccccagtaccgttcggaccgaacgggtaccagtcggtacggtaaagtaccgtaaacgaactggtcggtacgtgaccgtaccctataccgtcgttcttcgtaccg

SEQ ID NO: 259328 - DNA, 634 bp, Homo sapiens
  misc_feature: GYAE6OF01DKDTA.39.72.G06.1.454.CMB.1.raw
  modified_base (494)..(494): a, c, t, g, unknown or other
  misc_feature (494)..(494): n is a, c, g, or t
tcagtcgcactagtcacgaccggtgctcgatttagctacgactgcaagggaaagggggaagagctgctcagttaggacccagagggaaccatggaaaccccagcgcagcttctcttcctcctgctactctggctccagataccaccggagaatttgtgttgacgcagtctccaggcaccctgtctttgtctccgaggggatagacgcccaccctctcctgcaggccagtcagagtgttagccacctcgttagcctggtaccagcagtaattggacaggcctccgaggtctcctcatcgtttgatttcgacttccaagcacgggtaccacgtggcctacgtcccgaagtaccgtaggttacaggtacggacgtaggttcggggtacgtagggaactacggtacttcgacgttccacaccgtagtcacgactagtacgtaggacgtaccgtagtaacgttacgttttacgacgttagtacgttatttagttacgtntaacgtacaagttacgtggtaactcccgtaccccgtagtaccggttcggaaccgtacggactagtacggagtaaacgtacgtaaacgtagtacggtcggtacgacgtacctaactacttaccttcgttacgtcttacccg

SEQ ID NO: 259329 - DNA, 722 bp, Homo sapiens
  misc_feature: GYAE6OF01CDY7Y.39.72.G06.1.454.CMB.1.raw
  modified_base (247)..(247): a, c, t, g, unknown or other
  misc_feature (247)..(247): n is a, c, g, or t
tcagtcgcactagtcacgaccggtgctcgatttagctacgactgcaagggaaagggggaagagctgctcagttaggacccagagggaaccatggaaaccccagcgcagcttctcttcctcctgctactctggctcccagatacccaccggagtaatttgtgttgacgcagtctccgaggccaccctgtctttgtctccgaggggataggacgcccaccctctcctgcgacggccagtcagagtgtanctacctctagcctaggtaccagcaagtaattcggcctaggcctccgagcctctctattcttgactcactccagcgtacggcctacgtcggaccaccgtaccccgaggtaaccgtacgggttacgacggtcggacgtagggttcggggtcgtacgggtactaacggttaccttacgtacgttacctaccgaaccgtagtacgaacgaccgtaacggtacggtagggacgtaccgttagtaacgttagttttacgacgttaggtttagttacgtttacgttacggtcgtaacgtaacttaaaggttcgttaacggtacccgttaccccgtaccccccgtaaggttacccggttaaccggaacccggtaacggtaaccgtaggtaacgggtaacgtaaacgtaaccggaaaacgtacgtacggttacggacgtacgaccgttacgtaaccgttaccgtcgttaccgttacgttacccg

SEQ ID NO: 259330 - DNA, 775 bp, Homo sapiens
  misc_feature: GYAE6OF01CQ5MY.39.72.G06.1.454.CMB.1.raw
tcagtcgcactagtcacgaccggtgctcgatttagctacgactgcaagggaaagggggaagagctgctcagttaggacccagagggaaccatggaaaccccagcgcagcttctccttcctcctgctactctggctcccagataccaccggagaattttgtgttgacgcagtctccaggcaccctgttctttgtctccgaggggatagacgcctaccctctcctgcgagggccagtcaggtagtgttacgccaccttccttacgccttggtaccagcaagtaaacttcggccaggcctccgagcctcctctattcgtttgacttcactccgtagcgacgggtccacgttcggacctacgtacccgagtacgtaacggtttcgaggttcggcgtagggttcgggtacgtacggggactacggtaccttacgtacggtcctaaccgtaacccattaccgaacgacgtaacggtacgtacgggtacggtacccgttaaggtaaacggtttacttttacggtacgttaagttttaggtttaacgtttagtttacgttaccggtaagttaaccttaaaggttacggttaacgttaaccggtaccccgttaaccccccggtagggttacccgggttaccgggtaaccccggtaacggggtaccgtaaacgggttacgggtaacggtaaaacgttaacccggtaaaaccggtacggttacggtccgggtaccttacggaaccttaacccgtacttaccgttacggttcctttacgttaccccg

SEQ ID NO: 259331 - DNA, 685 bp, Homo sapiens
  misc_feature: GYAE6OF01AZHJH.39.72.G06.1.454.CMB.1.raw
  modified_base (244)..(244): a, c, t, g, unknown or other
  misc_feature (244)..(244): n is a, c, g, or t
tcagtcgcactagtcacgaccggtgctcgatttagctacgactgcaagggaaagggggaagagctgctcagttaggacccagagggaaccatggaaaccccagcgcagcttctcttcctcctgctactctggcctccagataccaccggagtaatttgtgttgacgcagtctcagcaccctgtctttgtctaccgaggggatagacgccaccctctcctgcacgggcctagtcagtagtgtacnctacctcttagccgtagaccagcgaagtaacttggcacgcctcccgaggtcctccgtactacttctttagtctttacacgtccacgtcgacgggcctacgtcggcctacctaccgaacgtacgtacggttaccagggtacgtaccgtacgggttgggtccgtacgggacgttacgtaccttacggaacgttcctaccgtaaccagttacgacgtcgaacgtacggttacggacggttaccgtaggttaaacgttcgtttacggtacgtacggtttaacgtttacttagtttcggactacggtaacttagtacgtcggtaccctacccgacccgttagttaccggttccggaaccgtacgggtagtacggttagaaacggtaaacaacgtaacggtacgtgtacggacgtacacgtactcggttatccgtacctttgacccg

SEQ ID NO: 259332 - DNA, 750 bp, Homo sapiens
  misc_feature: GYAE6OF01ESGRH.39.72.G06.1.454.CMB.1.raw
  modified_base (248)..(248): a, c, t, g, unknown or other
  misc_feature (248)..(248): n is a, c, g, or t
tcagtcgcactagtcacgaccggtgctcgatttagctacgactgcaagggaaagggggaagagctgctcagttaggacccaggagggaaccatggaaaccccagcgcagcttctcttcctcctgctactctggcctccagatacccacgggagtaattttgtgttgacgcagtctccgaggcaccctgttcgtttcgtctccgaggggtatacggcgccctaccctctcctgcgacgggccagtcagngttgtacgcctaccttccgttacgccgttaggtaaccagtaccaagtaacgtttcggaccgtacggtccctacccgtacggtacccttcctacctactttaccgtttacgtactttacgtaccgttacccgacggtaccggaaccgggccctaaccggttcggacctaccgtacccgacggtaaccgttcgggttaccaggttcggacggtagggttcggggtacgtagggaactacgtaccgttacgtacgtcctaccactactacgagcgtacgacggtggacgtccgtagtacgttatttggacgttagttacggtttattacttcggtactagtacgtaagtcgttacggaaccgtaccccgtacccggtaggttacccggtacggtaaccggacggtaacgtacgggttaacggtaacggtaaataccgtaaaacgtaggtacggtacggtacgtaccaccggtaacttccggttaatccggttatacggttacccg

SEQ ID NO: 259333 - DNA, 924 bp, Homo sapiens
  misc_feature: GYAE6OF01BYO47.39.72.G06.1.454.CMB.1.raw
tcagtcgcactagtcacgaccggtgctcgatttagctacgactgcaagggaaaggggaagagctgctcagttaggacccagaggaaccatggaaaccccagcgcagcttctcttcctcctgctactctggcctcccagactacccaccggaagtaatttgtgttagacgcagtcctccgaggcctacccgtgtctttgtcctccggagggtatacgacgtccctacccgttctccgtgcgacgggcctagtcgaagtagttagtacgcctaccgttccgttacggcccgttaggtaacccagtacgtaaggttaaacgtttcggacccggtaacggtcccgtaccccgaacggtcccttcccgttacgttaccgtttccgtttacggtactttccgtaacgttacccgacggaccggtaccggacccgtaaccggtaccggtacctaacccgtaccccgtaacggtaccggtaacggttaccgtaagggtaccggtacggtacggggtttacgggttacgtacggggtaaccgtaacggttacccgtttacgtacgttacccttaacgaacttaaccggtacgaaccggtacccgtaaggttaacggaccgggttagtaacccggttaaggttaaacggttttacgttttaccgaagtttacgtttaacgttttagtttacgtttagttaccgaacggttaattaacgtttacggttaacgttaacccgttcccccgtaacccggttaccggttaaccggttaccccggaacgtaaccggggtaaccgttaagggttaaccgggtaaaacgggttaaaacccgttaaccggtaaaccgttaacgggtccggttaacggtcctaaccggttacccgttaccggttaaccgttcccgtttaccgttaccgtttccccgttaaccgg

SEQ ID NO: 259334 - DNA, 1109 bp, Homo sapiens
  misc_feature: GYAE6OF01DYY6C.39.72.G06.1.454.CMB.1.raw
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagtaatttgtgttgacgcagtctccaggctacctgtctttgtctccgaggggtatagacgccctacccgttctcctgccgacgggccaggtacagtagttgttacgcctaccgttccttacgccgtacggtaccagtacgtaagttaacgtttcggacctacggtaccctcccgaaggtccttaccctacgtactttcgttttaacggtactttaccgtacgttacccgaacggtaccggtaaccggggtacccttaaccggtccgggtacctaacccgtaccccggtaaacgggtaacggtaacgggttttaccggaacggggtttaccgggtacggtaacgggggtttacggggtaccgttaacggggtaaacccgttaagggttaacccctttaggtaacccgtttacccgttaacccgtaacccgtagttaaccggtacggaaccggttaaacgggttaccgggttacgggtaaccccggttacgggttaaacggtttaaacgggtttaacctttttacgggaaccgtttttaagtttttaacgggtttaaactttttttaacgtttaccggttaaccgttaaacggtaaaccttttaaaacggggtttacggttttaaccggggtaaacccccgtttaccccccccgggttaaacccccgggtttaggggtttaaaacccccggggttttaccccggggaaaacccggggttaaacccgggggtttaacccggttaaagggggtttaacccgggttaaaaaacccggtaaaaacccgtttttaaaaaccccggggaaaacccggggtttaaacggtttttacggggttaaccccggggttaacccggttaaacccggttaaaaccccccggtttaaactttaaccccgggttttttcccccgggtttaaaacgggttttttacccccgtttaaccggttttaaaacccccccggg

SEQ ID NO: 259335 - DNA, 826 bp, Homo sapiens
  misc_feature: GYAE6OF01ECIUC.39.72.G06.1.454.CMB.1.raw
tcagtcgcactagtcacgaccggtgctcgatttagctacgactgcaaggggaaagggggaagagctgctcgagttacggacccagaggaaccatggaaaccccagcgcagcttctcttcctcctgctactctggcctcccagataccaccggtagtatttgtgttgacgctagtctccagccacctgtctttgctcgagggatagcgccctacctctcgtgcgtacgggcctagctagtgttcgttacgcctaccgtccgtttaagccgttacgggaacccagaccgtaagtaaagttttccggaccgaacggtcccttaccgacgggtccctccctagtactttcgtttacggactttaccgacgttaccgaaggcggaaccggaccctacgtacggaaccaaccttacccggaagtaccggttacgttaaccgaggggttacggtaccggtaggttacggggtaccgttacgggggaaactacggttaccggttactacggttacctaccgtaacgtacgttaacgaacgtacccggaacgtacccggtaaggtaccggtaaccgtttaaggtaaacgtttccgttttaacgggaaccgtttaacggtttaagttttaccgttaacgttttggaacccgtaagtaacccgttaaagggttacgtccgggtacgttaacccccccttccccgggaaggttaccgggttaaccccgaacggtaaaggggtccaagggttaaaggtacgaaaccggttaaacgaacgggtacggtcgttcgggaaactccgtaaaccgtctaccgttattccgtacttagtaccccg

SEQ ID NO: 259336 - DNA, 991 bp, Homo sapiens
  misc_feature: GYAE6OF01DRHO4.39.72.G06.1.454.CMB.1.raw
  modified_base (367)..(367): a, c, t, g, unknown or other
  misc_feature (367)..(367): n is a, c, g, or t
tcagtcgcactagtcacgaccggtgctcgatttagctacgactgcaaggggaaagggggaagagctgctcagttacggacccaggacgggaaccatacggaaaccccagccgctagcctttcctccttcctcctgcctactcgtacggcctacccgaagacctaacccgaaccgggtaattaacgttttgggtgttacggaaccgtcgtacggttcccacccggtaggtaccctacccgtttggtttcctttaccggtccgtacccggaaggggtaactacggacccgtacccctaccccgttctcccggtagaaccggtaccggggaacctaggttaccgtaaagggttcgtttacgggtaacccncccgttaacccgtttccggtacggtcccgtaaggttaacccgaagttaacgtaacggttaaccgttccggacccggtacggtaccctacccggtccggtaccttaccttcgtaacgtttacgtttacgtacctttaccaccgttaccgaaacggtcccggtaaaccgggtcccttaacgggccccgtaacgttaaccccggtaaccggtaacgggtaaaccggttacgggttaacgggtaacggtcgggggttaactcggggggtttaaccggtacgtaacggggaaccctaggttaccgtttaacggtccggtaaccttaaccgacgtaagttcccgaaggtaacgtaccggttaaacggccggtaaccggtagtttaaacggtaagtttcgttacggtaaccggtttattaacgtttaacgttacggtaataccggtaaagtaacgttacgtacggttacccggtaccctaccccgtaacgggttaccgtaaccgggtacgtaaccgtaagaaccggttaacggtacgtaaagaaaccgtaaacggtaagtaccgggttcgaacccggtgttaaccgacccgttacttacgttaacccgttacttaccgtcctttaaccccg

SEQ ID NO: 259337 - DNA, 735 bp, Homo sapiens
  misc_feature: GYAE6OF01BDOQT.39.72.G06.1.454.CMB.1.raw
  modified_base (106)..(106): a, c, t, g, unknown or other
  misc_feature (106)..(106): n is a, c, g, or t
tcagtcgcactagtcacgaccggtgctcgatttagctacgactgcaaggggaaagggggaagagctgctcagttaggacccagagggaaccatggaaaccccagcncagcttctctcctctgctactctggctcccacgataccgaccggagtaatttgtgttagacgcagtcctccaggcctaccctgttccgttgtcctcggagggatagacgcccaccctcgtcctcgccgacggccagtacgacggtacgttagtacgccgtaccttccgtacgtcccgtaggtaccacgtactaacgtaaagttcgggaccacgggtcctacccggaggtccctacctacgtacttcgtttagtacttccgactccgagtccggacggtctaccggtcgtacctacgtaccccgaagtaccgtaggttacaggtcggacggtagggtcgtccggtaggtaacgtacggtaccgttacgtacgtaccgtacctaccgtacgtacgacggacgtacggaacgttcgggacctaccggtaagtacgtttacgttggacgtttagttagttacttagtcgtacgtagtactaagtcgtcggtaccctcccgtaaccggtagttcccggttaacccgacggtaaccgtacgtacggtaacggtaccgtaaaaggtaccgtaacggtacgtacggtcgtaccgtcgtaaccgtcccttaaggtccgttaactcccgttacgtcccg

SEQ ID NO: 259338 - DNA, 528 bp, Homo sapiens
  misc_feature: GYAE6OF02JWWEQ.39.72.G06.1.454.CMB.1.raw
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaatttgtgttgacgcagtctccaggcaccctgtctttgtctccaggggatagagccaccctctcctgcagggccagtcagagtgttagcacctccttagcctggtaccagcagaaattggccaggctccaggctcctcatctttgattcatccagcagggccactggcatcccagacaggttcagtggcagtgggtctgggacaggagttcagtctcaccatcagcagcctgcagtctgaagtattttgtactttattacttgtcagtctagtatgattaccgtggtcctactactacgttttcggccgtaagggtacctagggttggagtagtacgaacgtacgtcgtagcgtacgcaccgtatcgtgttcttacg

SEQ ID NO: 259339 - DNA, 506 bp, Homo sapiens
  misc_feature: GYAE6OF02ICES5.39.72.G06.1.454.CMB.1.raw
  modified_base (503)..(503): a, c, t, g, unknown or other
  misc_feature (503)..(503): n is a, c, g, or t
tcagtcgcactagtcacgaccggtgctcgatttagctacgactgcaagggaaagggggaagagctgctcatttaggacccagagggaaccatggaaaccccagcgcagcttctcttcctcctgctactctggctcccagataccaccggagaatttgtgttgacgcagtctccaggcaccctgtctttgtctccaggggatagagccaccctctcctgcagggccagtcagagtgttagcacctcttagcctggtaccagcagaaatttggccaggctcccaggctcctcatctttgattcatccagcagggccactggcatcccagacaggttcagtggcagtgggtctgggacagacttcagtctcaccatcagcagactggagcctgaagatttgctagtgtattattgtcagcaatatggtagctcccccgagaccgttacggccaaggaccagtggtaggaatacgaaacgaactagtggactgcaccatctgttctntac

SEQ ID NO: 259340 - DNA, 547 bp, Homo sapiens
  misc_feature: GYAE6OF02F6PJE.39.72.G06.1.454.CMB.1.raw
  modified_base (362)..(362): a, c, t, g, unknown or other
  misc_feature (362)..(362): n is a, c, g, or t
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaatttgtgttgacgcagtctccaggcaccctgtctttgtctccaggggatagagccaccctctcctgcagggccagtcagagtgttagcacctccttagcctggtaccagcagaaatttggccaggctcccaggctcctcatcttgattcatccagcagggccactggcatcccagacaggttcagtggcagtgggtctgggacagacttnagtctcaccatcagcagactggagcctagaagtagtttgcgtagttgttaagttattgtacagctaagtagtggtagtccctacccccgagtaccggttacggccgaaacgggtaccagtacgggtacggaaactacgaaaacgtaacgtaggtacggtcgtagacaccgtatctagtcttctac

SEQ ID NO: 259341 - DNA, 520 bp, Homo sapiens
  misc_feature: GYAE6OF02JEH42.39.72.G06.1.454.CMB.1.raw
  modified_base (433)..(433): a, c, t, g, unknown or other
  misc_feature (433)..(433): n is a, c, g, or t
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaatttgtgttgacgcagtctccaggcaccctgtctttgtctccaggggatagagccaccctctcctgcagggccagtcagagtgttagcacctccttagcctggtaccagcagaaatttggccaggctccaggctcctcatctttgattcatccagcagggccactggcatcccagacaggttcagtggcagtgggtctgggacagacttcagtctcaccatcagcagactggacgcctagaagtatttgctagtgttattattgtacagtcaatatggtancctccccgagtaccgttcgaccgaaggaccgagtaggtagaatacgaaacgtactacggtgcgtacgcgacctatctcgttctctac

SEQ ID NO: 259342 - DNA, 604 bp, Homo sapiens
  misc_feature: GYAE6OF02JQ678.39.72.G06.1.454.CMB.1.raw
  modified_base (289)..(289): a, c, t, g, unknown or other
  misc_feature (289)..(289): n is a, c, g, or t
  modified_base (353)..(353): a, c, t, g, unknown or other
  misc_feature (353)..(353): n is a, c, g, or t
  modified_base (388)..(388): a, c, t, g, unknown or other
  misc_feature (388)..(388): n is a, c, g, or t
tcagtcgcactagtcacgaccggtgctcgatttagctacgactgcaagggaaagggggaagagctgctcagttaggacccagagggaaccatggaaaccccagcgcagcttctcttctcctgctactctggctcccagataccaccggagaatttgtgttgacgcagtctccaggcaccctgtctttgtctccaggggatagagccaccctctcctgcagggccagtcagacgtgttacgcacctccttagcctggtaccagcagaattggccaggctcccagctcctnatcttgattcatcagcaggccactggcatcccagacaggttcagtcggcaggtggtctgggacngtacttcgagtctacacgatcgagtcagactggcnccgtagagtagtttcgaccgtagtagttagtttaattgtacctagtaccgtaagttagtcggttaacgtcccgttacccccgaaggtaccggtttaccgaccgtaaacgggacctagttacgggtacgtaaactaccggaaacggtaaaccgttggtaacggtccgttaacggaccgtaacccgattacccggtacgtttcccgttacttaacccg

SEQ ID NO: 259343 - DNA, 533 bp, Homo sapiens
  misc_feature: GYAE6OF02JE9KO.39.72.G06.1.454.CMB.1.raw
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaatttgtgttgacgcagtctccaggcaccctgtctttgtctccaggggatagagccaccctctcctgcagggccagtcagagtgttagcacctccttagcctggtaccagcagaaatttggccaggctcccaggctcctcatctttgattcatccagcagggccactgcatcccagacaggttcagtgcagtgggtctgggacagacttcagtctcaccatcagcagactggagcctagaagtatttgctagtgttattattgtctagctaatatggtagtccgtcccccaggtaccgttcggaccgaagggtaccctagtcggtagaaagtcgaaacgaacgttggtaggactgacaccgtactctacggttccttgtacg

SEQ ID NO: 259344 - DNA, 540 bp, Homo sapiens
  misc_feature: GYAE6OF02GQKJB.39.72.G06.1.454.CMB.1.raw
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaatttgtgttgacgcagtctccaggcaccctgtctttgtctccaggggatagagccaccctctcctgcagggccagtcagagtgttagcacctccttagcctggtaccagcagaaatttggccaggctcccaggctcctcatctttgattcatccagcagggccactggcatcccagacaggttcagtggcagtgggtctgggacagacttcagtctcaccatcagcagactggagcctgaagtatttgctagtgttattattgtcagctaatagtggtacgcctcccccagtaccgttccggccgaacgggacctagtagggtacggaaacgttaccgaaacgtaacgtggtacggtacgtggaccacctagtacctgttccttctac

SEQ ID NO: 259345 - DNA, 548 bp, Homo sapiens
  misc_feature: GYAE6OF02H6BAE.39.72.G06.1.454.CMB.1.raw
  modified_base (431)..(431): a, c, t, g, unknown or other
  misc_feature (431)..(431): n is a, c, g, or t
tcagtcgcactagtcacgaccggtgctcgatttagctacgactgcaagggaaagggggaagagctgctcagttaggacccagagggaaccatggaaaccccagcgcagcttctcttctcctgctactctggctcccagataccaccggagaattttgtgttgacgcagtctccaggcaccctgtctttgtctccaggggatagagccaccctctcctgcagggccagtcagagtgttagcacctcttagcctggtaccagcagaaatttggccaggctcccaggctcctcatctttgattcatccagcaggccatggcatcccagacaggttcagtgcagtggtctgggacagacttcagtctcaccatcagcagacgtggagcctagaagtatttgactagtgtatttattgtctagctaatatggtacncctaccccgtagtaccgttacgaccgtaacggacctagtacggtaggaaacgtaccgaaacgtaacgttaggtacggtacgtacgacgaccgtacgttactacgttaccttataccg

SEQ ID NO: 259346 - DNA, 546 bp, Homo sapiens
  misc_feature: GYAE6OF02FWLHO.39.72.G06.1.454.CMB.1.raw
  modified_base (291)..(291): a, c, t, g, unknown or other
  misc_feature (291)..(291): n is a, c, g, or t
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaatttgtgttgacgcagtctccaggcaccctgtctttgtctccaggggatagagccaccctctcctgcagggccagtcagagtgttagcacctccttagcctggtaccagcagaaatttggccaggctcccaggctcctnatctttgattcatccagcagggccactggcactcccagacaggttcagtggcaggtgggtctgggacagacttcagtctcacctatcagcagactggacgcctagaagtatttgctagtgttattattgtacagcaatagtggtagccgtccccagtacgttcgaccgaacggaccagtacggtagaactacgaaacgtaaccgttaggtcggtacgtaggacctaaccgtacttccgttcgttccttactaccg

SEQ ID NO: 259347 - DNA, 569 bp, Homo sapiens
  misc_feature: GYAE6OF02HDGRM.39.72.G06.1.454.CMB.1.raw
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaatttgtgttgacgcagtctccaggcaccctgtctttgtctccaggggatagagccaccctctcctgcagggccagtcagagtgttagcacctccttagcctggtaccagcagaaatttggccaggctcccaggctcctcatctttgattcatccagcagggccactggcatcccagacaggttcagtggcagtgggtctgggacagacttcagtctcaccatcagcagactggagcctgaagtatttgactagttgttatttagttgttcagtactaattagtggtacgtccgtacccccgtaggtaccgttaccggaccgtaaacgggaccgtagtacgggtaggaaacgtacgaaacggtaacgtggtacggtacgtacggacctaccgtacgttaccgtcgttccttactaccg

SEQ ID NO: 259348 - DNA, 525 bp, Homo sapiens
  misc_feature: GYAE6OF02IBYT7.39.72.G06.1.454.CMB.1.raw
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaattttgtgttgacgcagtctccaggcaccctgtctttgtctccaggggatagagccaccctctcctgcagggccagtcagagtgttagcacctcttagcctggtaccagcagaaatttggccaggctcccaggctcctcatctttgattcatccagcagggccactggcatcccagacaggttcagtggcagtgggtctggggacagacttcagtctcacatcagcagactggagcctagaagtagtttagcgtagtgttatttattgtcagcaatatggtagtctaccccgagtacgttcgccgaaggaccagtggtagaaactacgaaacgtaactggtacggctagctactactcttcgtacttctaccg

SEQ ID NO: 259349 - DNA, 647 bp, Homo sapiens
  misc_feature: GYAE6OF02IQIAW.39.72.G06.1.454.CMB.1.raw
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaattttgtgttgacgcagtctccaggcaccctgtctttgtctccaggggatagacgccaccctctcctgcgacgggccagtcagtagtgttagccacctccttagcctggtaccagccaagtaaatttcggaccaggcctcccaggcctcctcattctttgacttcatccgagcgacgggccacgtggaccactcccagaccgtaggttccaggtggctagggtcgggtctgggacaggtacttcgagtcctaccgacactcgacgcaagacgtggacgccgtagaacgttacgtttgaccgtagttagttaatttacgttcgtacgtagtactaagttagtggtaccgtccctaccccgaagtaccggtttaccggaccgtaaacgggtaccgtagttacgggtacggtaaacgtaccggtaaaaccggtaacgttacgggtacggtaccgtacgaccgtaaccgtaacttccgttacgtttacctacttacccg

SEQ ID NO: 259350 - DNA, 546 bp, Homo sapiens
  misc_feature: GYAE6OF02FHFI2.39.72.G06.1.454.CMB.1.raw
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaatttgtgttgacgcagtctccaggcaccctgtctttgtctccaggggatagagccaccctctcctgcagggcccagtcagagtgttagcacctccttagcctggtaccagcagaatttggccaggctcccaggctcctcatcttgattcatccagcaggccactggcatccccagacaggttcagtggcaggtgggtctggggacagacttcagttctcaccatcagcagactggagcctgaacgtatttgcagttgttattattgtcagtctaattagttggtacgccctaccccccgagtaccgttccggaccaaacgggacctacgtggtaggaaataccgaaaacgaacgttaggtacggtctagaccacctattcctcgtcttctaccg

SEQ ID NO: 259351 - DNA, 580 bp, Homo sapiens
  misc_feature: GYAE6OF02GU9MG.39.72.G06.1.454.CMB.1.raw
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaatttgtgttgacgcagtctccaggcaccctgtctttgtctccaggggatagagcccaccctctcctgccagggccagtcagagtgttagccacctccttagcctggtaccagcagaaatttggccaggctcccaggctcctcactctttgattcatccagcagggccacgtggcactcccagacaggttcagtggacgagtgggtctgggacagtacttcgagtctcacctatacgacgcagacgtggacgcgtagtaagtagtttgacgtagttgttagtttagttgtacgagtactaattagtacggtacgtccctaccccgagtaccggttaccggaccgtaaacgggacgtacgtaggtacgaactacgaaacgtacgtacggtacgtacgtgaccgtacctagttcctacgttcgttctaccg

SEQ ID NO: 259352 - DNA, 598 bp, Homo sapiens
  misc_feature: GYAE6OF02IDCNU.39.72.G06.1.454.CMB.1.raw
  modified_base (234)..(234): a, c, t, g, unknown or other
  misc_feature (234)..(234): n is a, c, g, or t
  modified_base (241)..(241): a, c, t, g, unknown or other
  misc_feature (241)..(241): n is a, c, g, or t
  modified_base (291)..(291): a, c, t, g, unknown or other
  misc_feature (291)..(291): n is a, c, g, or t
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaattttgtgttgacgcagtctccaggccaccctgtctttgtctccaggggatagagccaccctctcctgcagggccagtcagngtgttancacctcttagcctggaccagcagaaatttggccaggctcccaggctcctnattctttgatttcatccagcaggtccactggcactcccagacaggttcaggtggcaggttcgggtcgtggactagacttcagtctccaccatcgagcagacgtaggacgccagtaagtagtttagcgtagttagttaagtttagttagttacgtagtacaaagttagttaggtacgtccctacccccgtaagtaccggttaccggaccgaaacgggaccgtagttacggtagtaaactaaccggaaacgtaacgttaggtacggtcgtacgaccgtaaccgtacttaccgtcgttaccttcttaccg

SEQ ID NO: 259353 - DNA, 575 bp, Homo sapiens
  misc_feature: GYAE6OF02FK99F.39.72.G06.1.454.CMB.1.raw
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaatttgtgttgacgcagtctccaggcaccctgtctttgtctccaggggatagagccaccctctcctgcagggccagtcagagtgttagcacctccttagcctggtaccagcagaaatttggccaggctcccaggcctcctcatctttgattcatccagcagggccatggcatcccagacagttcagtgcagtgggtctgggacagacttcgagtctcaccatcagcagactggacgctagagtatttgctagttgttattattgtctagactaagttataggttacgtccctacccccgtagtaccggtttccgggaccgtaaacgggtacctaacggttacggtaggaaacgtaccgtaaaaccggtaacgttacggtacggacgtacgaccgtaccgtagttccgtacgttaccttacgtac

SEQ ID NO: 259354 - DNA, 578 bp, Homo sapiens
  misc_feature: GYAE6OF02H1CXU.39.72.G06.1.454.CMB.1.raw
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaattttgtgttgacgcagtctccaggcaccctgtctttgtctccaggggatagagccacctctcctgcagggccagtcagagtgtagcacctcttagcctggtaccagcagaatttggccaggctccaggctctcatcttgattcatcagcagggccactggacactcccgagacaggttacaagttcggacaggttgggtcgtggggaactaggacttcgaagtcgtacaccatccgagacagacgtggacgctagaagtatttgcgtagtagttattattgtactagtacaaagttataggtacgacctaccccgagtaccgttaccggaccgaacggaacctagtcggtagaacgttacgaaacgtaacttaggtcggtacgtacgtaccaaccgtagttaccgtacgttaccgttcctaaccg

SEQ ID NO: 259355 - DNA, 668 bp, Homo sapiens
  misc_feature: GYAE6OF02JK1EZ.39.72.G06.1.454.CMB.1.raw
  modified_base (228)..(228): a, c, t, g, unknown or other
  misc_feature (228)..(228): n is a, c, g, or t
  modified_base (270)..(270): a, c, t, g, unknown or other
  misc_feature (270)..(270): n is a, c, g, or t
  modified_base (283)..(283): a, c, t, g, unknown or other
  misc_feature (283)..(283): n is a, c, g, or t
  modified_base (317)..(317): a, c, t, g, unknown or other
  misc_feature (317)..(317): n is a, c, g, or t
  modified_base (503)..(503): a, c, t, g, unknown or other
  misc_feature (503)..(503): n is a, c, g, or t
  modified_base (523)..(523): a, c, t, g, unknown or other
  misc_feature (523)..(523): n is a, c, g, or t
tcagtcgcactagtcacgaccggtgctcgatttagctacgactgcaagggaaagggggaagagctgctcagttaggacccagagggaaccatggaaaccccagcgcagcttctcttcctcctgctactctggcctacccagataccaccggagtatttgtgttgacgcagtcctccgaggctacccgtgtctttgtcctccgagggatacgacgccctacctcgtccngcgagggccagtcgagatgtacgcctactcgtagctcgtacngcagatggcagcncgagtcactcatcttgattcactccgagtaccgnggacctacgtggaccactcccaggtactacggttctacggtcgacgtaggttcgggtacgtacggacgtgtaaccgttcgtaagtacctaccgacgtatcgtaaacgcgtaaccgacggtaagtcgtacgtgtaacgttgttaacgcgttatacgttattacgttagctaagtactaggttaacgngtaccgtaccgtaaccccgngtttacccggtacggtaaccgaccggtaacgtaccggttaaggtaaccggtaaacgtttaaccgaaacccggtaagtttaccgggtaacgaacgtttcggaaccctacggtaaccgtttacacggttttacccacgtttacccgg

SEQ ID NO: 259356 - DNA, 619 bp, Homo sapiens
  misc_feature: GYAE6OF02H9WUO.39.72.G06.1.454.CMB.1.raw
  modified_base (217)..(217): a, c, t, g, unknown or other
  misc_feature (217)..(217): n is a, c, g, or t
  modified_base (239)..(239): a, c, t, g, unknown or other
  misc_feature (239)..(239): n is a, c, g, or t
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagaatttgtgttgacgcagtctccaggcaccctgtctttgtctccaggggatagagccaccctctccngcagggccagtcagagtgttancacctcttagctggtaccagcagaattgcaggctccagctcctcatcttgattcatccagcaggccagtcgcactcccagactaggttcaggtcggcgtaggtcgggtcgtgggactagtaccttcgaacgttcctcgacctatccagacagacgtaggacgtaccgtagtaacgtatttacggacgtaggtttaggttaacttttagttaggtacctaagtactaagttaacggttacgggtacgtcccctacccccgaaggttacccggttaccggaccgtaaacgggacctaggtacggtaacgtaacgtacgaaacggtacgttaggcggtacgtcggtacctaaccgtattaccgttacgttccgttactacccg

SEQ ID NO: 259357 - DNA, 828 bp, Homo sapiens
  misc_feature: GYAE6OF02HU606.39.72.G06.1.454.CMB.1.raw
tcagtcgcactagtcacgaccggtgctcgatttagctacgactgcaagggaaagggggaagagctgctcagttaggacccagagggaaccatggaaaccccagcgcagcttctcttcctcctgctactctggctcccagataccaccggagatttgtgttgacgcagtctccaggcaccctgtctttgtctccgaggggatagacgccaccctctcctgcagggccagtcaggagtgttagccacctcttagcctggtaccagactagtaatttcggccacggcctacccaggcctcctctattcttagtacttcactaccgaggccgtaacgggtaccctacggtacggacctaaccgttaccccgaagtaccgtacgggtttaccgaacgggtttacggaccggttaaggggttcgggggttacccggtacggggtaaacccgtacgggttaacccggttttccgtaacggttcccgttaacccgtaaacccgttaccgttaccggaaccggtaccgtaaaccggtaccgggtacgggtaaccgtacccggttaagggtaaacgttttacgttttacgggtaaccgtttaacggtttaaggtttaaacgttttacgtttacgttaacgtaacgtacgttaaacgttacggttacgggttaacccgtccccgtaacccccggttaggttacccggttaccggtacccggtaaacggtaaccgtacggttaggggtacgttaaaccggtaaccgtaaacggtaaccgttacgggtaacgccgtacgacccgttacgtaccgttaccgttaccgttacttacgtacccg

SEQ ID NO: 259358 - DNA, 802 bp, Homo sapiens
  misc_feature: GYAE6OF02G31XK.39.72.G06.1.454.CMB.1.raw
tcagtcgcactagtcacgaccggtgctcgatttagctacgactgcaaggggaaagggggaagagctgctcagttaggacccagagggaaccatggaaaccccagcgcagcttctcttcctcctgctactctggctccagataccacggagtaatttgtgttgacgcagtctccaggcaccctgtcttgtctcgaggggatagacgcccacctctcctcgcgacgggccagtcaggtacgttgttacgcctaccgttccttaggccgtacggtaccagactaagtaaacgtttcggaccgtacggtcctacccgaggcccttacctacgtactttcgtttagacttaccactaccgagtccggaacggggcccctaacggtggaccctaacccgtaccgaacgtaaccgtacgggtttccacggggttccggaggtaagggttcggggtacgtacggggtaacgtacggttaccgttgtaaccggttcctacccaaccgtacgtcgtacggacgaacggtacggtagggaacgtccgtaaagtaaacgtttcgttaacggacgttaggttactttaaagttcgtttacgacttacgtaactaagttacgtacggttacccgtacccgtaccccgtaggtacccgttaaccggaccgaaacgggtacgtaacggtaaccgggtaagtaaaccgtaaaccggttaaaacccggtacggttaacgggtaccggtaaaccggttccgtaaacccgtaaccggttaccggttaacctttccgggttaaccctttacccggttaccccg

SEQ ID NO: 259359 - DNA, 622 bp, Homo sapiens
  misc_feature: GYAE6OF02HH0P9.39.72.G06.1.454.CMB.1.raw
  modified_base (260)..(260): a, c, t, g, unknown or other
  misc_feature (260)..(260): n is a, c, g, or t
  modified_base (332)..(332): a, c, t, g, unknown or other
  misc_feature (332)..(332): n is a, c, g, or t
  modified_base (340)..(340): a, c, t, g, unknown or other
  misc_feature (340)..(340): n is a, c, g, or t
  modified_base (358)..(358): a, c, t, g, unknown or other
  misc_feature (358)..(358): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
  modified_base (381)..(381): a, c, t, g, unknown or other
  misc_feature (381)..(381): n is a, c, g, or t
  modified_base (411)..(411): a, c, t, g, unknown or other
  misc_feature (411)..(411): n is a, c, g, or t
  modified_base (417)..(417): a, c, t, g, unknown or other
  misc_feature (417)..(417): n is a, c, g, or t
  modified_base (563)..(563): a, c, t, g, unknown or other
  misc_feature (563)..(563): n is a, c, g, or t
  modified_base (589)..(589): a, c, t, g, unknown or other
  misc_feature (589)..(589): n is a, c, g, or t
tcagtcgcactagtcacgaccggtgctcgatttagctacgactgcaagggaaagggggaagagctgctcagttaggacccagagggaaccatggaaaccccagcgcagcttctcttcctcctgctactctgcctcccagactaccaccggagtaatttgtgttgacgcagtctccaggccacccttgtctttgtcctccgaagggggtataggacgcccaccccttctccgtgaccagggccagtcaggtagttggtacncctaccttccgttagccgtacggaccagccgtaagtaaacgtttcggacctacggcctccgacgtcctcctntactcttnatcactcagcgacgcagngcacnccganactgtangtacgngaggtggtcgaggacagtacctgactccanaccgtntccgagacacgtaccggaggaccgtcgtaagtacgtagtttacgcgttaagtcgtttaattacgttcgtacgtacgtaagaacttacggtacgaccgttacccgacccgtagtacccggttacgaccgaacggtactaggtagganaacgtaacgaacgtactggagtaacncgtaaccacttacgtattcgttactccgtaccg

SEQ ID NO: 259360 - DNA, 707 bp, Homo sapiens
  misc_feature: GYAE6OF02FKPID.39.72.G06.1.454.CMB.1.raw
  modified_base (113)..(113): a, c, t, g, unknown or other
  misc_feature (113)..(113): n is a, c, g, or t
tcagtcgcactagtcacgaccggtgctcgatttagctacgactgcaagggaaagggggaagagctgctcagttaggacccagagggaaccatggaaaccccagcgcagcttcncttcctcctgctactctggctcccagataccaccggagaatttgtgttgacgcaggtctccaggtcaccctgtcctttgtctccaggggatagagccacccgtctccgtgaccgagggcccagtcagtacgtgttagccacttccttagcctggtaccagtcacgtaaatttggccgaggcttccccgaggtcctaccctcgacttacgtttacgtattctactccacgtcgaaccgggcctaacgtcggacaccttaccccgaaggtaccgtaacggttccgtaacggtcgggcttaggggtgggtacggttacgggacgtacgtaacttccgagtacctaccgacctagtacacgcgaacgtcgtaggactaccgtacgggtattgggtttacaggtacgttgttattacgttgttaccgatacctaagttagtaggtaccgttccaaccctacggtaacggttaaccgttccgggtaacctaacgggtacctaaggtttacgggaaggttaaaccggtaaccggtaaaccgtaacggttacggtcgtaccgtaccggactacccagtttccgtacgtttacccgttacccg

SEQ ID NO: 259361 - DNA, 830 bp, Homo sapiens
  misc_feature: GYAE6OF02JDZZS.39.72.G06.1.454.CMB.1.raw
tcagtcgcactagtcacgaccggtgctcgatttagctacgactgcaagggaaagggggaagagctgctcagttaggaccagagggaaccatcggaaacccagcgcagcttctcttcctctgctactctggcctccagataccaccggatatttgtgttagacgcagtcctcgaggctacccgtgttcttcgtccgtaccgaggggtataggacgtcccaccctctccgtagccgacgggtccacgtcgaggtagttcgtacggacctaccttccgttacgccgttaggtaaccacgtacgtaacggttaaacgtttcggaccgtacgggtcctaccgacggtcccttaccgtcgtaactttcgtttacggtaccttacacttcccgaacggtccggtaaccggtccctaacgtacggtacctacttacccgtacggtaaccgttacggttaccgacggttacgggacgttaggttacggggccggttaacggggaacctagggtaccttacgtaccggtaccgttacccaacgttaacgtacgtacggaacctacggggaacgttacgggtaacgtactaaagggttaactcgtttcggaagtacgttacgttagttacgtttcggaacttagaacgtagttacgggttacggtaccccgtaccttaccccgggaaggtttaaccgggtccgtaaaccggtaaccgggtacctaagggttaagtacccgggaaaacgttccgtaaaacggttaccggcgggttacccggaacgttaaccggactttaacccggacgtttaccggttaccgttacttacccgttaacccgg

SEQ ID NO: 259362 - DNA, 658 bp, Homo sapiens
  misc_feature: GYAE6OF02ID11Y.39.72.G06.1.454.CMB.1.raw
  modified_base (210)..(210): a, c, t, g, unknown or other
  misc_feature (210)..(210): n is a, c, g, or t
  modified_base (603)..(603): a, c, t, g, unknown or other
  misc_feature (603)..(603): n is a, c, g, or t
tcagtcgcactagtcacgaccggtgctcgatttagctacgactgcaagggaaagggggaagagctgctcagttaggacccagagggaaccatggaaaccccagcgcagcttctcttcctcctgctactctggcctcccagatacccaccggagtaattttgtgttgacgcagtctccaggcaccctgtctttgtctccgagggatagacncccaccctctcctgcgagggccagtcagagtgttacgcctacccttccttacgccgtacggtaccacgcaaagtaaagtttcggaccaggcctacccgaggtcctcctctattcctttgtacttctactccgagcgacgggacctacgtcggtacctactacccagacgtcggttacgaggtcggaccgtaggttcgggtacgtacggaacgtacgtaccgttcgtacgttacctaccaaccgtattaccgagtacgaaacggtcgtacggacgtacccttaggtaaacgttgtttacgacgttagtttacgtttaatttagttgtacaagtactaagttgtacgtacgtcccctacccgagtaccgtaccgacgaaacggactagtacgtanaactaacgaacgtagtgtacgtcctagacctacgtcttcgtacgttcctagtacc

SEQ ID NO: 259363 - DNA, 906 bp, Homo sapiens
  misc_feature: GYAE6OF02FX3GH.39.72.G06.1.454.CMB.1.raw
tcagtcgcactagtcacgaccggtgctcgatttagctacgactgcaagggaaagggggaagagctgctcagttaggacccagagggaccatcggaaaccccagcgcagcttctcttcctcctgcctactcgtcggcctacccgagtacgtacccgaccgggagtaacttttggtcgttgacgcacgtcctaccgaggccacccgttgttcctttcggccttccggaggggtacttaggaccgtcccaacccgttccgtacccgtcggaccgtaacgggaccctagttccgaagtaggttagttacacctacccgttcgttacgccttacggtaaccgagtacctaaggttaaccgtttcggaccacgggtacccgtacccgtaggtccctaccgttcactttccttaggtactaccgtacgtccgaggaccggacggtacctcggtacggtccaaccgtcggaacgtacggtaaggttcgaacggtggtacccgtagggttccggtacgtaacggggacccttagttaccgttacgacggtacctacccgacgttaagcccgaggtaccgtaccgggtactagggaaccgttccggtaacggttaagtttcgttacggtcccgttaaggttaccggttgtttaacgtttcggaccgtaacggtaactttacgggtaacggtttaccgggtaacccttaccccccggggttaaccgtaaacgggtttcccgggtttaaacccggggaaacccggtacggggtttacccgtaaacggggttcccggtttaaacgtaacccgggttaaacgtaaacccgggtttacggttaaccgggttacccgacggtttacccggaacccttaccgtaacccggttttggtaccctttacctaccggggttaacccc

SEQ ID NO: 259364 - DNA, 1004 bp, Homo sapiens
  misc_feature: GYAE6OF02HN7A7.39.72.G06.1.454.CMB.1.raw
tcagtcgcactagtcacgaccggtgctcgatttagctacgactgcaagggaaagggggaagagctgcttcagttaggacccagagggaaccatcggaaaccccagcgcagcttcttcttcctcctgctacctctggctacccagataccaccggagtagtttgtgttacgacgctagtcctccaggcctacccgtgttctttacgtccgttaccgaggggtatacgtaccggccctacccctctaccgtcgaccgacggggtcccgtaacggtcctaagggtacggtttacgttaaccggtaccctaacccccgttttcctttaaccgggtcccgttaaccgggtaaccccaacggtacccttaaaacggttaaacggttttacggggacccccgttaacggggtacccccgttaccggtacccggtttaccccttacccccttaacgtttaacgttttacccggtttttagtaacccgtttaccttaaccgttaccccggaaacgccccgggtaaacgggcccctaaccgggttaccggtacctaccgttaacccccggagtaaccggttaccgggtttacggtacggtacccggcgggtttaaccggggtcgggggtttaccggaacgggggtaaccgtaccgggtttaaaccgtaccggtttaaaccggttcccttaacccggtacccgtaacggttacccgtaaacggtcgtaaaccggtacgggtacgggaaccggttaacccggttaagttaaccgtttacgggttttaacgcgggttttaaacggttacggttttaacgtttacggttacgaccgggttaaacttacggttaacggttagtttacccgggttaccggttacccccgtacccccgggttagtaacccggttaacccggtacgggtaaaccggacgttacgacggttacgaaccggttacgaaccggtagtaccggtacgtaccgtacacgtacctgttaccgtcttacgtaccgttcc

SEQ ID NO: 259365 - DNA, 436 bp, Homo sapiens
  misc_feature: GYAE6OF01C75SE.19.12.B01.1.454.CMB.1.raw
  modified_base (348)..(348): a, c, t, g, unknown or other
  misc_feature (348)..(348): n is a, c, g, or t
  modified_base (433)..(436): a, c, t, g, unknown or other
  misc_feature (433)..(436): n is a, c, g, or t
tcagtactctcgtgcacgaccggtgctcgatttagtagtgtagatttggggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtggccggggtatggttatttgtactactttgactactggggccagggaaccctggtcacgtctcctcagcctccaccagggcccatcggtcttcccctgcaccctcctccaagngcacctctggggcacagcggccctgggctgcctggtcaaggactacttccacgagagtactgagcgggctggcaaggcgcatagnnnn

SEQ ID NO: 259366 - DNA, 449 bp, Homo sapiens
  misc_feature: GYAE6OF01CDVXC.19.12.B01.1.454.CMB.1.raw
  modified_base (359)..(359): a, c, t, g, unknown or other
  misc_feature (359)..(359): n is a, c, g, or t
  modified_base (439)..(449): a, c, t, g, unknown or other
  misc_feature (439)..(449): n is a, c, g, or t
tcagtactctcgtgcacgaccggtgctcgatttagtagtgtagatttgggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgcatgtattactgtgggcggggtagtggttatttgtactactttgactactggggccagggaaccctggtcacgtctcctcagcctcaccaaaggcccatcggtcttccccctggcaccctcctccaagacgcacctcgngggggcacagcggcctgggctgccgtgtcaaggactacttcccagagagtactgacggcggcgtggcaaggcgacatagnnnnnnnnnnn

SEQ ID NO: 259367 - DNA, 644 bp, Homo sapiens
  misc_feature: GYAE6OF01BPBPQ.19.12.B01.1.454.CMB.1.raw
  modified_base (550)..(550): a, c, t, g, unknown or other
  misc_feature (550)..(550): n is a, c, g, or t
  modified_base (562)..(562): a, c, t, g, unknown or other
  misc_feature (562)..(562): n is a, c, g, or t
  modified_base (567)..(567): a, c, t, g, unknown or other
  misc_feature (567)..(567): n is a, c, g, or t
  modified_base (602)..(602): a, c, t, g, unknown or other
  misc_feature (602)..(602): n is a, c, g, or t
tcagtactctcgtgcacgaccggtgctcgatttagtagtgtagatttggcgtgggtgcgcccagatgcccgggaaaggccgtggagttcggattggggatcatctatcctggtagactctgataccagatacgagtcccggtccttccaaggtccgttacggtctaccattcttacgagtccgacaagtccatcagccaccgcgtaccgtgcgaggtggacgcacgcctgaaggcctcggacaccgccatcgtacttacgtgtcggccgggtacttggttagtttcgtaccttactttgactacgtcgggccaggtaaccctggtacgtccggtcctccctaccacgccgtccgaaccgaagggtcccgagtcggtccttccccgtggtcctaccctcctccaagacgcaccgtcgtcggggacacgacgcggcccgtgggccgtcggtccggtacggtaccgtaacggtacctaaccgttccctaccggtacgaacgtaaccgtacgaacgccgggacgtacggaccgtaaggtcgtacgtacgacgtnactcgatatcgngacgngtacgtagactagctagacgaggaggacgtacggngtacgtcgacgtacgtcgtacgtactggcggccgtcggtacg

SEQ ID NO: 259368 - DNA, 447 bp, Homo sapiens
  misc_feature: GYAE6OF01D9VT6.19.12.B01.1.454.CMB.1.raw
  modified_base (440)..(447): a, c, t, g, unknown or other
  misc_feature (440)..(447): n is a, c, g, or t
tcagtactctcgtgcacgaccggtgctcgatttagtagtgtagatttggggctgggtgcgccagatgcccgggaaaggcctggagtggatggggatcatctatcctggtgactctgataccagatacatcccgtccttccaaggccaggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccacgagagtactgagcgggctggcaaggcgcatagnnnnnnnn

SEQ ID NO: 259369 - DNA, 457 bp, Homo sapiens
  misc_feature: GYAE6OF01BUC4F.19.12.B01.1.454.CMB.1.raw
  modified_base (443)..(457): a, c, t, g, unknown or other
  misc_feature (443)..(457): n is a, c, g, or t
tcagtactctcgtgcacgaccggtgctcgatttagtagtgtagatttgggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccagggcccatcggtccttccccctggcaccctcctccaagagcacctcgtgggggcacgagcggccctggggctggcctggtcaaggactacttcccacgagagtactgagcgggctggcaggcgcagtagnnnnnnnnnnnnnnn

SEQ ID NO: 259370 - DNA, 465 bp, Homo sapiens
  misc_feature: GYAE6OF01E1S2L.19.12.B01.1.454.CMB.1.raw
  modified_base (454)..(465): a, c, t, g, unknown or other
  misc_feature (454)..(465): n is a, c, g, or t
tcagtactctcgtgcacgaccggtgctcgatttagtagtgtagatttgggggctgggtgcgccagatgcccgggaaaggcctggagtggatgggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgggccggggtagtggttatttgtactactttgactactggggccagggaaccctggtcaccgtctcctcagcctccaccagggcccatccggtccttccccctggccaccctccctccaacgagcacctcgtgggggcacacgccggccctgggcctgccgtggtcaacgggacctactcccacgagagtactgacgcgggctggacaggcgcatgnnnnnnnnnnnn

SEQ ID NO: 259371 - DNA, 445 bp, Homo sapiens
  misc_feature: GYAE6OF01BJXCL.19.12.B01.1.454.CMB.1.raw
  modified_base (336)..(336): a, c, t, g, unknown or other
  misc_feature (336)..(336): n is a, c, g, or t
  modified_base (441)..(445): a, c, t, g, unknown or other
  misc_feature (441)..(445): n is a, c, g, or t
tcagtactctcgtgcacgaccggtgctcgatttagtagtgtagatttggggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtggccggggtagtggttatttgtactactttgactactggggccaggggaaccctggtcaccgtctcctcagcctccaccagggcccatcggtcttcccccnggcaccctcctccaagagcacctctgggggcacgagcggccctgggctgcctggtcaaggacctacttcccacgagagtactgagcgggctggcaaggcgcatgnnnnn

SEQ ID NO: 259372 - DNA, 610 bp, Homo sapiens
  misc_feature: GYAE6OF01COEBZ.19.12.B01.1.454.CMB.1.raw
  modified_base (569)..(569): a, c, t, g, unknown or other
  misc_feature (569)..(569): n is a, c, g, or t
  modified_base (585)..(585): a, c, t, g, unknown or other
  misc_feature (585)..(585): n is a, c, g, or t
  modified_base (588)..(610): a, c, t, g, unknown or other
  misc_feature (588)..(610): n is a, c, g, or t
tcagtactctcgtgcacgaccggtgctcgatttagtagtgtagatttgggctgggtgcgccagatgcccgggaaaggcctggagtggatgggggatcatctatcctggtgactctgataccagatacagcccgtccttccaaggccaggtcaccatctcagccgacaagtccatcagcaccgcctacctgcagtggagcagcctgaacggcctcggacaccgccatgtattacgtggtcgggccggggtagttggtttatttgtacttactttgactacgtggggccagggaccctggtccaccgtctcctcacgccctccaccgaacggcccagtccggtccttcccccgtggcccacccctccgtacccaagaccgtccaacccgttcgggtcggggtacccacgtacggcccgggtcccgtacggggtcctccggccggttcgggtaccgtaaaccgggtaccctttaccccgttcccgaaacggaggttaacgttacggtacgggtacgggccggggtaccgttagggggacccgaaacgggggtccctcgtaaacggttcgcgngtccgatgacagccancgnnnnnnnnnnnnnnnnnnnnnnn

SEQ ID NO: 259373 - DNA, 598 bp, Homo sapiens
  misc_feature: GYAE6OF01EIAJ6.19.12.B01.1.454.CMB.1.raw
  modified_base (547)..(547): a, c, t, g, unknown or other
  misc_feature (547)..(547): n is a, c, g, or t
  modified_base (550)..(550): a, c, t, g, unknown or other
  misc_feature (550)..(550): n is a, c, g, or t
  modified_base (558)..(558): a, c, t, g, unknown or other
  misc_feature (558)..(558): n is a, c, g, or t
  modified_base (569)..(569): a, c, t, g, unknown or other
  misc_feature (569)..(569): n is a, c, g, or t
  modified_base (576)..(576): a, c, t, g, unknown or other
  misc_feature (576)..(576): n is a, c, g, or t
  modified_base (582)..(584): a, c, t, g, unknown or other
  misc_feature (582)..(584): n is a, c, g, or t
  modified_base (586)..(588): a, c, t, g, unknown or other
  misc_feature (586)..(588): n is a, c, g, or t
  modified_base (592)..(593): a, c, t, g, unknown or other
  misc_feature (592)..(593): n is a, c, g, or t
  modified_base (595)..(595): a, c, t, g, unknown or other
  misc_feature (595)..(595): n is a, c, g, or t
  modified_base (597)..(597): a, c, t, g, unknown or other
  misc_feature (597)..(597): n is a, c, g, or t
tcagtactctcgtgcacgaccggtgctcgatttagtagtgtagatttgggctgggtgcgccagatgcccgggaaaggcctggagtggatggggatcatctatcctggtgactctgataccagatacagcccgtccttcaaggccaggtcaccatctcagccgacaacgtccatcagccaccgcctactgcagtggagcagcctagaacgcctcggaccaccgcatgtattacgtggtgggtcggggtagttcggtttagtttgtacttactttggtactacgtcggggccaagggaaccctggtccgaccgtctcctcacgcctccaccgacggcccagtcgtcctcccctgcctaccctctccaagacgccaccgttcgtcgggggcacgtacggccggtccgtgggccgtacgccgtaggtaccgaaacgggtccttacccgtaccccggaacgtaacggacggtttaccgtcgggaacgggtcccggggtacgttcggggaacgaaaccggggtcctaccggtaacgttaagccgaagtgacgngancgcgacgncgacgtcgcgngtgagcncgtcgnnngnnntcgnncngnc

SEQ ID NO: 259374 - DNA, 558 bp, Homo sapiens
  misc_feature: GYAE6OF01CEO78.19.12.B01.1.454.CMB.1.raw
  modified_base (233)..(233): a, c, t, g, unknown or other
  misc_feature (233)..(233): n is a, c, g, or t
  modified_base (489)..(489): a, c, t, g, unknown or other
  misc_feature (489)..(489): n is a, c, g, or t
  modified_base (530)..(533): a, c, t, g, unknown or other
  misc_feature (530)..(533): n is a, c, g, or t
  modified_base (535)..(537): a, c, t, g, unknown or other
  misc_feature (535)..(537): n is a, c, g, or t
  modified_base (539)..(558): a, c, t, g, unknown or other
  misc_feature (539)..(558): n is a, c, g, or t
tcagtactctcgtgcacgaccggtgctcgatttagtagtgtagatttggggctgggtgcgccagatgcccgggaaaggcctggagtggatggggatcatctatcctggtgactctgataccagatacagcccgtccttccaaggccaggtcaccatctcagccgacaagtccatcagccaccgcctacctgcaggtgagcagcctgaaggcctcggacaccgcatgtattacnggtgggcggggtagtggttatttggtacttactttgactacgtcggggaccgacgggaccctggtccaccgtccttcctcacgccctaccaccgaacgggcccacgtccggtccttcccccgtcggcctacccctcctaccaacggcgcctacccgttcggcgggggtcaccgtacggcccgggcccgtcggggtcctccgcccggttagggtaccaacgggtaccttaccgttacccgacggacgtaggtaccgngtacgggcgggtctacgggccgaagggccgtagacgtagcnnnncnnngnnnnnnnnnnnnnnnnnnnn

SEQ ID NO: 259375 - DNA, 613 bp, Homo sapiens
  misc_feature: GYAE6OF01BZ8E1.19.12.B01.1.454.CMB.1.raw
  modified_base (574)..(574): a, c, t, g, unknown or other
  misc_feature (574)..(574): n is a, c, g, or t
  modified_base (579)..(579): a, c, t, g, unknown or other
  misc_feature (579)..(579): n is a, c, g, or t
  modified_base (583)..(584): a, c, t, g, unknown or other
  misc_feature (583)..(584): n is a, c, g, or t
  modified_base (586)..(586): a, c, t, g, unknown or other
  misc_feature (586)..(586): n is a, c, g, or t
  modified_base (588)..(589): a, c, t, g, unknown or other
  misc_feature (588)..(589): n is a, c, g, or t
  modified_base (592)..(605): a, c, t, g, unknown or other
  misc_feature (592)..(605): n is a, c, g, or t
  modified_base (607)..(613): a, c, t, g, unknown or other
  misc_feature (607)..(613): n is a, c, g, or t
tcagtactctcgtgcacgaccggtgctcgatttagtagtgtagatttgggggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggaccaccgccatgtattactggtgggccggggtagtggttatttgtactactttgactacgtggggccacgggaaccctggtccaccgtctcctcacgccctccaccgaacgggcccactccggttccttccccccgtggccctacccctccctaccaacgacgcctacccgtcggtacggggggccaacgacgggcccggtcccgtcggggccgtcggtacccgttcggggtaccgtaaacgggtacccttaacccgtttacccccgaaacgggtaacggtaacggttaccgtagggaaccgggtccggggaccgtcggggtaaccgaacgggccggtaccgtaacgttaacggcgancgtcncgcnngngnngcnnnnnnnnnnnnnncnnnnnnn

SEQ ID NO: 259376 - DNA, 818 bp, Homo sapiens
  misc_feature: GYAE6OF01C51SE.19.12.B01.1.454.CMB.1.raw
tcagtactctcgtgcacgaccggtgctcgatttagtagtgtagatcccgcgggctggcaccgaggggtcccttccaatatcagcaccatggcctggactcctctctttctgttcctcctctacttgactgcccagggtccaattcccgaggttgtggtgactcgaggacgcctacgactgactggtcgcccgaggacggacagtcactctcacgtgcgctaccaacgtcgtcggactcgtcctaccttcagactactaatacgtcctagttaggtactacgagtacgaacggacgtcccgtacggaacctaaccggaccccctaaagtacctacgttagttactttaccgataactaaaacccgaaccgaaacgtacgtactaccgtttcccgttaaccgaacccgtccccgttacctaccgtttttaccggtaccgtttacccgttccgggtacgggaactaacctcgtccgacccgtttaccggtcccggttacgggctaccggcgtacgccggtagtacggtacgtaggacgacgtacggtacggttcgttacgttcccgttaccctacggttcccgtttaccggtttttcggtttcggacggtacggtacgggaacggtacgtacgtccggttaccgtcccggttcgtaccggtcccgtaaccgggcccgtaagggtcccccgtacccggtaccccttacgggtcccgttaaccccggtttcccggttaacccgtttcccccccggtacccctacggtaccccccgtaaacggtacccggttacggaccccgttaggggtaccccgggtccggg

SEQ ID NO: 259377 - DNA, 498 bp, Homo sapiens
  misc_feature: GYAE6OF02I4EFE.19.12.B01.1.454.CMB.1.raw
  modified_base (439)..(439): a, c, t, g, unknown or other
  misc_feature (439)..(439): n is a, c, g, or t
  modified_base (465)..(481): a, c, t, g, unknown or other
  misc_feature (465)..(481): n is a, c, g, or t
  modified_base (483)..(484): a, c, t, g, unknown or other
  misc_feature (483)..(484): n is a, c, g, or t
  modified_base (486)..(498): a, c, t, g, unknown or other
  misc_feature (486)..(498): n is a, c, g, or t
tcagtactctcgtgcacgaccggtgctcgatttagtagtgtagatttgggacgtaggggtgcgccacgatgcccggggaaaggcctggagtggatggggatcagtcctatcctggtgactcgtgataccagatacagcccggtccttcccaagggccaggtacaccatctcagccgacaagtcccatcagcacccgctacctgcagtgagcagcctgaaggcctccggacaccgccatcggtacttactgtggccggggtagtggttactttggttactacctttggactactggggccagggaacccctgggtcacccgtctcctcagcctccaccaagggcccatcgtcttcccctaggcgaccctctccaagcgcaccgtctgggggcacagcgggcctgggctgcctggtcaaggactactcccacgagcgtacngagcgggctggcaaggtcgcattagnnnnnnnnnnnnnnnnngnngnnnnnnnnnnnnn

SEQ ID NO: 259378 - DNA, 446 bp, Homo sapiens
  misc_feature: GYAE6OF02HSUJY.19.12.B01.1.454.CMB.1.raw
  modified_base (436)..(446): a, c, t, g, unknown or other
  misc_feature (436)..(446): n is a, c, g, or t
tcagtactctcgtgcacgaccggtgctcgatttagtagtgtagatttgggctgggtgcgccagatgcccgggaaaggcctggagtggatggggatcatctatcctggtgactctgataccagatacagcccgtccttccaaggtcaggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaggactacttcccagagagtactgagcgggctggcaggcgcatagnnnnnnnnnnn

SEQ ID NO: 259379 - DNA, 456 bp, Homo sapiens
  misc_feature: GYAE6OF02HV59S.19.12.B01.1.454.CMB.1.raw
  modified_base (447)..(456): a, c, t, g, unknown or other
  misc_feature (447)..(456): n is a, c, g, or t
tcagtactctcgtgcacgaccggtgctcgatttagtagtgtagatttggggctgggtgcgccagatgcccgggaaaggcctggagtggatggggatcatctatcctggtgactctgataccagatacactccgtccttccaaggccgagtcaccatttcagccgacaagtccatcagcaccgcctacctgcagtggaacagcctgacggcctcggacagcggcgtctattactgtgcgagcattcaaaaatgggtggcggcagggtggttttgatttctggggccaagggacactggtcaccgtctcctcagcctccaccaagggcccatcggtcttccccctggcaccctcctccaagagcacctctgggggcacagcggccctgggctgcctggtcaaggactacttcccacgagagtactgagcgggctggcaaggcgcatagnnnnnnnnnn

SEQ ID NO: 259380 - DNA, 450 bp, Homo sapiens
  misc_feature: GYAE6OF02I4OFC.19.12.B01.1.454.CMB.1.raw
  modified_base (438)..(450): a, c, t, g, unknown or other
  misc_feature (438)..(450): n is a, c, g, or t
tcagtactctcgtgcacgaccggtgctcgatttagtagtgtagatttgggctgggtgcgccagatgcccgggaaaggcctggagtggatgggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtggccggggtagtggttatttgtactactttgactactggggccagggaacccctggtcaccgtctcctcagcctccaccaagggcccatccggtcttcccctggcaccctcctccagagcacctctggggcacagcggcctgggctgcctggtcaaggactacttcccacgagagtactgagcgggctggcaaggcgcatagnnnnnnnnnnnnn

SEQ ID NO: 259381 - DNA, 566 bp, Homo sapiens
  misc_feature: GYAE6OF02F6UTH.19.12.B01.1.454.CMB.1.raw
  modified_base (513)..(513): a, c, t, g, unknown or other
  misc_feature (513)..(513): n is a, c, g, or t
  modified_base (521)..(523): a, c, t, g, unknown or other
  misc_feature (521)..(523): n is a, c, g, or t
  modified_base (525)..(525): a, c, t, g, unknown or other
  misc_feature (525)..(525): n is a, c, g, or t
  modified_base (529)..(530): a, c, t, g, unknown or other
  misc_feature (529)..(530): n is a, c, g, or t
  modified_base (532)..(533): a, c, t, g, unknown or other
  misc_feature (532)..(533): n is a, c, g, or t
  modified_base (535)..(535): a, c, t, g, unknown or other
  misc_feature (535)..(535): n is a, c, g, or t
  modified_base (537)..(538): a, c, t, g, unknown or other
  misc_feature (537)..(538): n is a, c, g, or t
  modified_base (541)..(541): a, c, t, g, unknown or other
  misc_feature (541)..(541): n is a, c, g, or t
  modified_base (544)..(545): a, c, t, g, unknown or other
  misc_feature (544)..(545): n is a, c, g, or t
  modified_base (547)..(549): a, c, t, g, unknown or other
  misc_feature (547)..(549): n is a, c, g, or t
  modified_base (554)..(554): a, c, t, g, unknown or other
  misc_feature (554)..(554): n is a, c, g, or t
  modified_base (556)..(558): a, c, t, g, unknown or other
  misc_feature (556)..(558): n is a, c, g, or t
  modified_base (560)..(565): a, c, t, g, unknown or other
  misc_feature (560)..(565): n is a, c, g, or t
tcagtactctcgtgcacgaccggtgctcgatttagtagtgtagatttgggtcgttgggggtgacgccagatgcccgggaaaggcctgggacgtgggagtcgggggatcgaactctatccctgggtgtactcttgacttaccagatacaggccccgtccttccaaaggccaggtcacctatctcagccgacaagtccagtcacgcaccgtcctacctgcgagtggagccacgcctggaagggcccgtcggacaccgacctagtcgtattacctggttgggcccggggttagtcggttatttgtactactttgactacgtggggccagggaaccctggtcaccgtctcctcagcctccaccgaacgggcccagtccggtccttcccccgtggccaccccgttcctaccgtaaggacgcctaccgtcgtcggggggccacgacgtccggccctcgggcctcgcctggtacaaggactaccttccgacgagagtactgtacgcggctggactaggcncagtagannncncacnncnncncnncgnacnncnnnacgtngnnncnnnnnnc

SEQ ID NO: 259382 - DNA, 507 bp, Homo sapiens
  misc_feature: GYAE6OF02GCMX9.19.12.B01.1.454.CMB.1.raw
  modified_base (489)..(507): a, c, t, g, unknown or other
  misc_feature (489)..(507): n is a, c, g, or t
tcagtactctcgtgcacgaccggtgctcgatttagtagtgtagatttgggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtggccggggtagtggttatttgtactactttgactacgtggggccagggaccctggtcaccgtctcctcacgtcctccaccgaacggcccactcggtccttccccgtcggcctacccctcctccaagacgccgacctcgtcggggccacgacgccggtcccgtgggcctcgccgtggtaccaagggaccttaccgttccccgaaggtacgtacgtactgggaacgcggggctcgggacgtaagggcgacagtagcnnnnnnnnnnnnnnnnnnn

SEQ ID NO: 259383 - DNA, 459 bp, Homo sapiens
  misc_feature: GYAE6OF02FXXFG.19.12.B01.1.454.CMB.1.raw
  modified_base (343)..(343): a, c, t, g, unknown or other
  misc_feature (343)..(343): n is a, c, g, or t
  modified_base (425)..(425): a, c, t, g, unknown or other
  misc_feature (425)..(425): n is a, c, g, or t
  modified_base (449)..(459): a, c, t, g, unknown or other
  misc_feature (449)..(459): n is a, c, g, or t
tcagtactctcgtgcacgaccggtgctcgatttagtagtgtagatttggggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggaccaccgccatgtattactgtggccggggtagtggttatttgtactactttgactactggggccagggaccctggtcaccgtctcctcagcctccaccaacgggcccatcggtccttccccctggccncccctcctccaagacgcacctcgtggggccacgacgggccctgggcctgcctggtcacggactaccttcccgagagagtacngacgcgggctggcaaggcgcatgnnnnnnnnnnn

SEQ ID NO: 259384 - DNA, 580 bp, Homo sapiens
  misc_feature: GYAE6OF02H3U3G.19.12.B01.1.454.CMB.1.raw
  modified_base (237)..(237): a, c, t, g, unknown or other
  misc_feature (237)..(237): n is a, c, g, or t
  modified_base (344)..(344): a, c, t, g, unknown or other
  misc_feature (344)..(344): n is a, c, g, or t
  modified_base (534)..(534): a, c, t, g, unknown or other
  misc_feature (534)..(534): n is a, c, g, or t
  modified_base (540)..(540): a, c, t, g, unknown or other
  misc_feature (540)..(540): n is a, c, g, or t
  modified_base (545)..(546): a, c, t, g, unknown or other
  misc_feature (545)..(546): n is a, c, g, or t
  modified_base (551)..(552): a, c, t, g, unknown or other
  misc_feature (551)..(552): n is a, c, g, or t
  modified_base (555)..(555): a, c, t, g, unknown or other
  misc_feature (555)..(555): n is a, c, g, or t
  modified_base (557)..(562): a, c, t, g, unknown or other
  misc_feature (557)..(562): n is a, c, g, or t
  modified_base (564)..(566): a, c, t, g, unknown or other
  misc_feature (564)..(566): n is a, c, g, or t
  modified_base (568)..(570): a, c, t, g, unknown or other
  misc_feature (568)..(570): n is a, c, g, or t
  modified_base (572)..(572): a, c, t, g, unknown or other
  misc_feature (572)..(572): n is a, c, g, or t
  modified_base (574)..(580): a, c, t, g, unknown or other
  misc_feature (574)..(580): n is a, c, g, or t
tcagtactctcgtgcacgaccggtgctcgatttagtagtgtagatttggggcgtgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcacgcctgaacggcctcggacaccgcatgtatacgtgngggcgggtagtgttatttcgtactctttgactacgtgggaccaggaccctggtctaccgtctcctcacgcctccacgaacggccctagtccggtccctttcccccgnggccctaccccgttcctaccaacgtacgcctaccgtcgtcgggggacacacggccggcccgtagggtctccggccgttcggtacgaaacggtaccttaacccgttaccccgaacggacgtaacggtttacgacggtaccgggccggggtacgtacggggacgtaaacgggcccgttaacaacggttacgngcgtangagannacgcnncgncnnnnnngnnngnnngngnnnnnnn

SEQ ID NO: 259385 - DNA, 571 bp, Homo sapiens
  misc_feature: GYAE6OF02F72FJ.19.12.B01.1.454.CMB.1.raw
  modified_base (323)..(323): a, c, t, g, unknown or other
  misc_feature (323)..(323): n is a, c, g, or t
  modified_base (365)..(365): a, c, t, g, unknown or other
  misc_feature (365)..(365): n is a, c, g, or t
  modified_base (385)..(385): a, c, t, g, unknown or other
  misc_feature (385)..(385): n is a, c, g, or t
  modified_base (499)..(499): a, c, t, g, unknown or other
  misc_feature (499)..(499): n is a, c, g, or t
  modified_base (529)..(529): a, c, t, g, unknown or other
  misc_feature (529)..(529): n is a, c, g, or t
  modified_base (531)..(531): a, c, t, g, unknown or other
  misc_feature (531)..(531): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
  modified_base (538)..(542): a, c, t, g, unknown or other
  misc_feature (538)..(542): n is a, c, g, or t
  modified_base (545)..(545): a, c, t, g, unknown or other
  misc_feature (545)..(545): n is a, c, g, or t
  modified_base (547)..(548): a, c, t, g, unknown or other
  misc_feature (547)..(548): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (554)..(558): a, c, t, g, unknown or other
  misc_feature (554)..(558): n is a, c, g, or t
  modified_base (560)..(570): a, c, t, g, unknown or other
  misc_feature (560)..(570): n is a, c, g, or t
tcagtactctcgtgcacgaccggtgctcgatttagtagtgtagatttgggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctggaacggcctcggaccaccgaccatgtattacgtggtgggtccggggtagttggtttatttgttacttacgtttgacttacgtggggaccgagggaacccttggtccaccgtcctcctcncggccctccaccgaacggcccagttccggtcccttcccccgngcccacctccctacaagtcncctaccgtcggtcggggcacgacggcccggtccgtcgggcgtcgccgtcggtaccaacgggtaccttacccgtaccctaacggaacgagttaaccgtggaccgggcggggtacncggggtacgaacgggccacgtaagtacgancncgngnannnnncgngnngngncnnnnncnnnnnnnnnnnc

SEQ ID NO: 259386 - DNA, 476 bp, Homo sapiens
  misc_feature: GYAE6OF02GLP9C.19.12.B01.1.454.CMB.1.raw
  modified_base (447)..(447): a, c, t, g, unknown or other
  misc_feature (447)..(447): n is a, c, g, or t
  modified_base (453)..(476): a, c, t, g, unknown or other
  misc_feature (453)..(476): n is a, c, g, or t
tcagtactctcgtgcacgaccggtgctcgatttagtagtgtagatttggggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtggccggggtagtggttatttgtactactttgactactggggccagggaaccctggtcaccgtctcctcagcctccaccaacgggcccatccggtcttccccgtggccaccctcctccaagacgccacctcgtgggggcacaggcgcccgtgggctcgcctggtacgaaggactacgttcccgacgagagtactgacgcgggctggcaaggcncatagnnnnnnnnnnnnnnnnnnnnnnnn

SEQ ID NO: 259387 - DNA, 555 bp, Homo sapiens
  misc_feature: GYAE6OF02J1BRU.19.12.B01.1.454.CMB.1.raw
  modified_base (200)..(200): a, c, t, g, unknown or other
  misc_feature (200)..(200): n is a, c, g, or t
  modified_base (235)..(235): a, c, t, g, unknown or other
  misc_feature (235)..(235): n is a, c, g, or t
  modified_base (314)..(314): a, c, t, g, unknown or other
  misc_feature (314)..(314): n is a, c, g, or t
  modified_base (378)..(378): a, c, t, g, unknown or other
  misc_feature (378)..(378): n is a, c, g, or t
  modified_base (523)..(548): a, c, t, g, unknown or other
  misc_feature (523)..(548): n is a, c, g, or t
  modified_base (550)..(555): a, c, t, g, unknown or other
  misc_feature (550)..(555): n is a, c, g, or t
tcagtactctcgtgcacgaccggtgctcgatttagtagtgtagatttggggctgggtgcgccagatgcccgggaaaggcctggagtggatgggggatcatctatcctggtgactctgataccagatacagcccgtccttccaaggccaggtcaccatctcagccgacaagtccatcagccaccgcctacctgcagtggancagcctagaggcctcggacaccgcatagtattacnggtcgggccgggtgtcggttatttgtactactttgactacgtcgggcgacgggtaaccctgggtcaccgtctcctgacncctccaccgacgggcccacgtccggtcccttaccccgtcggccctacccctcctaccaggaacncctacccgtcgtcgggggacacgacgccgggcgtcgggtcctcgtccggtcggaccgtaacgtcccgttcccttacccgacggtaacgtaccgtacgtggtaccggccgggtcggtacgggcgaaacgggccgtacgagtggacnnnnnnnnnnnnnnnnnnnnnnnnnncnnnnnn

SEQ ID NO: 259388 - DNA, 537 bp, Homo sapiens
  misc_feature: GYAE6OF02IZ6EU.19.12.B01.1.454.CMB.1.raw
  modified_base (166)..(166): a, c, t, g, unknown or other
  misc_feature (166)..(166): n is a, c, g, or t
  modified_base (198)..(198): a, c, t, g, unknown or other
  misc_feature (198)..(198): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (504)..(505): a, c, t, g, unknown or other
  misc_feature (504)..(505): n is a, c, g, or t
  modified_base (508)..(508): a, c, t, g, unknown or other
  misc_feature (508)..(508): n is a, c, g, or t
  modified_base (510)..(510): a, c, t, g, unknown or other
  misc_feature (510)..(510): n is a, c, g, or t
  modified_base (512)..(512): a, c, t, g, unknown or other
  misc_feature (512)..(512): n is a, c, g, or t
  modified_base (516)..(518): a, c, t, g, unknown or other
  misc_feature (516)..(518): n is a, c, g, or t
  modified_base (520)..(524): a, c, t, g, unknown or other
  misc_feature (520)..(524): n is a, c, g, or t
  modified_base (526)..(537): a, c, t, g, unknown or other
  misc_feature (526)..(537): n is a, c, g, or t
tcagtactctcgtgcacgaccggtgctcgatttagtagtgtagatttggggctgggtgcgccagatgcccgggaaaggcctggagtggatggggatcatctatcctggtgactctgataccagatacagcccgtccttccaaggccaggtcaccatctcagccganaagtccatcagcaccgcctacctgcagtggancagcctgaacggcctcggacaccgcatgtattactgtgggccggggtatggttatttgtacttatttgactacgtggggccacgggaccctggtccaccgtctcctcacgcctaccaccgaacggcccatccggtcccttccccgtcgccgaccctcctaccgaacgacgcctaccgtcgcgggggccacgacggccggcccgtcgggccgtcgtccgtaggtacgaacggtacctaccgttcccgaacggagacgtacgtcgaggtccgggctgggaccgaaggcgacgagtacggcangngcgnngcngnancgannncnnnnncnnnnnnnnnnnn

SEQ ID NO: 259389 - DNA, 555 bp, Homo sapiens
  misc_feature: GYAE6OF02JYYHO.19.12.B01.1.454.CMB.1.raw
  modified_base (311)..(311): a, c, t, g, unknown or other
  misc_feature (311)..(311): n is a, c, g, or t
  modified_base (313)..(313): a, c, t, g, unknown or other
  misc_feature (313)..(313): n is a, c, g, or t
  modified_base (369)..(369): a, c, t, g, unknown or other
  misc_feature (369)..(369): n is a, c, g, or t
  modified_base (508)..(509): a, c, t, g, unknown or other
  misc_feature (508)..(509): n is a, c, g, or t
  modified_base (513)..(514): a, c, t, g, unknown or other
  misc_feature (513)..(514): n is a, c, g, or t
  modified_base (516)..(516): a, c, t, g, unknown or other
  misc_feature (516)..(516): n is a, c, g, or t
  modified_base (527)..(527): a, c, t, g, unknown or other
  misc_feature (527)..(527): n is a, c, g, or t
  modified_base (534)..(534): a, c, t, g, unknown or other
  misc_feature (534)..(534): n is a, c, g, or t
  modified_base (539)..(540): a, c, t, g, unknown or other
  misc_feature (539)..(540): n is a, c, g, or t
  modified_base (542)..(542): a, c, t, g, unknown or other
  misc_feature (542)..(542): n is a, c, g, or t
  modified_base (544)..(545): a, c, t, g, unknown or other
  misc_feature (544)..(545): n is a, c, g, or t
  modified_base (549)..(549): a, c, t, g, unknown or other
  misc_feature (549)..(549): n is a, c, g, or t
  modified_base (553)..(553): a, c, t, g, unknown or other
  misc_feature (553)..(553): n is a, c, g, or t
  modified_base (555)..(555): a, c, t, g, unknown or other
  misc_feature (555)..(555): n is a, c, g, or t
tcagtactctcgtgcacgaccggtgctcgatttagtagtgtagatttgggctgggtgcgccagatgcccgggaaaggcctggagtggatgggggatcatctatcctggtgactctgataccagatacagcccgtccttccaaggccaggtcaccatctcacgccgacaagtccatcagcaccgcctacctgcagtggagccagcctggaacgcctacggacaccgccatgtacttactggtggccggggtatggtttagttctacgttacttgactacgtgggcctacgggacctggtcaccgtctcctcncncctccaccgagcccgtactccgtcccttcccgtcgcctaccctccgtccaacgacnccaccgtcgtcggggacaccgagccggtcctcgggccgtcgtaccgtgggtaccaaggtaccctacgttaccccgagtacgtacgtacgtgggaggaccgggtcgtcggacgaccgggcggtacgacgtagcagtcgcnncagnngngacgcacgcgngcagcgngcagnngngnncagnagcncn

SEQ ID NO: 259390 - DNA, 548 bp, Homo sapiens
  misc_feature: GYAE6OF02HULSK.19.12.B01.1.454.CMB.1.raw
  modified_base (202)..(202): a, c, t, g, unknown or other
  misc_feature (202)..(202): n is a, c, g, or t
  modified_base (224)..(224): a, c, t, g, unknown or other
  misc_feature (224)..(224): n is a, c, g, or t
  modified_base (249)..(249): a, c, t, g, unknown or other
  misc_feature (249)..(249): n is a, c, g, or t
  modified_base (272)..(272): a, c, t, g, unknown or other
  misc_feature (272)..(272): n is a, c, g, or t
  modified_base (299)..(299): a, c, t, g, unknown or other
  misc_feature (299)..(299): n is a, c, g, or t
  modified_base (337)..(337): a, c, t, g, unknown or other
  misc_feature (337)..(337): n is a, c, g, or t
  modified_base (360)..(360): a, c, t, g, unknown or other
  misc_feature (360)..(360): n is a, c, g, or t
  modified_base (389)..(389): a, c, t, g, unknown or other
  misc_feature (389)..(389): n is a, c, g, or t
  modified_base (422)..(422): a, c, t, g, unknown or other
  misc_feature (422)..(422): n is a, c, g, or t
  modified_base (435)..(435): a, c, t, g, unknown or other
  misc_feature (435)..(435): n is a, c, g, or t
  modified_base (463)..(463): a, c, t, g, unknown or other
  misc_feature (463)..(463): n is a, c, g, or t
  modified_base (468)..(468): a, c, t, g, unknown or other
  misc_feature (468)..(468): n is a, c, g, or t
  modified_base (472)..(472): a, c, t, g, unknown or other
  misc_feature (472)..(472): n is a, c, g, or t
  modified_base (476)..(476): a, c, t, g, unknown or other
  misc_feature (476)..(476): n is a, c, g, or t
  modified_base (479)..(479): a, c, t, g, unknown or other
  misc_feature (479)..(479): n is a, c, g, or t
  modified_base (503)..(503): a, c, t, g, unknown or other
  misc_feature (503)..(503): n is a, c, g, or t
  modified_base (528)..(528): a, c, t, g, unknown or other
  misc_feature (528)..(528): n is a, c, g, or t
  modified_base (547)..(547): a, c, t, g, unknown or other
  misc_feature (547)..(547): n is a, c, g, or t
tcagtactctcgtgcacgaccggtgctcgatttagtagtgtagatttgggctgggtgcgccagatgcccgggaaggcctggagtggatgggggatcatctatcctggtgactctgataccagatacagcccgtcttccaaggccaggtcaccatctcgacgcccgacaagtccaatcagcaccgtcctacctgcagtcggancacgcctggaacgcctggaccnccgcatgtatcgtgtcggccgggtntggttacttgtactacttgctcncggggccacggacctcggtcaccgtcncctcacgcctccgacgacggccctagtccgtcctcccnggcctaccctccgtacaacgacnccacgtcggtcggggcacgagccgtccgnggctccgcgtcggtacacggtactacgtacccnggtacgtacgtancggtagcggcgaggcgaagggctaccgngtacncgancgtnacngactcgaatgacgtacgctgacgnttcgacgtcgatcggatggtaaccnggtctgtacgtgtgccgtng

SEQ ID NO: 259391 - DNA, 573 bp, Homo sapiens
  misc_feature: GYAE6OF02HUIJH.19.12.B01.1.454.CMB.1.raw
  modified_base (164)..(164): a, c, t, g, unknown or other
  misc_feature (164)..(164): n is a, c, g, or t
  modified_base (198)..(198): a, c, t, g, unknown or other
  misc_feature (198)..(198): n is a, c, g, or t
  modified_base (299)..(299): a, c, t, g, unknown or other
  misc_feature (299)..(299): n is a, c, g, or t
  modified_base (499)..(499): a, c, t, g, unknown or other
  misc_feature (499)..(499): n is a, c, g, or t
  modified_base (503)..(503): a, c, t, g, unknown or other
  misc_feature (503)..(503): n is a, c, g, or t
  modified_base (507)..(507): a, c, t, g, unknown or other
  misc_feature (507)..(507): n is a, c, g, or t
  modified_base (517)..(517): a, c, t, g, unknown or other
  misc_feature (517)..(517): n is a, c, g, or t
  modified_base (520)..(520): a, c, t, g, unknown or other
  misc_feature (520)..(520): n is a, c, g, or t
  modified_base (556)..(556): a, c, t, g, unknown or other
  misc_feature (556)..(556): n is a, c, g, or t
  modified_base (559)..(559): a, c, t, g, unknown or other
  misc_feature (559)..(559): n is a, c, g, or t
  modified_base (570)..(570): a, c, t, g, unknown or other
  misc_feature (570)..(570): n is a, c, g, or t
tcagtactctcgtgcacgaccggtgctcgatttagtagtgtagatttgggctgggtgcgccagatgcccgggaaaggcctggagtggatggggatcatctatcctggtgactctgataccagatacagcccgtcttccaaggccaggtcaccatctcagccganacgtccatcgagccaccgctacctgctagtggancagcctgaacgtcctggaccaccgctatcgtaatctgtcggcggtatggttattgtactattacgactacgtcgggaccaggtaaccctggtccacgttcncctcacgtcctccgaacgaacggcctaacgtccgtccttccccgcggtccaccctaccgtaccgaacgacgtaccaccgttcggtacggggcacgacggcggcccgtaggtcctacgccgtaggtacgaacgtactaccttcccgacgtagtacggtactcggacggcggtacgtacggtagacgggacacgatacggtnacgntacngacataccgnacncgtacgacgctacgacagtcgtccaggcctagcacncgngcaagctcagnacg

SEQ ID NO: 259392 - DNA, 508 bp, Homo sapiens
  misc_feature: GYAE6OF01ALIKY.15.66.F11.1.454.CMB.1.raw
  modified_base (402)..(402): a, c, t, g, unknown or other
  misc_feature (402)..(402): n is a, c, g, or t
  modified_base (502)..(502): a, c, t, g, unknown or other
  misc_feature (502)..(502): n is a, c, g, or t
tcagtctacgtagccacgaccggtgctcgatttagtcacgcgagaaggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttcngcggctcatatggagacaattacagctttgtcttcggaagtgggaccaggtcaccgtctaagtcagcccaaggcccaacccatcgtcactctcgttcccnccctcc

SEQ ID NO: 259393 - DNA, 709 bp, Homo sapiens
  misc_feature: GYAE6OF01AUR7L.15.66.F11.1.454.CMB.1.raw
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaaccattggtgattataactatgtctcctggtaccagcagcaccaggcaaagccccaaagtcatctatttatgagctcactaagccggccctcgacggggtccctgactcgtcttctctggctccaagtctggcgactcggccctcccgtcgtacccgtctcgtcgggtcctccgacgtcccgtgaaacgtagtggacgggtcttaggtaatttacgttttccgtgggccgggtccttaccgtaagttagtcgggtaacgtaaaccgttaaatttaccgaacggtttcctttttacgggttaccgttttacggggtaaacggttccggggaaacccgtaaaggggttacccgtaaaccccggttacccgttaaaacggttacccgaacccggtacccccgaaacgggtaccccccaaaaccccccgtaccgttacggttaacccctaacccgtttccgtttaccccggtttaccccttacccccgtttacccccg

SEQ ID NO: 259394 - DNA, 523 bp, Homo sapiens
  misc_feature: GYAE6OF01A2RNE.15.66.F11.1.454.CMB.1.raw
  modified_base (387)..(387): a, c, t, g, unknown or other
  misc_feature (387)..(387): n is a, c, g, or t
  modified_base (515)..(515): a, c, t, g, unknown or other
  misc_feature (515)..(515): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcgacgggtccctgatcgcttctctggctccaagtctggcgactcggcctcctgaccgtctcgtcggctccagcctgaagntgaggctgattatttctgcggctcatactggagactaattacagttcttgtcttcggaagtggaccaaggtctaccgtcctaagtcacgacccaaggcccaacccgctcgtacacttctcgttccccnccctcccg

SEQ ID NO: 259395 - DNA, 518 bp, Homo sapiens
  misc_feature: GYAE6OF01EDTI4.15.66.F11.1.454.CMB.1.raw
  modified_base (227)..(227): a, c, t, g, unknown or other
  misc_feature (227)..(227): n is a, c, g, or t
  modified_base (400)..(400): a, c, t, g, unknown or other
  misc_feature (400)..(400): n is a, c, g, or t
  modified_base (415)..(415): a, c, t, g, unknown or other
  misc_feature (415)..(415): n is a, c, g, or t
  modified_base (490)..(490): a, c, t, g, unknown or other
  misc_feature (490)..(490): n is a, c, g, or t
  modified_base (510)..(510): a, c, t, g, unknown or other
  misc_feature (510)..(510): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtnattataactatgtctcctggtaccagcagcacccaggcaaagccccaaagtcatcatttatgagctcactaagcgcctcgagggtcctgatcgcttctctggctccaagtctggcgactcggcctcctgacccgtctctgggctccagcctgaagatgaggctgatttattcngcggctcatatgganactaattacagtctttgtcttacgggaagtgggaccaaggtcaccgtcctaagtcacgcccaaggcccaaccccntcgtcactcctcgttccccnccctcccg

SEQ ID NO: 259396 - DNA, 673 bp, Homo sapiens
  misc_feature: GYAE6OF01CS2IQ.15.66.F11.1.454.CMB.1.raw
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtagatttataactatgtctcctggtaccagcagcacccaggacaaacgccccaaagtcatcatttatgagctcactaagccgccctcgacgggtccctgactccgtcttctctggcctccaagtctggcgactcggcctcctgtacccgtctcgtcgggctccgacgtcctagaaagcgtggacggtcttaggtaatttacgtttcgtcggtccggtcttacgaagttagtacgggaacgtaaacctaaatttaaccgaggttccgtttttagggttccgtttaacgggaacggttacggggaaccctaaagggttcccgtaacccggttacccgtaaaacggtcccgtaaacggacccccgtaaacgggcccccctaaaacccccgtacgttaccggttaccctaaccgttccccgtttccggttcccccccgtcccctttaccccgg

SEQ ID NO: 259397 - DNA, 512 bp, Homo sapiens
  misc_feature: GYAE6OF01BRTK3.15.66.F11.1.454.CMB.1.raw
  modified_base (419)..(419): a, c, t, g, unknown or other
  misc_feature (419)..(419): n is a, c, g, or t
  modified_base (486)..(486): a, c, t, g, unknown or other
  misc_feature (486)..(486): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccattggtgattataactatgtctcctggtaccagcagcacccaggcaaagccccaaagtcatcatttatgagctcactaagcggcctcagggtccctgatcgcttctctggctccaagtctggcgactcggcctccctgaccgtctctgggcctccagcctgaagatgaggctgatttatttctgcggtctcatatgganactaattacagtctttgtcttaggaagtggacaggtcacgtctaagtcacgcccaaggcccaacccnctcgtcacttctcgttcccgcctccg

SEQ ID NO: 259398 - DNA, 529 bp, Homo sapiens
  misc_feature: GYAE6OF01B69KK.15.66.F11.1.454.CMB.1.raw
  modified_base (426)..(426): a, c, t, g, unknown or other
  misc_feature (426)..(426): n is a, c, g, or t
  modified_base (521)..(521): a, c, t, g, unknown or other
  misc_feature (521)..(521): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcaccaggcaaagccccaaagtcatcatttatgagctcactaagccggccctcgaggggtccctgatcgcttctctggctcagtctggcgactcggcctccctgaccgtctcgtgggcctccagcctgaagatggaggctgtatttatttcgtgcggtctcagttatgganactaattacagtctttgttcgttaggaagtggaccaggtcaccgtcctaagtcacgcccaacggcccaaccctactcgtaccactctcgttcccnccctcccg

SEQ ID NO: 259399 - DNA, 545 bp, Homo sapiens
  misc_feature: GYAE6OF01B4R01.15.66.F11.1.454.CMB.1.raw
  modified_base (227)..(227): a, c, t, g, unknown or other
  misc_feature (227)..(227): n is a, c, g, or t
  modified_base (427)..(427): a, c, t, g, unknown or other
  misc_feature (427)..(427): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtnattataactatgtctcctggtaccagcagcaccaggcaaagccccaaagtcatcatttatgagctcactaacgcggccctcgagggtccctgactcgcttctctggctcaagtctggcgactccggcctcctgaccgtctcgtcgggcctccgagcctagaagatgaggctgtattatttctgcggtctctatagtgganaactaattacagtctttgtcgttacggtaagtcgggacgtaacggtcctaccgtcctaagtcacgacccaacggcccaaccccgatcgtacctacttcttccgtccccgtccctcccg

SEQ ID NO: 259400 - DNA, 551 bp, Homo sapiens
  misc_feature: GYAE6OF01BNLRH.15.66.F11.1.454.CMB.1.raw
  modified_base (410)..(410): a, c, t, g, unknown or other
  misc_feature (410)..(410): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaacgccccaaagtcatcatttatgagctcactaagccggcctcaggggtccctgatcgcttctctggctcagtctggcgactcggcctcctgacccgtctcgtgggcctccacgtcctagaagcgtgaggctgtatttagtttcngcgtctctatagtggacgacaattacagttctttgtcgttcggaagtcgggactacggtccaccgtacctaacgtcgacgtacccaacggccccaaccccacttcgtacctaccttccgttccgttccccctcccgtcccg

SEQ ID NO: 259401 - DNA, 517 bp, Homo sapiens
  misc_feature: GYAE6OF01BZWRP.15.66.F11.1.454.CMB.1.raw
  modified_base (401)..(401): a, c, t, g, unknown or other
  misc_feature (401)..(401): n is a, c, g, or t
  modified_base (415)..(415): a, c, t, g, unknown or other
  misc_feature (415)..(415): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcagggtccctgattgcttctctggctcaagtctggcgactcggcctccctgaccgtctctgggctccagcctgaagatgaggctgattatttcngcgctcatatgganactaattcagtctttgtcttcggaagtggacctaaggtccacgtctaagtccacgcccaaggcccaacccgctcgtccacttcctcgttccccgccctcccg

SEQ ID NO: 259402 - DNA, 514 bp, Homo sapiens
  misc_feature: GYAE6OF01BAIXS.15.66.F11.1.454.CMB.1.raw
  modified_base (385)..(385): a, c, t, g, unknown or other
  misc_feature (385)..(385): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagccccaaagtcatcatttatgagctcactaagcggccctcgaggggtccctgatcgcttctctggctccaagtctggcgactcggcctccctgaccgtctctgggctccagcctgagntgaggctgattatttctgcgctcatatggagacaattacagtctttgtcttcggaagtggaccaaggtcaccgtcctaagtcagcccaaggcccaaccccatcgtcactcctcgttccccgccctcccg

SEQ ID NO: 259403 - DNA, 512 bp, Homo sapiens
  misc_feature: GYAE6OF01CFFIU.15.66.F11.1.454.CMB.1.raw
  modified_base (287)..(287): a, c, t, g, unknown or other
  misc_feature (287)..(287): n is a, c, g, or t
  modified_base (412)..(412): a, c, t, g, unknown or other
  misc_feature (412)..(412): n is a, c, g, or t
  modified_base (422)..(422): a, c, t, g, unknown or other
  misc_feature (422)..(422): n is a, c, g, or t
  modified_base (489)..(489): a, c, t, g, unknown or other
  misc_feature (489)..(489): n is a, c, g, or t
  modified_base (507)..(507): a, c, t, g, unknown or other
  misc_feature (507)..(507): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagccccaaagtcatcatttangagctcactaagcggccctcgacgggtccctgatcgcttctctggctcaagtctggcgactcggcctccctgaccgtctcgtcgggctccgagccctgaacgatggagctgatttattctgcggntcatatgganacaattacagtcttgtcgttaggagtggaccaggtcaccgtctaagtcacgcccaaggcccaacccntcgtcactctcgttcccnccctc

SEQ ID NO: 259404 - DNA, 611 bp, Homo sapiens
  misc_feature: GYAE6OF01B7CUF.15.66.F11.1.454.CMB.1.raw
tcagtctacgtagccacgaccggtgctcgatttagtcacgcgagaaggggggtctcatgaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctctggtaccagcagcaccaggcaaacgcccaaagtcatcatttatgagctcactaagccggccctcgacgggtccctgactcgtcttctctcggctccaagtctggcacgtccggcctccctcgaccgtctcgtcgggccttccgagccctaggaacgtacgtggacggtcttggtaattttacgtttcgtggccggtctcgtattagtggaagtaactaactttacgagttcttttgtaccgtttacgggaaggttcgggaaccgtaaggttcccgaacccggttaccgtaacgtccgaacggaccccgaaacggccccctaaaccccgtacgttcgtaccctaaccttccttccgttcccccctaccccg

SEQ ID NO: 259405 - DNA, 512 bp, Homo sapiens
  misc_feature: GYAE6OF01B4J36.15.66.F11.1.454.CMB.1.raw
  modified_base (289)..(289): a, c, t, g, unknown or other
  misc_feature (289)..(289): n is a, c, g, or t
  modified_base (420)..(420): a, c, t, g, unknown or other
  misc_feature (420)..(420): n is a, c, g, or t
  modified_base (486)..(486): a, c, t, g, unknown or other
  misc_feature (486)..(486): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttangagctcactaagcggccctcgacgggtccctgatcgcttctctggctcagtctggcgactcggcctcctgaccgtctcgtgggcctccagcctgaagatgaggctgtattatttctgcgtctcatatgganacaattacagtctttgtcttcggaagtggaccaggtcaccgtctaagtcacgcccagcccaacccntcgtcactctcgttccccgccctccg

SEQ ID NO: 259406 - DNA, 516 bp, Homo sapiens
  misc_feature: GYAE6OF01CTAXX.15.66.F11.1.454.CMB.1.raw
  modified_base (227)..(227): a, c, t, g, unknown or other
  misc_feature (227)..(227): n is a, c, g, or t
  modified_base (407)..(407): a, c, t, g, unknown or other
  misc_feature (407)..(407): n is a, c, g, or t
  modified_base (417)..(417): a, c, t, g, unknown or other
  misc_feature (417)..(417): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtnattataactatgtctcctggtaccagcagcacccaggcaaagccccaaaagtcatcatttatgagctcactaagcggccctcagggtccctgatcgcttctctggctcaagtctggcgactcggcctccctgaccgtctcgtcgggctccagcctgaagatgaggctgattattctgcgntcatatgganacaattacagtctttgtcttcgggaagttgggaccaaggtcaccgtcctaagtcacgcccaaggcccaaccccactcgtcactctcttcccgcctcccg

SEQ ID NO: 259407 - DNA, 694 bp, Homo sapiens
  misc_feature: GYAE6OF01DMNES.15.66.F11.1.454.CMB.1.raw
  modified_base (221)..(221): a, c, t, g, unknown or other
  misc_feature (221)..(221): n is a, c, g, or t
  modified_base (227)..(227): a, c, t, g, unknown or other
  misc_feature (227)..(227): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaacctnttggtnattataactatgtctcctggtaccagcagcacccaggacaaacgccccaaagtcatcatttatgagctacactaacgccggtccctcgacggggtccctgactcgtcttctctcggtcctccgtaagtccgtcgggccgacgttccggcccttcccgtacggtacccgttccgttcgtcgggtcccttcccgaggtcccttaaggaaacgtgtacgggaacgggtcttaggttaacttttacgttttcgtcgggccggtcttacgaattagtagggaacaacttaaattaccagttccttttggtaccttacgggtaaggtacgggacccgaaaggttccccgtaaccgttacctaaaggtccgaaccggtaccccgaaaccgggccccctaaacccccgtaacgttcccgtaacccgtaacccctttacccgtccccggttttcccccccgcccccccgttacggg

SEQ ID NO: 259408 - DNA, 533 bp, Homo sapiens
  misc_feature: GYAE6OF01BLV7F.15.66.F11.1.454.CMB.1.raw
  modified_base (225)..(225): a, c, t, g, unknown or other
  misc_feature (225)..(225): n is a, c, g, or t
  modified_base (390)..(390): a, c, t, g, unknown or other
  misc_feature (390)..(390): n is a, c, g, or t
  modified_base (429)..(429): a, c, t, g, unknown or other
  misc_feature (429)..(429): n is a, c, g, or t
  modified_base (526)..(526): a, c, t, g, unknown or other
  misc_feature (526)..(526): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctcgcgtccgggtctcctggacagtcagtcaccatctcctgcactggaaccattggtnattataactatgtctctggtaccagcagcaccaggcaaagccccaaagtcatcatttatgagctcactaagcggccctcgacggggtccctgactcgtcttctctggctcaagtctggcgactcggcctcctcgaccgtctcgtgggcctccacgcctagaacgntggagtctgatttagtttcgtgcggtctcagttatgganactaattacgagttctttgtacgttcggaagtcgggactaggtcaccgtctaagtcacgacccaggcccaaccccatcgtacacttctcgttccccnccttccc

SEQ ID NO: 259409 - DNA, 616 bp, Homo sapiens
  misc_feature: GYAE6OF01EGMQ2.15.66.F11.1.454.CMB.1.raw
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaacgccccaaagtcatcatttatgagctcactaagccggccctcgacggggtccctgactcgcttctctcggctccaagtcgtcggcgacgtccggcctcccgtgtaccgtctcgtcgggtcctccacgtcctagaagatggaggtctagtatttattcgtgtcggttctagttagtggaacgtaactaattacgagttctttgtacgttacggtaagggtcggaacgtaacggtcctaccgttaccgtaagtccgtaacggaccccgtaaagggaccccctaaaccccgacgttacggtacccttacttcccttacccggtttcccccctaccccgttcccgtacccgg

SEQ ID NO: 259410 - DNA, 696 bp, Homo sapiens
  misc_feature: GYAE6OF01D0VTO.15.66.F11.1.454.CMB.1.raw
  modified_base (399)..(399): a, c, t, g, unknown or other
  misc_feature (399)..(399): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctcgcgtccgggtctcctggacagtcagtcaccatctcctgcacgtggaacctagttggtacaattataactatcgtctccgtggtaccagcacgcaccgaggacaaacgccccaaagtcactcattatgagtctcaactacgccgccctcgacgggtccctgactcgtcttctcgtggcctaccgagtcgtcggaccgtacgtccggccctccgtggacccgttcgtcgngggtctccgacgtcctaggaacgtatcggacgtcgtagtagtttactttcggtcgtccggttactacgtaagttaggttcggaaagtaaccgtaaatttacgacggtttcgtttacgggttaccgtttacggggtaaacgttacgggaaccgttaaacgggttacccgtaacccggtttaaccgtaaacggtttaccgaaccccggtacccgtaaaccggacccccgtaaacccccgtcgttaccggttacctacccgtttaccttaccccgtttccccccgaccccgtttacccgg

SEQ ID NO: 259411 - DNA, 522 bp, Homo sapiens
  misc_feature: GYAE6OF01CVKK5.15.66.F11.1.454.CMB.1.raw
  modified_base (232)..(232): a, c, t, g, unknown or other
  misc_feature (232)..(232): n is a, c, g, or t
  modified_base (289)..(289): a, c, t, g, unknown or other
  misc_feature (289)..(289): n is a, c, g, or t
  modified_base (511)..(511): a, c, t, g, unknown or other
  misc_feature (511)..(511): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattanaactatgtctcctggtaccagcagcacccaggcaaagcccccaaagtcatcatttangagctcactaagccggccctcgagggtatctaatcgcttctctggctcaagtctggcaacacggcctccctgaccgtctctcggcctccagactgaggacgaggctgattatactgccactcatatagaagtatactactctgttggtttcggcggaggacagctagaccgtcctaggtcacgcccgaagcctcgccccgtcgtcctacctctcgttccccnccctccgtccg

SEQ ID NO: 259412 - DNA, 696 bp, Homo sapiens
  misc_feature: GYAE6OF01BC300.15.66.F11.1.454.CMB.1.raw
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcatcggaaccattggtgattataactatgtctcctggtaccagcagcaccagcaaacgccccaaagtcatctatttanganctcactaagcgccctcgacgggtccctgatcgtcttctctcgctccagtctggcgactccggcctccctcgtacccgtctcgtcgggtcctccgacgtcctaggaagacgtcggaaggtccttagtaacttttagtttccgtggtccggtccttacgaaacgtttacgtaggaacgtaaaccgtaaactttaccgtaaggttccgtttttacggttaccggtttaccggggtaaaggttacggggtaacccgtaaacgggttcccgtaaaccccggttaccgttaaaacggttcccgaaccggtaaccccgtaaaccggggtaccccccaaaacccccgtaacgttaccggtacccttaacccgttacccgtttacccgtttaccccccctaaccccgttcccccg

SEQ ID NO: 259413 - DNA, 673 bp, Homo sapiens
  misc_feature: GYAE6OF01DRDQI.15.66.F11.1.454.CMB.1.raw
  modified_base (229)..(229): a, c, t, g, unknown or other
  misc_feature (229)..(229): n is a, c, g, or t
  modified_base (291)..(291): a, c, t, g, unknown or other
  misc_feature (291)..(291): n is a, c, g, or t
  modified_base (333)..(333): a, c, t, g, unknown or other
  misc_feature (333)..(333): n is a, c, g, or t
  modified_base (346)..(346): a, c, t, g, unknown or other
  misc_feature (346)..(346): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatcctcctgcactggaacctattggtnattataactatgtctctggtaccagcagcacccagccaaacgccccaagtcatcattatganctacacgtaacgcggcctcgacgggtccctagactcgcttcncgtgcctcagtcnggcactcggccctcctcgacccgtctcgtcggtcctccgacgtccgtaggaacgtagtgggaacggttccttaggtaacttttacgtttcgtacggtcggtccttacgattacgtaggaacgtaactaacgttacacggttctttttcggttaccgtttacggggaacggttccggggaaacccttaacgggtacccgttaacccggttaccgttaaaccggtccgaaacccggtaccccggaaacccgggtacccccaaaaccccgttcttacccggtacccttaacccttccgttacccccgttccccctaccccgtttaccccg

SEQ ID NO: 259414 - DNA, 550 bp, Homo sapiens
  misc_feature: GYAE6OF01C9FXS.15.66.F11.1.454.CMB.1.raw
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaacgccccaaagtcatcatttatgagctcactaagccggccctcgacggggtccctgatcgcttctctgctccaagtctggcgactcggccctccctcgcccgtctcgtgggctccagcctagaagatgaggctgtatttattctgcggtctcatagtggagacaattacagtcttttgtcgttacggagttcgggaccaaggtccaccggtcctaagccgaacgcccgaacggccccaaaccccgtatcgtaccaccttccttccgttccccgtcccttcccg

SEQ ID NO: 259415 - DNA, 728 bp, Homo sapiens
  misc_feature: GYAE6OF01CSV93.15.66.F11.1.454.CMB.1.raw
  modified_base (346)..(346): a, c, t, g, unknown or other
  misc_feature (346)..(346): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaacctagttggtagaatttaactaactatcgtctccgtggtaccagcacgccaccgaggaccaaacgccccaaagtcatctattatgagctacactaacgccgcctcgacgggtcctagactcgtcttcncgtcggcctaccgtaagtcgtcggaccgtaccgtcccggtccctcccgtcggttacccgtcgttccggtcgggtcccttccgacggtccgtaaggaacgtacgttacgggacggtcgttagttaactttacgttttcgcggtccggtacttacgtaagttagtaacgggtaactaaaccgttaatttacgaacgtttcgttttacggttaccggtttaacgggaaaggttacccgggaaccgttaacggttaccctaacccgggttaaccgttaaccgtacccgaaccggacccccgtaaacgggacccccctaaaccccgttacgtcccgttaaccctaccgtttacccgttacccctttcccccgaccccgtttacccgg

SEQ ID NO: 259416 - DNA, 527 bp, Homo sapiens
  misc_feature: GYAE6OF01DJTEW.15.66.F11.1.454.CMB.1.raw
  modified_base (226)..(226): a, c, t, g, unknown or other
  misc_feature (226)..(226): n is a, c, g, or t
  modified_base (428)..(428): a, c, t, g, unknown or other
  misc_feature (428)..(428): n is a, c, g, or t
  modified_base (499)..(499): a, c, t, g, unknown or other
  misc_feature (499)..(499): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccatttggngatttataactatgtctcctggtaccagcagcacccaggcaaagccccaaagtcatcattatgagctcactaagcggccctcgagggtccctgatcgcttctctggctcaagtctggcgactcggcctcctgaccgtctcgtggctccgagcctagaagatgagtctgtattattctgcgtctcatagtggatacaattacngtctttgtcgttcggaagtacggactaaggtcctaccgtctaagtcaacgacccaacggcccaaacccctntcgtcctacttctctccccaccctcccg

SEQ ID NO: 259417 - DNA, 746 bp, Homo sapiens
  misc_feature: GYAE6OF01DL179.15.66.F11.1.454.CMB.1.raw
  modified_base (307)..(307): a, c, t, g, unknown or other
  misc_feature (307)..(307): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctcgcgtccggtctcctggacagtcagtcaccatctcctgcacgtaggaacctagtttggtagtatttaataactatcgtcctaccgtggtaccagcacgccaccgaggaccaaacgaccccaaagtcatactatttangacgtctacgaacgtaacggccggtaccccgtacggtaccgggttccctagtaccgttccgtcgttcgtaccgtcggtacctaccgtaagttccgtcggaccgtaccgtcccggtccctccgtcgtacccgttccgtcggtccggtcctaccgacgtccgtaaggaacgtagtacggagtacgttagtacttttacgttcgtacggtccgttactacgtagttacggtacggtaacgtaacttaacgttacgttaacgtttccgtttacggttaccgggttaacgggtaacggttaccggtaccgtaaccggttacccgtaaccgttaaccgtaacggtacccgtaacccggaacccgtaacccggacccctaacccgttcgttaccgtacccgtacccttacccggtttccccccggttccctcccccggtttacccg

SEQ ID NO: 259418 - DNA, 721 bp, Homo sapiens
  misc_feature: GYAE6OF01CU7NJ.15.66.F11.1.454.CMB.1.raw
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaacctatttggtgattataactatgtctcctggtaccagcagcacccaggaccaaacgccccaaagtcatcatttatgagctacactaacgccggccctacgacgggtccctgactccgtcttctcgtcggcctcctaagtccgtggccgtacgtccggccctccctcggtacccgtcgtccgtcgggcctcccgtacgtcccgtaggaacgtagtggacggtcgttggttaactttagttttccgtcgggtaccggtctttaccgtaattacggtacgggtaactaaacttaaacgtttaacgtacggtttaccgtttttacggtaccggttttacgggaacggtttacggggtaacccgtaaaggggtttaccccaacccggttaccccggttaaagtcccgtaaaccgggaccccccaaacggtacccccgaaacccccctagttcccggtaccctaacccgtttacccgttcccgttacccccctaccccgtttaccccg

SEQ ID NO: 259419 - DNA, 560 bp, Homo sapiens
  misc_feature: GYAE6OF01EH186.15.66.F11.1.454.CMB.1.raw
  modified_base (225)..(225): a, c, t, g, unknown or other
  misc_feature (225)..(225): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctcgcgtccgggtctcctggacagtcagtcaccatctcctgcactggaaccattggtnattataactatgtctcctggtaccagcagcaccaggcaaagccccaaagtcatcatttatgagctcactaagcgccctcgagggtccctgactcgcttctctcggctccaagtctggcactcgcctcctgaccgtctctgggcctcgagcctgacgatgagctgatttatttctgcggtctctatagtcggagtactaattacgagtctttggtctttacgggaagttcggggaacctaagggttccaacccggttacctaaacgtccaacgcccgaaacggccccaaaccccgtatcgttccaaccttccttaccgttccccaccccttacccg

SEQ ID NO: 259420 - DNA, 568 bp, Homo sapiens
  misc_feature: GYAE6OF01BYOYX.15.66.F11.1.454.CMB.1.raw
  modified_base (219)..(219): a, c, t, g, unknown or other
  misc_feature (219)..(219): n is a, c, g, or t
  modified_base (225)..(225): a, c, t, g, unknown or other
  misc_feature (225)..(225): n is a, c, g, or t
  modified_base (230)..(230): a, c, t, g, unknown or other
  misc_feature (230)..(230): n is a, c, g, or t
  modified_base (235)..(235): a, c, t, g, unknown or other
  misc_feature (235)..(235): n is a, c, g, or t
  modified_base (542)..(542): a, c, t, g, unknown or other
  misc_feature (542)..(542): n is a, c, g, or t
  modified_base (561)..(561): a, c, t, g, unknown or other
  misc_feature (561)..(561): n is a, c, g, or t
tcagtctacgtagccacgaccggtgctcgatttagtcacgcgagaagggggggtctcaggaggtcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctctgcatggaacnttggtnattanaactntgtctctggtaccagcagcaccaggacaaacgccccaaagtcatcattatgagctcactaacgcggccctcgacgggtccctgactcgtccttctcgtggccttaccgaagtcgttgggaccgtacgtccggccctcccgtcggtacccgttctcgtcgggcctcccgaacgtcctaggaacgagttggaacgtctagtatttagtttcgtgcggtctctatagtggagtaacaattacagttctttggtcttagggaagttcgggactaggtctaccgtctaagtcacgcccaaggcccaaccctntcgtcactctcgttccccnccctccg

SEQ ID NO: 259421 - DNA, 612 bp, Homo sapiens
  misc_feature: GYAE6OF01DX4WS.15.66.F11.1.454.CMB.1.raw
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctgggcagtcagtcaccatctcctgcactggaaccattggtgattataactatgtctcctggtaccagcagcacccaggcaaacgccccaaagtcatcattatgagctcactaagcggccctcgaggggtccctgactcgcttctctggctcaagtctgcgactcggcctccctgacccgtctcgtcgggcctccgagtccctagaacgtagtggaacgggcttagtaatttagtttcctggccggtcttcaattagtagggagtaactaatttaacaggttcgttttcggtcctttacggggaaaggttcgggtaacctaaaggttcccaaccggttccctaaaggttccgaacgtaccccgaacgggaccccaaacccctattaccgggtccaaccgttccttcggttcccccgcccttaccccgg

SEQ ID NO: 259422 - DNA, 767 bp, Homo sapiens
  misc_feature: GYAE6OF01BRNXY.15.66.F11.1.454.CMB.1.raw
  modified_base (222)..(222): a, c, t, g, unknown or other
  misc_feature (222)..(222): n is a, c, g, or t
  modified_base (229)..(229): a, c, t, g, unknown or other
  misc_feature (229)..(229): n is a, c, g, or t
  modified_base (324)..(324): a, c, t, g, unknown or other
  misc_feature (324)..(324): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcacgcctccctccgcgtccggtctccgtggacagtcagtccaccatctcctgcactggaaccngttggtnattataactatgtctccgtggtaccagcagccaccaggacaaacgccccaaagtcatctattatgagctacactaagccgcctcgacgggtcccngactcgcttctcgtggcctcaagtcgtggcgactcggcctccgtcgacctcgtcgtcgggcctccgacgtccgtaggaagacgttcggaacgggtccttagttaacgtttacgtttcgtacgggtccggtaccttaccgtaagttaacggtagggtaaacgtaaccgttaaacgttttaaccgtaacgttttccgtttttaccgggttaccggttttaaaccgggggtaaacgggtttaaccggggaaccccggttaaacgggttaccccttaacccgggtttaacccgttaaacggttacccggtaaaccccggacccccggttaaaaccccgggaacccccctaaaaccccccgttaacgttaccccgggttaacccctaacccggttttccccgtttcccccgttaaaccccccccgtacccccgttttaaccccccggg

SEQ ID NO: 259423 - DNA, 598 bp, Homo sapiens
  misc_feature: GYAE6OF01DNEDL.15.66.F11.1.454.CMB.1.raw
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatcctcctgcactggaaccattggtgatttataactatgtctcctggtaccagcagcaccaggaccaaacgccccaaagtcatcatttatgagctcactaacgccgccctcgacgggtccctgactcgtcttctctcggctcgaagtcgtggccgacgtccggcctcccgtcgaccgtctcgtcggcctccgagcctagaacgagtggaggtcttagtactttagttcgtcggcggtcttacgattagtacggacgtaactaattacgagttcgtttcgtcgttacggtaagtcgggacctaacggtccaccggttactaacggtaccgacgtacccgaacggaccccaaccccgtgtaccgtcctaccttccgttccgtcccccgtcccttcccg

SEQ ID NO: 259424 - DNA, 748 bp, Homo sapiens
  misc_feature: GYAE6OF01D76R6.15.66.F11.1.454.CMB.1.raw
  modified_base (228)..(228): a, c, t, g, unknown or other
  misc_feature (228)..(228): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaacctattggtnattataactatgtctcctggtaccagcagcaccaggacaaacgccccaaagtcatctattatgagctacactacgccggccctgacgggtcctgactcgtcttctcgtcggcctaccgaagtcgtggccgtacgtcccggcccttcccgtcggtaccccgttccgttcggtccgggtcccttcccgacgtcccgttaaggaacgtacgtacggacggtccgttaaggttaattttacgtttccggtcgggtccggttaccttacgtaacgtttaggtacgggtaacgtaaccgttaaacgtttaaccgtaacgtttccggttttacgggttaccggtttaacggggtaaacgggttaccggggtaaacccgttaacggggttacccctaacccggttacccgtaaacggttcccgaaaccggtacccccggaaaacggtaccccccaaaaccccgtacgttaccgtacccttaacccgttcccgtttaccccggtttcccccctaaccccgtttaccccg

SEQ ID NO: 259425 - DNA, 612 bp, Homo sapiens
  misc_feature: GYAE6OF01DO5D4.15.66.F11.1.454.CMB.1.raw
  modified_base (220)..(220): a, c, t, g, unknown or other
  misc_feature (220)..(220): n is a, c, g, or t
  modified_base (226)..(226): a, c, t, g, unknown or other
  misc_feature (226)..(226): n is a, c, g, or t
  modified_base (387)..(387): a, c, t, g, unknown or other
  misc_feature (387)..(387): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctcctccgcgtccgggtctcctggacagtcagtcaccatctcctgcactggaaccntttggnattataactatgtctcctggtaccagcagcaccaggcaaacgccccaaagtcatcatttactgagctcactaagccggccctcgacgggtccctgactcgcttctctggctcaagtctggcgacgtccggcctcccgtgacccgtctcgtcgggctccganccgtgaacgatggacggtctgtatttatttcgtgcggtctcgtaattagtaggatactaattacacgttcgttttacgttcggtttacggaaggttacgggaaccgtaacgggttccaaccggtttacccgtaaacgttccgaacggacccccgtaaacgggacccctaaaccccctgtaccgttacaacccttccgtttacccgttcccccgcccttaccccgg

SEQ ID NO: 259426 - DNA, 681 bp, Homo sapiens
  misc_feature: GYAE6OF01B2XM2.15.66.F11.1.454.CMB.1.raw
  modified_base (293)..(293): a, c, t, g, unknown or other
  misc_feature (293)..(293): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagccaccaggaccaaaacgccccaaagtcatctatttangagctacaactaacgccggccctcgacggggtccctgactccgtcttctctcggcctccgaagtctgggcgaccgtccggccctcccgtcgtacccgtctccgtcgggcctccgacgtccctagaaacgtagtggaggtccttaggtattttacgtttcgtcggtcggtcctactaagttacgtcgggtaacgtaactaaacgtttaccgtagtttccgttttaggttaccggtttaagggaaacggttacgggaacccgtaaacggttcccgtaacccggttaccgtaaacggtaccgaaccggtaaccccgaaccggtacccccaaaccccgtacgttaccgtacctaccgttcccgttcccgttaccccctaccccgttaccccg

SEQ ID NO: 259427 - DNA, 678 bp, Homo sapiens
  misc_feature: GYAE6OF01DCSTD.15.66.F11.1.454.CMB.1.raw
  modified_base (227)..(227): a, c, t, g, unknown or other
  misc_feature (227)..(227): n is a, c, g, or t
  modified_base (291)..(291): a, c, t, g, unknown or other
  misc_feature (291)..(291): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccattggnattataactatgtctctggtaccagcagccacccgaggcaaaacgccccaaagtcatcatttangagctcactaacggccgccctgacgggtccctgactccgtcttcctcgtggcctacctaagtcgtcggccgtaccgtccggccctcccgtcgaccgttctcgtcgggtcctcccgagtccgtagaagtagtcgaggtctagtaattttacgttcgtcggccggtctacgtaagttagtagggaactaactaagtttaaccacggtttacgttttcgttaccgttaacggggtaacggttacggggaacccttaacgggttccctaaaccccggttaccttaaacggtccgaaacccggaccccgtaaaccgggccccctaaaaccccccgtgttaccgtaacccctacttccccgtttacccgttacccccctaaccccgttccccg

SEQ ID NO: 259428 - DNA, 731 bp, Homo sapiens
  misc_feature: GYAE6OF01B7NVS.15.66.F11.1.454.CMB.1.raw
  modified_base (298)..(298): a, c, t, g, unknown or other
  misc_feature (298)..(298): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattaataactatgtcctccgtggtaccagcagccaccgaggacaaaacgccccaaaagtcatctatttacngacgctacactaacggccgccctcggacgggtccctgactcgtcttctctcggcctccgaagtcgtcggccgtaccgtccggtccctcccgtcggtacccgttcgtcggtcgggtcccttccgacgtcccgtaggaaacgtcgtacggtacggtcttaggttaacttttacgtttcgtcgggtcccggtacttacgtaagttacgtacgggaaacgtaaccttaaacgttaccgtaacgtttcgttttacggttaccggttacgggtaaaggttccggggtaaccctaacgggttaccccgtaaacccggtttaccgttaaacggtcccgaaacccggtaccccgtaaaaccgggacccccctaaaccccgtacgttcccgtaacccttaaccgttacccgttacccgtttaccccccgccccgtttaccccg

SEQ ID NO: 259429 - DNA, 781 bp, Homo sapiens
  misc_feature: GYAE6OF01CH7UG.15.66.F11.1.454.CMB.1.raw
  modified_base (226)..(226): a, c, t, g, unknown or other
  misc_feature (226)..(226): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtaagtcaccatctcctgcactggaaccattggtnattataactatgtctcctggtaccagcagccaccaggacaaacgcccccaaagtcatctatttatgagctcactaacgccggccctcgacggggtccctgactccgtcttctcgtcggcctaccgtaacgtctcgggccgtaccgtccggtccccttcccgtcggtacccgttccgttccgttacggggtccctacccgacggtcccgttaggaaacggtagtacggtaggtccgttagtaacgttttacgttttccgtcggtaccgggtaccttacgtaacgtttagtacgggaacgtaacctaaagtttacgaacgtttcgttttacggttaccggtttacgggtaacgggttaccggggtaaacccgttaacggggttacccgttaaacccggttacccgttaaaacggtacccggtaaacccggtaacccccgaaaccgggtaacccccccaaaaccccccgttaccgtttacccggttaccccttaaccccggtttaccccgtttacccggtttacccccccccggtccccttttaccccggtaccccgg

SEQ ID NO: 259430 - DNA, 719 bp, Homo sapiens
  misc_feature: GYAE6OF01C7BB7.15.66.F11.1.454.CMB.1.raw
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
tcagtctacgtagccacgaccggtgctcgatttagtcacgcgagaagggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaacctnttggtntattanaactatgtctccgtggtaccagcacgccacccgaggacaaacgcccccaaaagtcatactattatgacgtctacactaacgccggtccctacggacgggtccctgactccgtcttcctcgtcggtcctccgtaacgtcgtcgggaccgtacgtccggtccctccccgttcggtacccgttccgtcgtccggggtcctcccggacgtccctaggaacggtacgtaggacgggtcttacggtaattttacgtttccgtcggtccggtcttacgagttacggtcggtaacgtaacttaacgttaaccgttagttacgttttacggttccgttaacggggtaacggttaccgggtaaccgtaacgggttacccgtaaccgttacccgtaagggtacccgaaccggaccccgtaaaccgggaccccaacccccgttagtacccgtaccttacccttacctttccccggttacccctccccgttaccccgg

SEQ ID NO: 259431 - DNA, 692 bp, Homo sapiens
  misc_feature: GYAE6OF01CPAC2.15.66.F11.1.454.CMB.1.raw
  modified_base (223)..(223): a, c, t, g, unknown or other
  misc_feature (223)..(223): n is a, c, g, or t
  modified_base (297)..(297): a, c, t, g, unknown or other
  misc_feature (297)..(297): n is a, c, g, or t
tcagtctacgtagccacgaccggtgctcgatttagtcacgcgagaagggggggtctcaggaggcagcgctctcaggacgtcaccaccatggcctgggctctgctcctcctcaggcctcctcactcgagggcacagggtcctgggcccagtctgcctgactcagcctcctccgcgtccgggtctccaggacagtcagtcaccatcctcgtgccactcggaaccngttggtagaattaataactagtgtctacctaggtaccagcagacaccaggacaacgcccaaagtcatctattangacgctacactaacgccgacctcgaccggtcctaggctcgtcttactcgtacggtcctacgtaacgtctacgggccgtacgtccggtaccctcgtacggtaccgtcgttaccgtggtcctaccgacgtaccgtaggtaacgtagttacggaacggtcttagtattttacgttcgtacggtcgggacttacgtagtaggtacgaacgtaacgtaaactttaccggaacgtttcgtttaccggttacggttaacgggtaacggttaccgggaaaccgtaccggttaccctaacccggttacccgtaaagtaccggaaacccgtccccggaaaccggtacccccaacccgtcgtacccgtacctaccgtccgttaccccggtcccctcccgttaccgg

SEQ ID NO: 259432 - DNA, 774 bp, Homo sapiens
  misc_feature: GYAE6OF01EAV7R.15.66.F11.1.454.CMB.1.raw
  modified_base (114)..(114): a, c, t, g, unknown or other
  misc_feature (114)..(114): n is a, c, g, or t
  modified_base (243)..(243): a, c, t, g, unknown or other
  misc_feature (243)..(243): n is a, c, g, or t
  modified_base (257)..(257): a, c, t, g, unknown or other
  misc_feature (257)..(257): n is a, c, g, or t
tcagtctacgtagccacgaccggtgctcgatttagtcacgcgagaaggggggggtctcgaggaggcagcgctctcaggacgtcaccaccatggcctgggctctgcctcctcctnagccctcctcactcgagggcacgagggtcctgggcccagtctcgccctgactcacgccctccctccgcgtccggtctcctggacagtcagtccaccatctccgtgccacgtcggaacctagtttggtanaatttaataacttntcgtacctccgttaggtacctgcacgtaccaccgtaggaccaaaccgacccctaaagtctatcgtattagtcgacgtctacgacgtaacggccgtcccgtacggacgggttcctgtactcgtcttcgtcgtcgcctacgacgttcgtcggacgtaccgtccggtaccctcccgtcgtacccgtcgttccgtacggtcctccgacgtccgtaagtaacgtacgtagggtaccgtacttaggttaacttttcggtttaccgtcggtacgggttaccttacggtaacgtttacggaacgggtaacgtaacgttaaacgttacgttacgtttccgtttacgggttacccgttaacggggtaacggttaccgggtaaaccgttaacggtaacccgttaccggtaaccgttaaggtcccgtaaacccggtacccgttaaacccgggaccccttaaaccccgtacgttaacgttaaccctaccgtttaccccggttacccgttaccccccctcggttacccccg

SEQ ID NO: 259433 - DNA, 529 bp, Homo sapiens
  misc_feature: GYAE6OF01CNX30.15.66.F11.1.454.CMB.1.raw
  modified_base (224)..(224): a, c, t, g, unknown or other
  misc_feature (224)..(224): n is a, c, g, or t
  modified_base (384)..(384): a, c, t, g, unknown or other
  misc_feature (384)..(384): n is a, c, g, or t
  modified_base (418)..(418): a, c, t, g, unknown or other
  misc_feature (418)..(418): n is a, c, g, or t
  modified_base (500)..(500): a, c, t, g, unknown or other
  misc_feature (500)..(500): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctcgcgtccggtctcctggacagtcagtcaccatctcctgcactggaaccattggtnattataactatgtctcctggtaccagcagcaccaggcaaacgccccaaagtcatcattatgagctcactaagccgccctcgacgggtccctgactcgcttctctgctccaagtctggcgactcggcctcctgaccgtctcgtcggctccagcctagaagngtgaggctagtatttattcgtgcgtctctatagngagaactaattcagtctttgtcttcggaagtcggactaaggtccaccgtctaagtccgacgtacccaaggccccaacccgtntcgtctactctccgttccccaccgtcccg

SEQ ID NO: 259434 - DNA, 632 bp, Homo sapiens
  misc_feature: GYAE6OF01D6501.15.66.F11.1.454.CMB.1.raw
  modified_base (227)..(227): a, c, t, g, unknown or other
  misc_feature (227)..(227): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaacctattggtnattataactatgtctcctggtaccagcagccacccgaggcaaacgccccaaagtcatctatttatgagctcactaaggccggccctcgtacggggtccctgactcgtcttcgtctcggccttaccgaagtcgtggccgtaccgtccgggcccttcccgtcgacccgtcgtcgtcgggtcctccgagtccctagaagtagtggacggtctagtactttacttccgtggccggtctacgagttagtggaactaactaagttacagttccgttttaggtccgtttagggaacgttcgggaccaaggttccctaaccggtccgtaaagtccgaacggtaccccaacggtaccccaaccccgtacgtccgtaccctaccttccttacccgttccccctacccgttccccg

SEQ ID NO: 259435 - DNA, 643 bp, Homo sapiens
  misc_feature: GYAE6OF01A16P4.15.66.F11.1.454.CMB.1.raw
  modified_base (253)..(253): a, c, t, g, unknown or other
  misc_feature (253)..(253): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaacccattggtgattataactatgtctcctggtaccngcagcaccaggcaaagccccaaagtcatccatttatgagctcactaagcgccctcgacgggtccctgatcgcttctctgctcaagtctggcgactcggcctccctcgaccgtctctgggcctccagcctagaacgatgacggtctagtactttatttcgtcgtcggtcttcctaattacgtggaacgtaacctaaagtttaccgtacggttccttttagggttaccgtttacgggtaacggttcggggaacccgtaacgggttccctaacccggttaccgttaaacggttccgaaacccgtaccccgaaacggggtccccccaaacccccgtacgttaccgttaccctaccgtttcccttaccgtttccccccctaccccgtttaccccg

SEQ ID NO: 259436 - DNA, 734 bp, Homo sapiens
  misc_feature: GYAE6OF01DRNH7.15.66.F11.1.454.CMB.1.raw
  modified_base (297)..(297): a, c, t, g, unknown or other
  misc_feature (297)..(297): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctcgcgtccggtctcctggacagtcagtcaccatctctgcactggaacctgttggtgaatttaataactatcgtctccgtggtaccagcacgccaccgaggacaaacgaccccaaagtcatctatttangacgtctacacgtaacgccgtccctcgacgggtccctgactcgtccttctcgtcggcctaccgtaagtccgtacgggccgtaccgtcccggcccttcccgtcggtacccgttcgtcgtcgggccctccgacgtccgtaggaacgtagtcggaacggtcttagttaacttttacgttttcgcgggtccggtaccttacgtaagttacggtaggaacgtaacttaaacgtttacggtacgtttccgttttacgttaccgggtttaacgggaaagggttaccgggaaacccgttaacgggttaccccgtaaacccggtttacctaaaaccgggtccgaaccccggaaccccgaaacccgggtaccccctaaacccccgtagttcccgtaccctacccgtttaccctttccccggttacccccctacccccggtttacccg

SEQ ID NO: 259437 - DNA, 717 bp, Homo sapiens
  misc_feature: GYAE6OF01DYRLJ.15.66.F11.1.454.CMB.1.raw
  modified_base (230)..(230): a, c, t, g, unknown or other
  misc_feature (230)..(230): n is a, c, g, or t
  modified_base (441)..(441): a, c, t, g, unknown or other
  misc_feature (441)..(441): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacgagggtcctgggcccagtctgccctgactcagcctccctcgcgtccgggtctccgtggacagtcagtcaccatctctgctactggaacctagttggtntaatttaataactatcgtcctcgtaggtaccagcagccaccgagacaaacgcccaaagtcatctattatgagctacaacgtaacgccgcctcggacgggtcctgactcgtcttcgtccgtcggtcctaccgtaacgtcgtacgggccgtaccgtccggtcctcctcggtaccgttcgtcgtccgggtctaccgacgtccgttaaggaacgngtaggtcgtcgttagttacgttttacgttcgtcggtccgttactacgtaacgttacggtacggtaacgtaacgttaaacgttcgtaacgtttccgtttaggttaccggtttaaccgggaaagttacggggtaaacccgtaaacggggtttccctaaacccggttaccgttaaaccgggtacccgtaaccgtaaccccgaaacgggtaccccctaaaccctacgttacccgtaccgtacccttccggttacccttacccccggtccccgtttacccg

SEQ ID NO: 259438 - DNA, 769 bp, Homo sapiens
  misc_feature: GYAE6OF01DQ5FW.15.66.F11.1.454.CMB.1.raw
tcagtctacgtagccacgaccggtgctcgatttagtcacgcgagaagggggggggtctcaggaggcagcgctctcaggacgtcaccaccatggcctgggctctgctcctcctcagcctcctcactcgagggcacgagggtcctgggcccagtctgccctgactcacgcctcccgtccgcggtccgggtctccgtggacagtcacgtccacctactcctcctgcctacgtacggaaacctagtttggtagtaatttaaacttaactacgttcgtcctccgtaggtaccagcacgaccaccgaacggaccaaaccgacccctaaagtccaattctaatttagcgacgtctactaacgtaacggccgtccgtacggtaccgggtccgtagtactcgtcttctcgtcgcctacgtacgtcggtcggcgtacgtccggtcctccgtacggtcccgttctccggtacgggtcctacgtacgtccgtaggaacgtgtacgggtacggtcttaggttacttttacgtttcggtacggtcgtacgttataagttacggaagggtaactaacgtaacttacgtacggtttagtttacgggtttacggttaacgggttaacggtaaccggggtaccgttaaccggttaaccgttacccggtaaaccgttaacggacccgtaaaccggtaccccggaaaccgtaccccctaaacccgttaacgtacccgttacccttacccgttacctttaccccgttaacccccctaccgtttaccccgg

SEQ ID NO: 259439 - DNA, 683 bp, Homo sapiens
  misc_feature: GYAE6OF01D8T5X.15.66.F11.1.454.CMB.1.raw
  modified_base (227)..(227): a, c, t, g, unknown or other
  misc_feature (227)..(227): n is a, c, g, or t
  modified_base (291)..(291): a, c, t, g, unknown or other
  misc_feature (291)..(291): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctcgcgtccgggtctcctggacagtcagtcaccatctcctgcactggaaccattgggtnattataactatgtgtcctggtaccagcagccaccaggaccaaacgccccaaagtcatctattangagctacactaacgccggccctcggacggggttccctagtactcgtccttctcgtcggcctaccgaacgttctcgggccgtacgtccggtccctccgtcgaccgttctcgtcggcctcgcgtcctagagtacgtggacggtctaggtactttacgttcgtacggccgtactacgtacgtacgtacggaacgtaaccttaacgttaccgtacggtttaccgttttacgggttccgtttaaccgggagggttacccgggtaaccgtaacgggttcccgttaaacccggttaccgtaaaccggtccgtaaccgaaccccggtaaccggtacccccgaaacccgttcttaccggtccctaacgttccccgtttaccgtaccccctccgttaccccg

SEQ ID NO: 259440 - DNA, 762 bp, Homo sapiens
  misc_feature: GYAE6OF01EPO6J.15.66.F11.1.454.CMB.1.raw
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctctggtaccagcagcaccaggacaaacgccccaaagtcatcatttatgagtctacactaacgcggccctcgacggggtccctgactcgtcttctcgtcggtcctaccgaagtcgtcgggccgtacgtccggtccctcccgtcgtacccgttcttccggtcgggtccttccgacggtcctaggaacgtagtacggacgggtccttaggttaacttttacgttttccgtagggtcccgggtacttacgtaacgtttaacggtacgggtaacgtaaacttaaacgtttaaccgtaacggtttccggtttttacggttaccggttttacggggtaaacgggttaccggggtaaacccgttaaacgggttaccccgtaaacccgggtttacccgttaaaaccgggttacccgaaaccggtaacccccggtaaaaccgggaccccccctaaaaccccccgtacgtttacccggtaccctaaccctttcccgtttaacccgtttccccccgacccccgtttaccccgg

SEQ ID NO: 259441 - DNA, 804 bp, Homo sapiens
  misc_feature: GYAE6OF01CL5TC.15.66.F11.1.454.CMB.1.raw
tcagtctacgtagccacgaccggtgctcgatttagtcacgcgagaaggggggggtctcaggaggcagcgctctcaggacgtcaccaccatggcctgggctctgctcctcctcagcctcctcactcgagggcacgacgggtcctgggcccagtctcgccctgactcacgccctccctccgccgtccggtctcctggacagtcagtcaccatcctcctgctacgtacggaacctagttggtagtaatttaataactattcgttcctaccgtcggtaccagccacggaccaacccgacggaaccaaaaccgaccccccgtaaaagtcctaactacttattttagtcgtaacgtcctacctaaccgtaacggcccggtaccccgtacggtaccggggtcccttagtacgtcgtccctttcctaccgtcggtaccttacccgaaggttcgtaccgggaccgtaccgtcccggtccccttacccgtacggtacccgtttcgtcggtcgggtccctccgacgtaccgtaaggaacgtacgtacggaacggttctttacggttaacttttacgttccggttaccgggaccggtacctttacgtaagttaacgtacgggaaacttaaccgtaagtttaaccgtacgttttacgttttacgggtacgttaacgggtaacggttaccggggtaaccgtaacggttacccgtaacccgtaccgttaacggacccgaaaccgtaccccgaaccggtacccccaacccgttatcccgtacccgttactttcccgacccgttcccctaacccggttccg

SEQ ID NO: 259442 - DNA, 648 bp, Homo sapiens
  misc_feature: GYAE6OF01BV6T8.15.66.F11.1.454.CMB.1.raw
  modified_base (204)..(204): a, c, t, g, unknown or other
  misc_feature (204)..(204): n is a, c, g, or t
  modified_base (228)..(228): a, c, t, g, unknown or other
  misc_feature (228)..(228): n is a, c, g, or t
  modified_base (289)..(289): a, c, t, g, unknown or other
  misc_feature (289)..(289): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccntctcctgcactggaaccattggtnattataactatgtctcctggtaccagcagcaccaggcaaacgccccaaagtcatcatttangagctcactaagcggccctcgacggggtccctgactcgtcttctctggcctcagtctggccgactccggcctcccgtcgacccgtctcgtcgggcctccgagccctagacgtagtcgaggtctagtatttacgtttcgtacgtccggtctactacgttagtgggtaacgtaactaaattacgtagttaccgttttcggttacggtttacggaacggttacgggtaacccgtaacgggttcccgtaacccggttaccgttaaacggtccgaaccgggtaccccaaaccggggtccccaaacccccgtaccgtccgttacccacccgttccgttacccggttcccccgtccccttccccgg

SEQ ID NO: 259443 - DNA, 704 bp, Homo sapiens
  misc_feature: GYAE6OF01BXXU6.15.66.F11.1.454.CMB.1.raw
  modified_base (379)..(379): a, c, t, g, unknown or other
  misc_feature (379)..(379): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcacgcctccctccgcgtccgggtctcctggacagtcagtcaccatcctcctgcacgtggaaacctagttggtagaatttaactaaacttatcgttccttccgtggtaacccagcacgaccaacccgaggaccaaaacgacccccaaagtccaatctatttatgagctacactaacgccggcctcgacgggtccctgactcgtcttctctggctcagtcncgcgacgtcgcctccgtcgaccgtctcgtcgggcctccgacgtccgtagaacgtagtcggaggtctagttaactttgtttcgcggtaccggtctacgtaagttgtaacgggaactaacttaacgtttacgtacgttacgttttaggttaccggtttaacgggtaacggtaccggggaaccttaaacgggtcccgttaaacccgttacccgttaaagggtacccgtaaccggtaaccccggaaacccggtacccccaaacccccgttacgtacccggtacccttaaccttccgttaccccggttccccccggtacccttaccccgg

SEQ ID NO: 259444 - DNA, 612 bp, Homo sapiens
  misc_feature: GYAE6OF01EW448.15.66.F11.1.454.CMB.1.raw
  modified_base (256)..(256): a, c, t, g, unknown or other
  misc_feature (256)..(256): n is a, c, g, or t
  modified_base (297)..(297): a, c, t, g, unknown or other
  misc_feature (297)..(297): n is a, c, g, or t
  modified_base (447)..(447): a, c, t, g, unknown or other
  misc_feature (447)..(447): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaacctattggtgaatttaataactatgtcctctggtaccngcacgcacccaggaccaaacgcccccaaagtcatcatttangagcctcactaacgccggccctcgacgggtccctgactcgtcttctctcggcctacaagtctggcgtactcggccctccctgacccgttctcgtcgggtcctcccgagtcccttaggaacgagtggacggtcttagtagtttatttccgnggtccgctctattagaggagtactaattacgtagttctttagtccgttaggaagtcgggaacctaaggtccaccggttacctaagtccgacgaaccccaacggaccccaaaccccgtataccgttaccctacgttcctttccccggttcccccgcccgttacccg

SEQ ID NO: 259445 - DNA, 784 bp, Homo sapiens
  misc_feature: GYAE6OF01AR5JV.15.66.F11.1.454.CMB.1.raw
  modified_base (227)..(227): a, c, t, g, unknown or other
  misc_feature (227)..(227): n is a, c, g, or t
  modified_base (288)..(288): a, c, t, g, unknown or other
  misc_feature (288)..(288): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctggccccagtctgccctgactcagcctccctccgcgtccgggtctcctggacagtcagtcaccatctcctgcactggaaccattggtnattataactatgtctcctggtaccagcagcaccaggcaaacgccccaaagtcatcatttangagctcactaagcggccctcgacgggtccctgactcgtcttctctggctcaagtctggcacgtcgcctccgtcgaccgtctcgtcgggccttccgacgtccctaggaacgtacgttacgggacggtcttacggtaattttacgttttaccgtcgggtcccgggtaccttaccgtaagtttaacgttacggggtaacgtaaaccttaaacgttttaaccggaacggtttacccgttttttacgggttaacccggttttaaccgggggtaaaacgggtttaccgggggtaaaccccgttaaacggggttaccccgtaaacccccgggtttaaccccgttaaaaccgggttaccccggtaaacccgggtaaccccccgggtaaaaccggggtacccccccctaaaaacccccccggttacgttacccggtttaaccccttaacccgtttccccgtttaccccgggtttacccccccctaacccccggtttaccccccgg

SEQ ID NO: 259446 - DNA, 652 bp, Homo sapiens
  misc_feature: GYAE6OF01B4WN6.15.66.F11.1.454.CMB.1.raw
  modified_base (288)..(288): a, c, t, g, unknown or other
  misc_feature (288)..(288): n is a, c, g, or t
  modified_base (638)..(638): a, c, t, g, unknown or other
  misc_feature (638)..(638): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcaccaggcaaacgccccaaagtcatcatttangagctcactaagccggccctcgaggggtccctgatcgtcttctctggctaccaagtctcggcgactccggccctcctcgaccgttctcgtcgggctccgagcctagaagtactaggacggtctagtatttactttcgtcggtccggtacctacgtaagttagtacgggaagtaactaacgtttaacgacgtttacgttttcggttaccgtttaacgggtaaaggttccgggtaacctaacgggttccctaacccggttaccttaaacggtccgtaaccgaccccgtaaaccggccccctaaaaccccgtcgttaccgtaccctacccgttaccttacccggtttcccccncccccgtttacccg

SEQ ID NO: 259447 - DNA, 643 bp, Homo sapiens
  misc_feature: GYAE6OF01DXBQM.15.66.F11.1.454.CMB.1.raw
  modified_base (442)..(442): a, c, t, g, unknown or other
  misc_feature (442)..(442): n is a, c, g, or t
  modified_base (483)..(483): a, c, t, g, unknown or other
  misc_feature (483)..(483): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatcctcctgccactggaacctagtttgggtagtaatttaataaacttattcggttcctccgtaggtaacccagccacgccacccgaggaccaaacgcccccaaaagtcatctatttatgagtcctacacgtaacggccggccctcggacgggtccctgactccgtcttctcgtcggcctaccgaagtctcggccgtaccgtccggtccctcccgtcgcccgttctcgtcgggcctccgngtccgtagaagtgtgagtcttgtatttgttcgtggcgtctnagttagtaggaacgtactaattacgtagttcgtttgtccgttagggtagtacgggtacctaacggtccctaaccggttacctaacgtaccgaccgacccgaaccggccccaaacccctgtaccgtcctacccttccgttacccttcccccgtccttcccg

SEQ ID NO: 259448 - DNA, 564 bp, Homo sapiens
  misc_feature: GYAE6OF01EW1NS.15.66.F11.1.454.CMB.1.raw
  modified_base (235)..(235): a, c, t, g, unknown or other
  misc_feature (235)..(235): n is a, c, g, or t
  modified_base (296)..(296): a, c, t, g, unknown or other
  misc_feature (296)..(296): n is a, c, g, or t
  modified_base (421)..(421): a, c, t, g, unknown or other
  misc_feature (421)..(421): n is a, c, g, or t
  modified_base (553)..(553): a, c, t, g, unknown or other
  misc_feature (553)..(553): n is a, c, g, or t
tcagtctacgtagccacgaccggtgctcgatttagtcacgcgagaagggggggtctcaggaggcagcgctctcaggacgtcaccaccatgggcctgggctcgtgctcctcctcagcctcctcactccagggccacacgggtcctgggcccagtctgccctgtactcagcctccctaccgcgtccgggtctcctggacagtcagtcaccatctcctgcacgtggaaccattcggtnattataactagtgtctctggtaccagcagcaccaggcaaacgccccaaagtcatcatttangagctcactaagcggccctcgacgggtccctgatcgtcttctctggctccaagtctggcgactcgcctcctgaccgtctcgtgggctaccgacgtccagaagagtggagtctagattacgttcgngtccggctcagtagtggacgactattacgagtctttgtcgttaggacgtcgggacctaggtccgtaccgttccaagtccgtacgcccgaacggccccaaacccgtgtaccgtccaccttcctccgttccccncccgttacccg

SEQ ID NO: 259449 - DNA, 726 bp, Homo sapiens
  misc_feature: GYAE6OF01CSYPL.15.66.F11.1.454.CMB.1.raw
tcagtctacgtagccacgaccggtgctcgatttagtcacgcgagaaggggggggtctcaggaggcagcgctctcaggacgtcaccaccatggcctgggctctgctcctcctcagcctcctcactcaggacacagggtcctgggcccagtctgccctgactcagcctgcctccgtgtctgggtctcctggacagtcgatcaccatctcctgcactggaaccagcagtgagttggttgggggttactctaccttgtcttcctaggtaacccaacacccaccccggcacgaccgaccccccaaactcatagtatttagtgacgacctaacgtaacgccgaccctcgacgggttctttactaactcgtcttcgtcgtcggaccttaccgtaacgtccgtacggactaaccgaccggtcccctcccgtacgaacctaacttccgttcgtcgggtccctaccgacgggtccgtacggaaccggaacggtacggttacttaaacgtttactttacgtcggtactacgtacctactaacgtttataagggttaaaggtttaaacctaacttaacgtttaacgttaaccgtttaacggttaccggggaacggggtaacgggaacctaacggtcctacggtacccggtccgtacggccgttaccggacccggacccgtaaccggtcccgtaccccggtcccccgttacggtaccctcccgttcccgtttacccccg

SEQ ID NO: 259450 - DNA, 815 bp, Homo sapiens
  misc_feature: GYAE6OF01C5D2B.15.66.F11.1.454.CMB.1.raw
  modified_base (151)..(151): a, c, t, g, unknown or other
  misc_feature (151)..(151): n is a, c, g, or t
  modified_base (803)..(803): a, c, t, g, unknown or other
  misc_feature (803)..(803): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtccncgtccgtacgtactacgccgtccctcccgtccgtccggtccgtcctcggtacgacgtcgtacgtacgtaccaactcgtccgttcgccgaccgtacggtaccgtaaaccgttggttacggtaacgtttaacttaaaccgttaacgttcggttccgttaccgtaccggttaccgtaccgtacgaaccgtaccgaaccccgtaacgggacgaaaaccctaacccccgtaaccgttatcttaccttaagtttacgttaggacgtacctactaacgtaacggtccggcccgtaccgtaccgggttaccgtctagttcccggtcttttccgtccgtacggccgttacccgttaacggttacgttccgggaccgtaccgttcccgggtaccctacccgttcggtaacccgtttctaccgggtcggtccttacccgacgtaaccgtgtaacggtacgtcggtaccggtcgtaacgtttattaccgtttcgacggtcgtacttacactaggttcgaaacgtactaacgtttacgtcggttacgtttcggttcggttaacggtacggacggttaccgtaccgtacgttaccgtacccgtagttaccgaccgtaccgaacctacccggtacctacgtagtcctaacgtccttaccggttcccnccgttcctacgg

SEQ ID NO: 259451 - DNA, 768 bp, Homo sapiens
  misc_feature: GYAE6OF01C6JKC.15.66.F11.1.454.CMB.1.raw
  modified_base (203)..(203): a, c, t, g, unknown or other
  misc_feature (203)..(203): n is a, c, g, or t
  modified_base (206)..(206): a, c, t, g, unknown or other
  misc_feature (206)..(206): n is a, c, g, or t
  modified_base (300)..(300): a, c, t, g, unknown or other
  misc_feature (300)..(300): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcacgccctccctccgcgtccggtctcctggacagtcagtcacntcncctgcactggaacctagttggtatattaataactatcgtctcctggtaccagacacgaccaccgagaccaaaacgccccaaagtcatctattangacgctacactacgccgcctcgacgggtcctagtacgtcgtcttaccgtcgtcggaccttacgaacgttccgtacggggcctaccgtcccggtccccttacccgtccgtaccccggtttccgtcggtaaccggttcccacccggttacgacccgttaggaaacggtacgtagggtaacgggtcttaggttaacttttacgttccggtcgcggttacctacgtaagttacgttacgggaactaacttaaagtaccgttaagttccgtttttacggtaccggttaacggggtaaacgttaccggggtaacctaacggggttaccccctaaaccggttacccgtaacgggtaccctaaacccgggtaaccccgaaaccggtaaccccccctaaacccgttaccggtttctaaaaccccgtttcccgttacccgttttaccccgggttcccccccttaaccccggtttccgg

SEQ ID NO: 259452 - DNA, 845 bp, Homo sapiens
  misc_feature: GYAE6OF01EFOU8.15.66.F11.1.454.CMB.1.raw
  modified_base (256)..(256): a, c, t, g, unknown or other
  misc_feature (256)..(256): n is a, c, g, or t
tcagtctacgtagccacgaccggtgctcgatttagtcacgcgagaaggggggggtctcaggaggcagcgctctcaggacgtcaccaccatggcctgggctctgctcctcctcagccctcctcactcagggcacagggtcctgggcccagtctgccctgactcacgcctcccgtccgcgtccgggtctccgtggacagtcagtcaccatcctcctgcacgtacggaacctagtttggtagtaatttaattaaacctnttcggttccttccgttagggtaacccagaccacggccaaccccgaaggtaaccaaaaccggacccccctaaaagtcctaacttacctaattttatcggaacgtccttaaccgaaccgttaaacggcccggtcccctacggtaaccggggttccccttaggacgttcccgtccttttccgtacgttcggtacccttaccgtaacggttccgtacgggacccgtaccgtcccgggtaccccttaccccggtcgtaccccgttcttccgggtaccgggtccctttacccgaacggtcccgttaaggaaacggtacgtacgggtaacggttaccttaaggtttaacttttacggtttcccgtacgggtcccggttaccttaaccgtaagtttacggtacgggtaaacctaaacgtttaacgttaaccgttaggtttaccgtttttacgggtaccgtttaacgggacggttacgggaacccgttaacgggtccctaaccgttaccgtaacggtccgaaccgtaaccccaacggtacccctaacccctgttaccgtaccctaccgttcccttcccgttccccctcccgttacccg

SEQ ID NO: 259453 - DNA, 655 bp, Homo sapiens
  misc_feature: GYAE6OF01BAGYF.15.66.F11.1.454.CMB.1.raw
  modified_base (310)..(310): a, c, t, g, unknown or other
  misc_feature (310)..(310): n is a, c, g, or t
  modified_base (313)..(313): a, c, t, g, unknown or other
  misc_feature (313)..(313): n is a, c, g, or t
  modified_base (375)..(375): a, c, t, g, unknown or other
  misc_feature (375)..(375): n is a, c, g, or t
tcagtctacgtagccacgaccggtgctcgatttagtcacgcgagaacggggggggtctcaggaggcagcgctctcaggacgtcaccaccatggcctgggctctgctcctcctcagcctcctcactcagggcacagggtcctgggcccagtctcgccctgactcacgccctccctccgcgtccggtctcctggacagtcagtcaccatctctgcacgtaggaacctagttggtagtaatttaactaactatcgtcctccgtggtaccagcacgaccaccgaggaccaaacgaccccaaagtcatctattanganctacacgtacgccgtcctacggacgggtcctgtactccgtcttctcgtcgcctacgagtcgnggccgtaccgtccgcctccgtacgtaccgtcgtacggtcggcctccgacgtaccgtagaacgtacgtcgacgttctagttactttacgttcgcggtccgtctactagtagtacggaactaacttaaacgtcgtacgttcgtttagttaccggttacgggaagtaccgggaaccgtaacggtcccgtaaccgttacgtaacggaccgaccgaacccgaccgtaaccccacccgtattaccgtaaccctacgttccccgtcccgttccccgtcccgtcccgg

SEQ ID NO: 259454 - DNA, 704 bp, Homo sapiens
  misc_feature: GYAE6OF01C5DXD.15.66.F11.1.454.CMB.1.raw
  modified_base (660)..(660): a, c, t, g, unknown or other
  misc_feature (660)..(660): n is a, c, g, or t
tcagtctacgtagccacgaccggtgctcgatttagtcacgcgagaagggggggggtctcaggaggcagcgctctcaggacgtcaccaccatggcctgggctctgctcctcctcacgcctcctcactcagggcacgagggtcctcgggcccagtctcgccctgactcacgccctccctccgccgtccgggtctcctggacagtcagtcaccatcctcctgcacgtcggaacctagttggtagtaattaactaacttatcgtctccgtcggtaccagcacgaccaccgagaaccaaaaccgaccccaaagtcattactaatttagcgtacgtcctacgaacgtaacggcccggaccctaggtaccgggtccctagtactcgtccttcgtcgtcggtcctacgtaacgtcgtcggacgtaccgtcccggtccctccgtacggtacccgttcgtacggtccggtcctaccggacgtaccgtaaggaacgtacggtcgtacggtctttagttactttacttcggcgtcgtctacgtataggtacgaattaacgtaagttactaggtttcgttaggttccgaacgggtaacgtacggtacctacggttacccgtaccgttaccgtaacgccgtaacccgacccgtaaccgtaccccctaacccgtnttaccgtacctaccgttacccttaccctccccgtccccgtaccg

SEQ ID NO: 259455 - DNA, 739 bp, Homo sapiens
  misc_feature: GYAE6OF01C61R1.15.66.F11.1.454.CMB.1.raw
  modified_base (166)..(166): a, c, t, g, unknown or other
  misc_feature (166)..(166): n is a, c, g, or t
tcagtctacgtagccacgaccggtgctcgatttagtcacgcgagaagggggggtctcgaggaggcagcgctctcaggacgtcaccaccatggcctgggctctgcctcctcctcagcctcctcactcgagggcacgagggtcctcgggcccagtctgccctgactcngcctccgtcgcgtccggtctccgtggacagtcacgtcacctatctcctgccacgtcggaaacctgttggtatacttaataaccttagtcgttcctaccgtaggtaccaggaccacgaccgaccgaggtaaccaaaccggccccctaaaagtccagttacctaagtttaacgtgaacgtaccttacgaacgttaaccgcccgtaccgtacggtaaccgggtccctagtaccgtcgtcttcgccgtgtacctacgtacgtcgtacgccgtacgtccggtacctcgtcgacgttcgcgtacggtaccacggtactccgtaagacgtaagcgtatagttattacttcgtacgcggtactacgagtcgtaggtaacgtaactacgttacgtacgttacgtttaccggtaacggttaccggtaagggtacgggtaacccgtaccgggttaaccgttcccggtaaccgttaccggtaccgtaccggtaaaccccgtaccgggtaacccctaaacccgtccttaaacggtccctaaacgttccccgttacccttaccccccgtcgttacccgttaacccgg

SEQ ID NO: 259456 - DNA, 695 bp, Homo sapiens
  misc_feature: GYAE6OF01BRSGT.15.66.F11.1.454.CMB.1.raw
  modified_base (297)..(297): a, c, t, g, unknown or other
  misc_feature (297)..(297): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaacctagttggtagaatttaataactatgtcttcctggtaccagcagccaccaggacaaacgccccaaagtcatctattangacgctacactaacgccggccctcgacgggtccctgactcgtcttctcgtcggcctacaagtcgtcggcgacgtccggacctccgtcgtaccgtctcgtcggcctccgacgcctagaacgtataggacgtctagttatttactttcgtgcggtcttacgtaattacgtaggaacgtaactaaacgtttacgtaacgtttccgtttttaggttaccgttttaacgggggaaacggttaccggggtaaacccgtaaacgggttcccgttaaaccccggttaccgttaaaacggtacccgaaccggtaaccccgaaacccgggtaacccccaaaacccccgttcttacggttaccctacccgtttaccgtttccccgttccccccgtccccgtttacccgg

SEQ ID NO: 259457 - DNA, 784 bp, Homo sapiens
  misc_feature: GYAE6OF01A0KCC.15.66.F11.1.454.CMB.1.raw
  modified_base (223)..(223): a, c, t, g, unknown or other
  misc_feature (223)..(223): n is a, c, g, or t
  modified_base (229)..(229): a, c, t, g, unknown or other
  misc_feature (229)..(229): n is a, c, g, or t
  modified_base (254)..(254): a, c, t, g, unknown or other
  misc_feature (254)..(254): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagccctccctccgcgtcccgggtctcctggacagtcagtcaccatctcctgcactggaaccnttggtnattataactatgtctcctggtaccngcagccaccaggacaaacgccccaaagtcagtctatttactagacgtctactaacgtaacggccggtacccctcgaaccggggttccctgactccgtctttcctcgtcggtcctaccgtaacgtcgtcgggccgtaccgtccggtccctcccgtcgtacccgtccttcggtcggtacctaccgacgtcccgttaggaaacgtacgtacggtacgggttcttacgtttaatttacgtttccgtacgggtcggtcctacgtaagtttacggtacgggtaactaaaccgttaatttaacgtacggtttaccgtttttacgggttaccggtttaacgggtaaccggggttaaccgggtaacccgttaaccgggttaccccgttaaacccggttacccgttaaacgggtacccggtaacccggtaaccccccggtaaccgggtaaccccccaaaaccccccgttacgtttaccccgttaccctaacccgtttacccgttaccccgtttacccccccgtaccccctttaaccccgg

SEQ ID NO: 259458 - DNA, 749 bp, Homo sapiens
  misc_feature: GYAE6OF01D7EVG.15.66.F11.1.454.CMB.1.raw
  modified_base (229)..(229): a, c, t, g, unknown or other
  misc_feature (229)..(229): n is a, c, g, or t
tcagtctacgtagccacgaccggtgctcgattttagtcacgcgagaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccatttggnattataactatgtctccgtggtaccagcagccacccgaggaccaaaccgaccccaaagtcatactatttatgagctacaactaacggccggccctcgacggggtcctgactcgtcttctcgtcgtcctaccgaagttcgcggccgtaccgtcccggtccccttcccgtacggtacccgttccgttccggtcggggtcccttcccgacgtcccgtaggaaacggtacgtcgggacgggtccttaaggttaacttttcgtttccggtacgggtccggttaccttacgttaaagttaacggttacgggaacttaaacgttaacgtttaaccgttaggtttaccgttttacggtttaccgggtttaacggggtaacgggttccggggaaacccgttaacgggtaccctaacccggttacctaaacggtaccgacccgaaccccgtaacccggaaccccctaaccccgtacgttaccgttacccgtaccttacccgttcccggttccccccgtccccgttccccg

SEQ ID NO: 259459 - DNA, 676 bp, Homo sapiens
  misc_feature: GYAE6OF01BVVLW.15.66.F11.1.454.CMB.1.raw
  modified_base (189)..(189): a, c, t, g, unknown or other
  misc_feature (189)..(189): n is a, c, g, or t
  modified_base (200)..(200): a, c, t, g, unknown or other
  misc_feature (200)..(200): n is a, c, g, or t
  modified_base (217)..(217): a, c, t, g, unknown or other
  misc_feature (217)..(217): n is a, c, g, or t
  modified_base (224)..(224): a, c, t, g, unknown or other
  misc_feature (224)..(224): n is a, c, g, or t
  modified_base (234)..(234): a, c, t, g, unknown or other
  misc_feature (234)..(234): n is a, c, g, or t
  modified_base (289)..(289): a, c, t, g, unknown or other
  misc_feature (289)..(289): n is a, c, g, or t
  modified_base (627)..(627): a, c, t, g, unknown or other
  misc_feature (627)..(627): n is a, c, g, or t
  modified_base (664)..(664): a, c, t, g, unknown or other
  misc_feature (664)..(664): n is a, c, g, or t
tcagtctacgtagccacgaccggtgctcgatttagtcacgcgagaagggggggtctcaggaggcagcgctctcaggacgtcaccacatggcctgggctctgctcctcctcagcctcctcactcagggcacagggtcctgggcccagtctcgccctgactcagcctccctcgcgtccggtctcctggacngtcagtcaccntctctgcactggaaccngttggtnattataactntcgtctcgtaggtacagcagccaccgaggacaaacgaccccaagtcatctattangacgctacaactacgccgacctcggacgggtcctgactccgtcttcgtcgtcgtcctacgtaagtcgtggccgtaccgtcccggtcccttcccgtacgtcccgttcgtccggtccgggtaccctccggaccgtaccggtacggaaacgtacgtacgggaacggtcgttacggtttaattttacggtttcgtcgggtaccgtcttaccgtaagtacggtacggaattaacctaacgttcgtacgttcgttttcgttaacgtacgggtagtaccgggacctaacgggttctaaccgtaccctaagcccgaacgaccccgtaaacggcccccttaacccgngttacccgtacctacccttaccgttaccccgttcccnccccgttacccg

SEQ ID NO: 259460 - DNA, 623 bp, Homo sapiens
  misc_feature: GYAE6OF01B28JB.15.66.F11.1.454.CMB.1.raw
  modified_base (232)..(232): a, c, t, g, unknown or other
  misc_feature (232)..(232): n is a, c, g, or t
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
  modified_base (297)..(297): a, c, t, g, unknown or other
  misc_feature (297)..(297): n is a, c, g, or t
  modified_base (300)..(300): a, c, t, g, unknown or other
  misc_feature (300)..(300): n is a, c, g, or t
tcagtctacgtagccacgaccggtgctcgatttagtcacgcgagaaggggggggtctcaggaggcagcgctctcaggacgtcaccaccatggccctgggctctgcctcctcctcagcctcctcactcagggccacagggtcctgggcccagtctgccctgactcacgcctccctccgcgtccgggtctcctggacagtcagtcaccatctcctgcactggaacctgttggtnattataactntgtcctcctggtaccngcagccaccagaccaaacgccccaaagtccatctattanganctcactaacgccggccctacgacgggtccctagactcgtcttctcgtcgcctcaagtcgtcggcgtacgtcggcctccgtcgaccgtctcgtcggcctccgacgcctagaacgtacgtagacggtcttagtactttacgtttcgtcggccgtacttactagtagtcggaataactaagttaccgagttcgtttcgtacgttacggaacggtcggtaactacggtccctaccgttaccgtaagtccgaaccggtacccgaaccggtcccccaacccgtacgtccgtacctacccttaccgtcccgtttaccccgccccttcccg

SEQ ID NO: 259461 - DNA, 688 bp, Homo sapiens
  misc_feature: GYAE6OF01CIFKO.15.66.F11.1.454.CMB.1.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
  modified_base (308)..(308): a, c, t, g, unknown or other
  misc_feature (308)..(308): n is a, c, g, or t
  modified_base (449)..(449): a, c, t, g, unknown or other
  misc_feature (449)..(449): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctcctccgcgtccgggtctcctggacagtcagtcaccntctctgcactggaacctagttcggtntattaataacttatcgtcctccgtggtacccagcagccacccgagaccaaacgacccccaaagtccaattcctagtttangagtctcactaacggccggccctcggtacggggtccctgactcgtcttctcgtcggcctccgaagtcgtacggccgacctccggccctccgtcgtaccctcgtcgtcgggcctaccgacgtccgtaggaagtagtacgggngtacttaggttaatttacgtttcgtcggccggttctacgtagtagtaggtaactaactaacttacgtacgttcccgttttaggtaccgtttacggggaacggttccgggaacgtaacgggttcccaacccggttaccgttaaccggtccgaaccggtaaccccgaaccggtacccccaaccccgtagttacccgttcctaccctttcccgttaccccgttccccctccccgttaccccg

SEQ ID NO: 259462 - DNA, 633 bp, Homo sapiens
  misc_feature: GYAE6OF01A4S4O.15.66.F11.1.454.CMB.1.raw
  modified_base (226)..(226): a, c, t, g, unknown or other
  misc_feature (226)..(226): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtnattataactatgtctcctggtaccagcagcaccaggcaaacgccccaaagtcatcatttatgagctcactaacggccggccctcgacggggtccctgactcgtcttctctcggctcaagtctggcgactccggcctccgtgacccgtctcgtgggcctcgacgtcctagaacgtctggacggtctagtatttagtttcgtgcggtctactaagtagtggagtaactaattacgagttccgttttggttaccgtttaacgggaaaggttcggggaacctaacgggttcctaacccggttaccgttaaacggtccaccggtaaccccgaaaccgggtacccccaaaccccgtaccttaccggttaccctacccgtttcctcccggtttcccccaaccccgtttccccgg

SEQ ID NO: 259463 - DNA, 755 bp, Homo sapiens
  misc_feature: GYAE6OF01DWB3I.15.66.F11.1.454.CMB.1.raw
  modified_base (230)..(230): a, c, t, g, unknown or other
  misc_feature (230)..(230): n is a, c, g, or t
  modified_base (303)..(303): a, c, t, g, unknown or other
  misc_feature (303)..(303): n is a, c, g, or t
  modified_base (739)..(739): a, c, t, g, unknown or other
  misc_feature (739)..(739): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagccctccctccgcgtccggtctcctggacagtcagtccacatcctcctgcactggaacctattggtanatttataactatgtacctccgtaggtaccagcagccacccgaggaccaaacgccccaaagtccatctatttangacgtctactaacgtacgccggccctacggacgggtccctagtactccgtccttcgtccgtcggaccttaccgaacggttcgtcggcccgtacgtcccgggtcccttcccgtcggtacccgttcgtccggtccgggtacctcccggtacgtcccgtaggaaacgtagtacgggtacgtctttaaggttactttaacgtttcgccggtcggttacctagtacgttagaggtaacgaaactttaacgttaacgtaacggtttccgttttacggttaccggttaagggtaacgggttaccggtaaaccggtaacgggttccctaacccgttaccgttaaccggtccgtaaacccggaccccgtaaaaccggccccccctaaaaccccgtcggttccgtaacccttaccccgtttaccgtttacccccgtttaccccccnccccgttttacccggg

SEQ ID NO: 259464 - DNA, 796 bp, Homo sapiens
  misc_feature: GYAE6OF01D6HCE.15.66.F11.1.454.CMB.1.raw
  modified_base (234)..(234): a, c, t, g, unknown or other
  misc_feature (234)..(234): n is a, c, g, or t
  modified_base (251)..(251): a, c, t, g, unknown or other
  misc_feature (251)..(251): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatcctcctgcacgtacggaacctattgggtntaatttaataaaacttntcgtaccttccgtaggtaccagcacgccacccgaggaccaaacgccccaaagtcatctatttatgagtcctactaacgtacggaccggtccctacggtaccgggttccctagtacgttccgtccttcgtcgtcggcctaccgtaacgtccgtacgggacgtaccgttcccgggtaccctccgtaccggtacccgttccgtccggtcggtccctaccgtacgtacccgtaagtaaacggtacgtacgggtacgtaccgttagttaacgttttactttcccggtgggtaccccggtacttacgtaagttaacggtaagggtaactaaactttaaacgtacgttaaggtttcgttttacgggtaccggtttaacggggtaaacggttaccggtaaccggtaaccggttcccgtaacccggttaccgttaaaccggacccgttaaccggaaccccggtaaaccccgaacccccgtaaaccccttggtaaacccgttaccccgtactttaccccgttacccccgtttaccccccgtacccgttaccccgg

SEQ ID NO: 259465 - DNA, 728 bp, Homo sapiens
  misc_feature: GYAE6OF01EZ6OL.15.66.F11.1.454.CMB.1.raw
  modified_base (227)..(227): a, c, t, g, unknown or other
  misc_feature (227)..(227): n is a, c, g, or t
  modified_base (289)..(289): a, c, t, g, unknown or other
  misc_feature (289)..(289): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtnattataactatcgtctctggtaccagcagcacccagacaaacgccccaaagtcatcatttangagctacactaacgccggcccgtcgaccgggtcctagactcgtcttctcgtcggcctcgaagtcgtggccgaccgtccggccccttcccgtacggtaccccgttccgtccggtcgggtccctccgtacggtcccttaggaaacgtgtacggacgggtcttagttaactttacgttttccgacgggtccggtaccttaccgaaagttacggtagggtaactaacgtaaagtttaccgtaaggtttccgtttttacggtaccggtttaacgggtaacgggttacgggaaacccgttaacggggttaccctacccggtttaccgtaaacggttaccgaaacccggtacccccggaaaaccgggtcccccctaaaacccccgtgtttaacccgtacccgtttaacctaccgttttccccgtcccccggtccccctttacccgg

SEQ ID NO: 259466 - DNA, 726 bp, Homo sapiens
  misc_feature: GYAE6OF01CE2H8.15.66.F11.1.454.CMB.1.raw
  modified_base (534)..(534): a, c, t, g, unknown or other
  misc_feature (534)..(534): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacgagggtcctgggcccagtctcgccctgactcagccctccctccgcggtccgggtctccgtggacagtcagtcaccatctccgtgcactggaacctagtttggtgtaattaataacttatcgttccttcctggtaaccagccacgccaacccgacggaccaaaacggcccccaaaagtccaactcctaattttaagcggaactcctaccgaacgttaacggcccggtccccgtcggtaccggggtccctagtacgttccgtcttctcgttcgtcctacgtaacgtcgtacggccgtaccgtccggccctcccgttcgacccgttctccggtcgggtcctcccgtacgtcccgtagtaagtacgtggacggtcttagttacttttacgttcgtgaccgttcctntagttaacggtggtaactaactaagttacgtagttcgtttacgttacgttacgggtaaacggtcgggtaaccgtacggtaccctaccgtaccgttaagtaccgtaccggaacccgaaccggtaccccaaccccgtacgtttacccgtccttaacccgttcccgtttacccttccccccgtcccgttaccccg

SEQ ID NO: 259467 - DNA, 756 bp, Homo sapiens
  misc_feature: GYAE6OF01CCH3C.15.66.F11.1.454.CMB.1.raw
  modified_base (133)..(133): a, c, t, g, unknown or other
  misc_feature (133)..(133): n is a, c, g, or t
  modified_base (234)..(234): a, c, t, g, unknown or other
  misc_feature (234)..(234): n is a, c, g, or t
  modified_base (248)..(248): a, c, t, g, unknown or other
  misc_feature (248)..(248): n is a, c, g, or t
  modified_base (266)..(266): a, c, t, g, unknown or other
  misc_feature (266)..(266): n is a, c, g, or t
  modified_base (319)..(319): a, c, t, g, unknown or other
  misc_feature (319)..(319): n is a, c, g, or t
  modified_base (499)..(499): a, c, t, g, unknown or other
  misc_feature (499)..(499): n is a, c, g, or t
  modified_base (540)..(540): a, c, t, g, unknown or other
  misc_feature (540)..(540): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacngggtcctgggcccagtctcgccctgactcacgccctccctcgcgtccggtctccgtggacagtcagtcacatcctctgcacgtacggaacctagttcggtntaattaactaactntcgtcctcgtggtaaccngcacgccaccgaagaccaaaccggacccctaaagtcctataccttagtttacngacgtcctaaccacgtaaccggccgaccccgttaggtaccgggtccctagacctccgtacgttcctacggtcggtaccctacgtaaggtccgtaccgggtcgacccgtcccggtacccttccgtcggtacccgtcggtcggtcgggtcctaccggacgtcgtagacgtagtcggaacgtntagtttactttacgttcggacgtcgtacttacgtagtaacncgggtaactaacggttacttacgttaacgttccggttttacgttaccgggtaacgggttaacggtaccggggtaacccttacggttaacccgtaccggttaccgtaaacgtccccggtaacccgaaccccggtacccggtaaccccctaacccgtacttacccgttacccgttaccgttccccgttttcccggtccccccgtccccgtttacccgg

SEQ ID NO: 259468 - DNA, 640 bp, Homo sapiens
  misc_feature: GYAE6OF01AZ7C1.15.66.F11.1.454.CMB.1.raw
  modified_base (190)..(190): a, c, t, g, unknown or other
  misc_feature (190)..(190): n is a, c, g, or t
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (211)..(211): a, c, t, g, unknown or other
  misc_feature (211)..(211): n is a, c, g, or t
  modified_base (214)..(214): a, c, t, g, unknown or other
  misc_feature (214)..(214): n is a, c, g, or t
  modified_base (226)..(226): a, c, t, g, unknown or other
  misc_feature (226)..(226): n is a, c, g, or t
  modified_base (563)..(563): a, c, t, g, unknown or other
  misc_feature (563)..(563): n is a, c, g, or t
  modified_base (620)..(620): a, c, t, g, unknown or other
  misc_feature (620)..(620): n is a, c, g, or t
tcagtctacgtagccacgaccggtgctcgatttagtcacgcgagaaggggggggtctcaggaggcagcgctctcaggacgtcaccaccatggcctgggctctgctcctcctcacgcctcctcactcgagggcacgagggtcctgggcccagtctgccctgactcacgcctcccgtccgcgtccggtctcnggacngtcagtcacntctcgncancgaactgtgganattatactatcgtctcgtacgtaccagctacggaccaccgtacggacctaaccgacccctaaaggtccacgtctattagcgagtcctacgacgtacgccgtccgtgaccgggttccagacgtcgtcctgtctcggtctaccgtgtcgtcgggactccggtccgaccgttctccggtacgtcgtaccggttcggccttaccggacgtaccgtaggaaccgtgtaacgtcgggtacccttaggttactttcttacgtccgggtactccgtaacgtcgtacggtacggattaacctaaggttacctgtccgttagtcggtaccggtaatccggtaaccgngtacccgtacgtagtaaccgccgaccgacgtaccgacctcgacgttgtaccacgttnacccggttcccgtaccgtcg

SEQ ID NO: 259469 - DNA, 781 bp, Homo sapiens
  misc_feature: GYAE6OF01CPL7O.15.66.F11.1.454.CMB.1.raw
tcagtctacgtagccacgaccggtgctcgatttagtcacgcgagaagggggggggtctcaggaggcagcgctctcaggacgtcaccaccatggcctgggctctgctcctcctcagccctcctcactcgagggcacgagggtccggggtcggccagtctcgccctgacctcacgccctccctccgcggtccgggtctaccgtggacacgtcagtccaccactcctcctcgcacgtacggaacctagtttagggtactaatttaactaacttagttcgttccgtccgtacggtaccgagccacgaccaaccgacggaccaaaccgaacccctaaaggtcaacttacgtaactttaagcgaccgtacctacgtaaaccgtacggcccggtacccgtacggtaccgggtcctagccttcggtaccttcgtcgtacggtcctaccgtaggttccgacggccgtacgtcccggtccctccgtaccgtaccgtcgtccggtccgggtactaccggtcgtaacgtggtaaacgtacggttacggcgttagtactttacgtttacgttcggtagggtccggtacttaggtacgtacgttaaggtaaccgaactttacgtaacgtcgttgtttcccggtaggttaacgggtcgaacgggtaacctcgggtaccctacgtacccgtagaacccggtcccggtaaacccacccgttaacccgtaacctacggtttaccccgtaccggttacccctcccgttttacccccggtaccccttccccgttaaccggg

SEQ ID NO: 259470 - DNA, 778 bp, Homo sapiens
  misc_feature: GYAE6OF01DSY7D.15.66.F11.1.454.CMB.1.raw
  modified_base (768)..(768): a, c, t, g, unknown or other
  misc_feature (768)..(768): n is a, c, g, or t
tcagtctacgtagccacgaccggtgctcgatttagtcacgcgagaaggggggggtctcaggaggcagcgctctcaggacgtcaccaccatggcctgggctctgcctcctcctcagcctcctcactcgagggcacgagggtcctcgggcccagtctcgccctgactcacgtcctccctccgcggtccggtctccgtggactagtcagtcaccatcgtcctgacacgtacggaacctagttggtataatttaactaactattcgtcctccgtacgtaaccagcgacgacccaaccgaacggaacccaaaaccgtaccccctaaatacctaactaccttaagttagtaggacctctaccgtaacgtaccggccggtcccgttacggaccgggtaccttagacttccgtcgttccgtacgtcggtacctaacgtacggtcggtccggtaccgtacccgtccccgtacccgttccgtacggtcccgtaccgttcggtcggtaccctacgacggtaccggtaagtaacgtcgttaacgggtacggttacttaacgtttagtttaccgttgaccgggtcttactagtacgtacggtaacgtaacgtaacttaacggtttacgtaggtttccgtttaacgggttacggttaagggtaaccgggtaccggtaaaccgtacggttccccgtaaacgttaccgtaacggtcgaaccccgttaccggaaccctaccccgtaacgttccgtactaccgtccgtaccctttcccctaacccncccgttacgg

SEQ ID NO: 259471 - DNA, 710 bp, Homo sapiens
  misc_feature: GYAE6OF01DS37P.15.66.F11.1.454.CMB.1.raw
  modified_base (227)..(227): a, c, t, g, unknown or other
  misc_feature (227)..(227): n is a, c, g, or t
  modified_base (296)..(296): a, c, t, g, unknown or other
  misc_feature (296)..(296): n is a, c, g, or t
  modified_base (346)..(346): a, c, t, g, unknown or other
  misc_feature (346)..(346): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtntattaataactatgtctcgtggtaccagcagccaccgaggaccaaacgaccccaaagtcatctatttangagctacacgtaacgccggccctcggacgggtcctgacgtccgtccttcncgtcggcctaccgaacgttcgtcggccgtaccgtcccggccctcccgtacggtcccgttcgtcggtcgggtcctacccgagtcccgtagaacgtagtcggagtcttagtatttactttcgcggtccggtcctacgtaagttagtagggtaactaaacgttaacttaacgtcgttaccgttttcgggtaccggtttacgggaaacgggttccggggtaaccgtaaaccgggttcccctaacccgggttaccttaaacggtccgaaacccgggtaacccccgaacccggtaaacccccaaaccccgtcgtttaccgaccctttaacctccccgtttacccggtttcccccgaccccctttacccgg

SEQ ID NO: 259472 - DNA, 881 bp, Homo sapiens
  misc_feature: GYAE6OF01EN39C.15.66.F11.1.454.CMB.1.raw
  modified_base (169)..(169): a, c, t, g, unknown or other
  misc_feature (169)..(169): n is a, c, g, or t
  modified_base (199)..(199): a, c, t, g, unknown or other
  misc_feature (199)..(199): n is a, c, g, or t
tcagtctacgtagccacgaccggtgctcgatttagtcacgcgagaagggggggggtctcaggaggcagcgctctcaggacgtcaccaccatggcctgggctctgctcctcctcacgcctcctcactcgagggcacgaggggtcctcgggcccagtctcgccctgactcncgcctcctccgcgtccgggtctcgtggacngtcagtccaccatcctcctcgcacgtacggaaaccttagttgggtagttaactttaacgtaaactttagtcgttccttccggtaacggtaccacggaccaacggacccaaacccggaacggaacccaaaaacccggtaccccccgtaaaaagttcctaacttacgttaacttttacgtacggaacgtccttaaccgtaaacggtaaccgggtccccggtaccccgtaccggggtaccggggttccctaggtaaccgttcccgtcgtttccgttcgtacggtaccgttaccgtacggttccgtcgggtacccggtaccgttcccggtacccctccgtaccggttacccgtcgttcggtccggtcccttaccgtacgggtacgtaagggtaacgtacgggtcggtacggttctttaacggtttaactttttccggtttaccggacgggttcccgtttactaacgttaggttaacggtcggaaaacgttaaccgtaaagtttccgttacggttttaccgttacggggtttaccggtttaaacggggacggttaaccgggaaccgttaaccggtaaccgttaccggttacgtaacccgtacgaacccggaaccccgttaccggacccctaaacccgttgtacccgtaccttaccgttcccgttaccccggtcccctcccgtaccgg

SEQ ID NO: 259473 - DNA, 789 bp, Homo sapiens
  misc_feature: GYAE6OF01B4M8V.15.66.F11.1.454.CMB.1.raw
  modified_base (237)..(237): a, c, t, g, unknown or other
  misc_feature (237)..(237): n is a, c, g, or t
  modified_base (328)..(328): a, c, t, g, unknown or other
  misc_feature (328)..(328): n is a, c, g, or t
tcagtctacgtagccacgaccggtgctcgatttagtcacgcgagaagggggggggtctcaggaggcagcgctctcaggacgtcaccaccatggcctgggctctgctcctcctcagcctcctcactcagggcacgagggtcctgggcccagtctgccctgactcacgccctccctccgcggtccgggtctcctggacagtcagtcaccatctcctgcacgtcggaacctagttgggtntaatttaacttaaccttagttcgtccttccgtacggtaaccagacgacgaccaaccgaaggaccaaaccgaccccaaagtcatctatttangacgctacaacgtacggcccgtccgtacggtacgggtcctgtactcgtcttctcgtcggcctaccgtacggtcgtcggccgtaccgtccggtcccttccgtcggtacccgttcgtccggtccgggtccctaccgacgtaccgtaaggaacgtacgtcggacggttcgttaggttaacttttcgttccggtacggtcggttaccttagtaacgttacggacgggtaactaacttaacgtttaaccgtcggtttaccgttttacgggtttacccggttaacgggggttaacgggttaccgggtaaaccgttaaccgggttaccccgtaaacccggtttaccggtaaaccggtaccgaaccccggtaaccccggtaaccccggaaaccccctaacccgttaccgtttaccgtacccgttaccctttaccccggttccccgttacccccgtacccgtttccccgg

SEQ ID NO: 259474 - DNA, 792 bp, Homo sapiens
  misc_feature: GYAE6OF01ECR99.15.66.F11.1.454.CMB.1.raw
  modified_base (243)..(243): a, c, t, g, unknown or other
  misc_feature (243)..(243): n is a, c, g, or t
tcagtctacgtagccacgaccggtgctcgatttagtcacgcgagaaggggggggtctcaggaggcagcgctctcaggacgtcaccaccatggcctgggctctgctcctcctcacgcctcctcactcgagggcacgagggtcctcgggcccagtctcgccctgactcagccctccctccggcgttcccgggtctccgtggacagtcacgtcacctatctcctgcacgtcggaacctagttggtntattaataactagtcgtccttcgtggaccagcacgaccaccgaggaccaaaccgacccaaagtccacttactatttacgaggactcctacgaacgtaacgggcccgtacccgtacggtaccggggttcctagtaccttccgtcctttccgtcgtcgacctaccgtacggttcgacgggaccgtaccggtcccggtcccctacccgtccggtacccgtcggttccggtaccgggtccctacccgacggtaccgttaacggaaggtacgtcgggtaacggtactttaaggtttacttttacggtttcggcgggtacccgttactacggtaacgttagtacgggaaacttacggttaaacttccggttaggtttaccgtttttacgggtacgggttaacgggaacgggttaaccgggacgttaccgggttaccctaaccgggttacctaaaccggacccgtaacccgggaccccgtaaaccggcccccttaaccgtacggtacccgtttaccacccgtttcccgttccccggttccccacccgtttaccccg

SEQ ID NO: 259475 - DNA, 676 bp, Homo sapiens
  misc_feature: GYAE6OF01DYGQT.15.66.F11.1.454.CMB.1.raw
  modified_base (225)..(225): a, c, t, g, unknown or other
  misc_feature (225)..(225): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaacattggnattataactatgtctcctggtaccagcagccaccaggacaaacgccccaaagtcatcatttatgagctcactaacgcggccctcgcgggtccctgactcgtcttctctggtcctccaagtcgtgcgtactccggcctccctgtcccgtctcgtcgggcctccgagtccgtagaacgtatacggagggtcttgtaattttactttccgtcggccggtcttacgtattagtcgggaagaaccttaaacgtttaccgtagttaccttttcgtttccggtttacggggtaacggtacggggtaaccctaacgggttaccctaacccggtttacccttaaacggtcccgtaaccggaacccccgtaaaccggggaccccctaaaacccccgtaccgtttacgtaccccgtaaccctttacccctttcccgttccccccgtaacccctttcccccgg

SEQ ID NO: 259476 - DNA, 775 bp, Homo sapiens
  misc_feature: GYAE6OF01BM8A7.15.66.F11.1.454.CMB.1.raw
  modified_base (192)..(192): a, c, t, g, unknown or other
  misc_feature (192)..(192): n is a, c, g, or t
  modified_base (222)..(222): a, c, t, g, unknown or other
  misc_feature (222)..(222): n is a, c, g, or t
  modified_base (227)..(227): a, c, t, g, unknown or other
  misc_feature (227)..(227): n is a, c, g, or t
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
  modified_base (251)..(251): a, c, t, g, unknown or other
  misc_feature (251)..(251): n is a, c, g, or t
  modified_base (287)..(287): a, c, t, g, unknown or other
  misc_feature (287)..(287): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagccctcctccgcgtccgggtctcctggacngtcagtcaccatctcctgcactggaaaccnttggnattanaactntgtctctggtaccngcagcaccagacaaacgcccaaagtcatcagtttangagctcactacgccggcctcgagggtccctgactcgtctttccgcgtcggtccttacgaagttccgtcgggccgtacgtcccggccctttccccgtacgtacccgttcgttccgtcggggtacccttccgaacgtcccgtaggtaacgacgttaggaacgggtccttaggttaacttttacgtttaccgtcggggtaccggtccttacgtaaggttaacgttaggggtaaactaaccttaaaacgtttacccgtaaggtttacccgttttttacgggtacccgttttaacccggggtaaaagggttcccgggggtaaaaccgttaaaccgggttccccgttaaaaccggtttacccgtaaacgggtttacccgaacccggttaaccccgaaaccccgggtaacccccgaaaacccccttacggttaccggttaccctaacccgttcccgtttacccccggtttacccctaaccccccgtttccccggg

SEQ ID NO: 259477 - DNA, 884 bp, Homo sapiens
  misc_feature: GYAE6OF01BOYJK.15.66.F11.1.454.CMB.1.raw
  modified_base (637)..(637): a, c, t, g, unknown or other
  misc_feature (637)..(637): n is a, c, g, or t
tcagtctacgtagccacgaccggtgctcgatttagtcacgcgagaagggggggggtctcaggaggcagcgctctcaggacgtcaccaccatggccgtgggctctgcctcctcctcacgccctcctcactcgacgggcacgacgggtcctcgggccctagtctcgccctgactcacgccctccctccggcggtccggtctccgtggacacgtcagtccactctccgtcctgcctacgtacgaactagttggtataacttaacgtaacttagtcgttccgtcgtacggtaaccagctaacgcctaaccggacggaaccctaaaccggaacccccgtaaaattcctaactactaagttttacgagtaaccgtactaccgtaaacggtaccggcccggtaccccgtacgggaccgggtaccctaggtaccgttccgttccgttccgtccggtccgtacccttaacgtaacgtcccggtacggtacccgtaccgtcccggtcccctacccggtaccggttcccgttccgtggtcccggtaccccaccgttaccgacggtaacggtaacggtacgttgggaacgtttacggtacgttttagtttcccgttcggtaccgggtaccgttactacggtttaacggngttaaacgggtaataaacccgttagttaaccttcggtttacgtttaccggttaacgggttaacgggggtaaccctacggggttaaccccgtaccggttaccgttaaccccgggtacgtaaacccggtacccggtaaacccggaaccccgtaacccccggtaccccgttaaaccgaccggtttcccggtaccccttaccccggtttaccccggtttaaccccccgtcccccgtttaacccgtttcccg

SEQ ID NO: 259478 - DNA, 803 bp, Homo sapiens
  misc_feature: GYAE6OF01A13C5.15.66.F11.1.454.CMB.1.raw
  modified_base (226)..(226): a, c, t, g, unknown or other
  misc_feature (226)..(226): n is a, c, g, or t
  modified_base (252)..(252): a, c, t, g, unknown or other
  misc_feature (252)..(252): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggnattataactatgtctccgtggtaccngcagccaccaggacaaacgaccccaaagtccaatcatttaatgagtcctcactaacgccggtccctacgcggggtccctgtatccgcttcgtctggcctcgacgtcgtcggccgtaccgtccggtcccttcccgtcggtaccccgttcgtccggtacgggtcctacccgtacggtcccgttaggaactacggtacggacgggtcttaggttaattttaacgtttccgtcgggtccggttacttaccgttaagttacggttacggtaacggtaaaccctttaaagtttacccgtaacggttttcccgtttttagggtttacccggtttaaccggggttaaacgggttaaccgggggtaaccccgttaaacgggtttccccggttaaacccggttaccggttaaacccggttacccggtaaacccggaacccccggttaaaaccgggttaccccccccaaaacccccgtttacccttcccgggttaacccccttaacccgttttaccccgggtttacccccggtttccccccggttccccggtttaccccccg

SEQ ID NO: 259479 - DNA, 714 bp, Homo sapiens
  misc_feature: GYAE6OF01CDJ0X.15.66.F11.1.454.CMB.1.raw
  modified_base (132)..(132): a, c, t, g, unknown or other
  misc_feature (132)..(132): n is a, c, g, or t
  modified_base (150)..(150): a, c, t, g, unknown or other
  misc_feature (150)..(150): n is a, c, g, or t
  modified_base (204)..(204): a, c, t, g, unknown or other
  misc_feature (204)..(204): n is a, c, g, or t
  modified_base (228)..(228): a, c, t, g, unknown or other
  misc_feature (228)..(228): n is a, c, g, or t
  modified_base (327)..(327): a, c, t, g, unknown or other
  misc_feature (327)..(327): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcaggcacngggtcctgggcccagtcngccctgactcagccctccgtccgcgtccggtctccgtggacagtcacgtcaccntcctccgtgccacgtggaaacctntttgggatatttaagtaaaccttgttcgtcctaccgtggtaacccagcagaccaccgaggacctaaaacgccccctaaaagtctaacgtctactttagngacgtcctaaccacgttaaccgcccggtccctacggtaccgggtccctgaactccgtcttccgtggtaccgcctctaacggtctcggccgacgtccggtccctcccgtacgtaccgtcgtccggtcgtactccgacgtcctaggaactacggtgacggtattacgttacgtttacttaccgtcgggtccgttactaacgtagtcgttaacgggaagttaaaccctaactttagtaacctttcggtttaccggttacgttaacgggttacgggtaaccggtacctaacgggtccctaaccgttaccgtataccggaaccgtaccccaaaccggtccccgaacctcgttaccgtactaccttaccggtcccctacccgccccttacccg

SEQ ID NO: 259480 - DNA, 818 bp, Homo sapiens
  misc_feature: GYAE6OF01BRDQ3.15.66.F11.1.454.CMB.1.raw
  modified_base (235)..(235): a, c, t, g, unknown or other
  misc_feature (235)..(235): n is a, c, g, or t
tcagtctacgtagccacgaccggtgctcgatttagtcacgcgagaaggggggggtctcaggaggcagcgctctcaggacgtcaccaccatggcctgggctctgctcctcctcagccctcctcactcgagggcacagggtcctgggcccagtctgccctgactcagccctccctccgcgtccgggtctccgtggacagtcagtccaccatcctcctgcactggaacctagttggtnaatttaataaacctgtcgtcctccgttcggtacccaggccacgaccaaccccgacgggaaccaaaaccgaaccccccgtaaaagttcccaattacctaatttttacgaggaacgtcctaccgaacgtaacggcccggtaccctccggacggggttccctgtacttccgtctttcctccgtcggtcctaccgtaacgtccgtacgggcccgtaccgtcccccgggtccccttaccccgttaccggtaccccggttccgttccggtccggggtccccttacccggtacgtacccgttaaggaaacggtacgtacgggtacgggtacctttaaggtttacgttttaacgtttccggtcgggttacccggtacctttacgtagttacgtaacggtacgtaaacttaagttaccgtacgtttcgtttacggttcggttaacgggtaacgggttaccggtaacccgtaacggttcctaacccggtaccgtaacgtaccgacccgtaacccgaaccccggtacccctaaaccccgtccgtaacgttcccgtaccttacccggttcccgttccccccgtcccgttaccccg

SEQ ID NO: 259481 - DNA, 837 bp, Homo sapiens
  misc_feature: GYAE6OF01APH0C.15.66.F11.1.454.CMB.1.raw
tcagtctacgtagccacgaccggtgctcgatttagtcacgcgagaagggggggtctcagggaggcagcgctctcaggactcaccaccatggcctgggcctctgcctcctcctcagcctcctcactcagggcacagggtcctgggcccagtctcgccctgactcacgccctccctcgcgtccggtctcctggacagtcagtcacatcctcctgcactggaacctagttggtatattaacgtaactatcgtcttaccgtggtaaccagaccacgaccaacccgacggacctaaaaccgacccccgtaaaaaggtccaacttaccgtaatttttaacgttacgggaacgtccttaccgtaaccgttaaacggcccggaccccgttacggaaccgggttccccgtagtaccgttaccgtctttccgttccgtacggtccttaacccgtaacggttccgtacgggaccgtaccgttcccgggtcccttaccgtacggtacccgttcgttaccggtccgggtacctcccggaacgtccctaggtaaacgtagttcggacggtctaacgttaacttttacgttacgtcgggtacgtccgttacacgttaagtcggaacgttaactaacgttacgtaacgtttccggtttacgttaccggttaagggaacgggttcggaacccgtaaagggttcccaaccgggtttaaacccgttaaacggtaccggtaaaaccccgaccccggtaaaaccgggtaaccccccgaaacccgtaacccgtttaccgtaccccgttaaccgtttaccccgttacccggttaccccccgtttccccgttaacccccgg

SEQ ID NO: 259482 - DNA, 875 bp, Homo sapiens
  misc_feature: GYAE6OF01BSCL1.15.66.F11.1.454.CMB.1.raw
tcagtctacgtagccacgaccggtgctcgatttagtcacgcgagaagggggggggtctcaggaggcagcgctctcaggacgtcaccacatggcctgggctctgctcctcctcacgcctcctcactcgagggcacgagggtcctgggccctaggtcctgccctgacctcacgccctccctccggccggtcccggggtcctccgtaggactagtccagtccaacccatccgttcctggcctaacgttacggaaacctaggtttgggtataaactttaataaaccttcttcgttccttaccggttcggtaacccagaccgacgacccaaacccgacggaaccaaacccgaaccccctaaaggtctaactacgtatttacgagtacgcctacgacgtaaccggccggtcccggtacgggtacccggggtcctcgtacgttccgttcttacgtcgtacggcctacgtacggtcgcggtaccgtaccgtcccggtcccttaccgtacggtcccgttccgttaccgggtcccggacccgttaccggacccggtacgttaacggaaggttaacggacggtacggttaccgtttaagtttaaccgttttacgtttccgggtacggtccggtaccttaacgtaacgggtttaggtaaaccgggaacttaaaacgttaccgtttaacgtttacggttttccggttttacgggtacgggttttaaccggtaacccgggttacgggtaaccgtacccggttaccgttaccgtaaccggtacccgtacgggaacccgtaacccggaaccccgacccggttaacccctcgtttacccggtacccttacgtttaccccggtttccccggtcccccgtccccgttaacccgg

SEQ ID NO: 259483 - DNA, 708 bp, Homo sapiens
  misc_feature: GYAE6OF01EADZA.15.66.F11.1.454.CMB.1.raw
tcagtctacgtagccacgaccggtgctcgatttagtcacgcgagaaggggggggtctcaggaggcagcgctctcaggacgtcaccaccatggcctgggctatgctcctcctcagcctcctcactcagggcacagggtcctcgggcccagtctgccctgactcagccctccctccgcgtccgggtctcctggacagtcagtcaccatctcctgcactggaacctagttggtagtaatttaataaacttagttcgttccttccgttggtaccagcacgccaccgacggaccaaaaccgaccccaaagtcaattctatttatcgagctccgtaacgtaacgccggcccgtcggacggggtccctgactcgtcttacgtcgtcggccttacgacgttcgcggaccgtccgtccggtccctaccgtcggtacccgttcttccggtcgggtcctccgacggtcgtacggaagtgtggtacggtcttaggtaacttttcgttacgtcgggtctcttactaggttagtacggtaacgtaaccttaagtacgttggttaccttttcggggttaaccggttagggaaacgggtacggggaacccttaagggtccctaaccggttaccgtaacggtacccgaccggtaccccgaacggtacccccaaacccgtcgttaccgtaccttaccttccgttacccgttcccaccgttcccccg

SEQ ID NO: 259484 - DNA, 789 bp, Homo sapiens
  misc_feature: GYAE6OF01EDLVF.15.66.F11.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (382)..(382): a, c, t, g, unknown or other
  misc_feature (382)..(382): n is a, c, g, or t
tcagtctacgtagccacgaccggtgctcgatttagtcacgcgagaaggggggggtctcagggaggcagcgctctcaggacgtcaccaccatggcctgggctctgcctcctccgtcacgtccctcctcactcgacgggcacgagggtcctgggcccagtctcgccctgactcacgccctcctccggcgtccggtctccgtggacngtcagtcacntctcgtgactagtacggaacctgttagtagtaattaactaacttagtcgttccgtccgttacggaccacgcacgaccaaccggaggaaccaaacccgaaccccgtaatccatttactagtttagcgtacgtctacaacggtaccggccctccgtacgggtccggtccngtaccgttctcgttcgtaccgtcgtaccgtacgtacgtcggtccggccgtccgtcccgcccttacgcgttaccgtcgcggttccggcctacgacggtaccgtaagacggtgacggtagttctagttactttagtccgcgtccgtaactgtaagggtctaacggtaactaagtttaaccgtgtaccggttacttttaccggggtacgggtttaaaggacggtacccggtaacgttacccggaaccttaacccggttaagttacccggaaccggaaaacccgttacccccggggaaaaccccttcccccccgggtaaaacccctttagtaccccccggttttaccgtaaacccccgttttttcccggaacccccccccggttttacctacccggttttaaccccccggg

SEQ ID NO: 259485 - DNA, 673 bp, Homo sapiens
  misc_feature: GYAE6OF01A8RIU.15.66.F11.1.454.CMB.1.raw
  modified_base (226)..(226): a, c, t, g, unknown or other
  misc_feature (226)..(226): n is a, c, g, or t
  modified_base (231)..(231): a, c, t, g, unknown or other
  misc_feature (231)..(231): n is a, c, g, or t
  modified_base (251)..(251): a, c, t, g, unknown or other
  misc_feature (251)..(251): n is a, c, g, or t
  modified_base (524)..(524): a, c, t, g, unknown or other
  misc_feature (524)..(524): n is a, c, g, or t
tcagtctacgtagccacgaccggtgctcgatttagtcacgcgagaaggggggggtctcagggaggcagcgctctcaggacgtcaccaccatggcctgggctctgctcctcctcagcctcctcactcagggcacagggtcctgggcccagtctgccctgactcagcctccctcgcgtccgggtctcctggacagtcagtcaccatctcctgcactggaaccattggnattanaactatgtcctctggtaccngcagccaccagccaaacgccccaaagtcaatcatttatgacgcctacacttaacgcggaccctacggacgggtccctggattccggtctttccgtctcgggccttaccgtaaacggttctacgggtccgtaaccgtcccggtccctccccgtgtaccccggtttctccggtcgggtcccttacccgacggacccgttaggaaaccggtacgtagggtacggtcgttagtaattttacttccgtgggcggtccttactagttaacgagggtaanaaccgttaaattacgaacgttcgttttacggttacgttacggggaaagttcgggaaccctacggttccaccggttacctaagtccgaaccgtacccgaacggccccaaacctctacgtcctactccttacccgttcccgacccttcccg

SEQ ID NO: 259486 - DNA, 722 bp, Homo sapiens
  misc_feature: GYAE6OF01DFT6X.15.66.F11.1.454.CMB.1.raw
  modified_base (260)..(260): a, c, t, g, unknown or other
  misc_feature (260)..(260): n is a, c, g, or t
tcagtctacgtagccacgaccggtgctcgatttagtcacgcgagaaggggggggtctcaggaggcagcgctctcaggacgtcaccaccatggcctgggctctgcctcctcctcagccctcctcacctcgagggcacgagggtcctgggcccagtctcgccctgactcacgccctcccgtccgcggtcccgggtctccgtcggacagtcacgtccaccatcctcctcgcacgtcggaaacctgttggtatattaataactntcgtctccgtaggtaccagccacgaccaccgaggaaccaaacccgaccccgtaagtcactacttaattagtaggacgtcctacgaacgtacggtcccgaccgtcggaccgggttcctacgtactccgtccttcgtccgtcggtcctacgtacgtcgcggaccgtcgtccggtccctaccgtcgtaccgttgtaccgtcgcctacgtgaccgtagagtacgtcgacgtagttacgttacgttacgtcgtacgtcgttactacgtagtacggtaacgtaacgtaagttaacgttaccgttacggtttccgtttaacggttaaccgggttaagggttaaccggtacgggtaaccttccgtaaccgtaccggtaaccgttacgacccgaaccgtaaccccgaacccgtacccacccgtactaccgtaccttacccttaccggtttcccctacccctacccgttccg

SEQ ID NO: 259487 - DNA, 651 bp, Homo sapiens
  misc_feature: GYAE6OF01B0K1G.15.66.F11.1.454.CMB.1.raw
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctccgtggacagtcagtcacctatcctcctgcacgtcggaacctagttggtataattaactaactatcgtcctccgtcggtaaccagcagccaacccgaggaccaaaccgacccccaaagtcaatactatttagtgacgtcctacacgtaacggccggtcccgtacgacgggtccctagactcgtcttctcgtcgcctaccgtagtcgtcggccgtactccggtccctccgtacgtcccgtcgtccggtcggtcctccgacgtccgtaggaacgtacgtaggacgtcgttagtacttttcgttcgcgtcgtctacgtagtcgtaggactaactacttacgtgtttcgtttggttacgtacgggtaacggtacggtaaccgtacgtaccgtaccgttaccgtacgtaccgaccgacccgaccgacccaccctcgtacgtcctaccgttcctccctccccgtccctaccg

SEQ ID NO: 259488 - DNA, 772 bp, Homo sapiens
  misc_feature: GYAE6OF01CWX2G.15.66.F11.1.454.CMB.1.raw
  modified_base (292)..(292): a, c, t, g, unknown or other
  misc_feature (292)..(292): n is a, c, g, or t
  modified_base (348)..(348): a, c, t, g, unknown or other
  misc_feature (348)..(348): n is a, c, g, or t
  modified_base (369)..(369): a, c, t, g, unknown or other
  misc_feature (369)..(369): n is a, c, g, or t
  modified_base (531)..(531): a, c, t, g, unknown or other
  misc_feature (531)..(531): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcgacggcacacggggtcctcgggacccagtcgtcgccctgtaactccgacgcccttccctcccggtccggttcccggggtcctccgttacgggaactggttacacgtaccaccactccgtcctacggaccacgtacgtaacctaggttggtagtaattaactaaactnttcgtcctaccggtcggtaccacgcacgaccaccgagaccaaaaccaccccgtaanctactacgtaatttagagacnctaccaacgtaccgccgtacccgtacggaccgggtcctagtacgttcccgtctccgttcgtcgtacctacgtaagtcgtcgtccgtacgtcccgtcccgtaccgtaccgtacgttccacgggttaccgcctaccgcgaacgtggaaacggatcggaccggtntacgttaatttccgtcgttacgcgtcgtacgtagtacgtagaacgtaacttacgttacgttagtttacccgtttggttaacggtacgttacgggaaccggtaacctaacgggtacccgttaaccgtccgtaaacggtacccgaaacccggaccggtaaaccccgaacccttaccccggacgtttaaacccctcgtaaccccggttcttaaccccccgggtcccttacccccgggtaacccg

SEQ ID NO: 259489 - DNA, 774 bp, Homo sapiens
  misc_feature: GYAE6OF01CJF89.15.66.F11.1.454.CMB.1.raw
tcagtctacgtagccacgaccggtgctcgatttagtcacgcgagaagggggggggtctcaggaggcagcgctctcaggacgtcaccaccatggcctgggctctgcctcctcctcacgcctcctcactcagggcacgagggtccgtgggcccacgtctcgccctgactcacgccctccctccgccggtccggtctccgtggacagtcagtccactctcctcctgacacgtacggaacctagtttggtagttaactttaactaaacttagttcgttaccgttccgttacggtaaccagcaacgccaacccgaacggaaccaaaacccgaccccaaacgtactactacttaattttacgtcggtactcctaacgtaccgtaaacggcccgtcccgtacgggtaccgggttcctacgtacgttccgtctttccgccgttcggtaccgttaccgtaacggttcgtacgggtacccgtaccgttcccggtacccgttcccgtccggtaccctttcggtcccggtacgggtccctaccggtcggtaccgttaggaacgtaccgtaggacgttcgttacggttaacttttcgttccgcgggttacccgtcctaagttaccgtaggtaacgtaacggtaactttacgtacgttacgtttcgtttacgggtacgtacggtaacgggtacgtaccgtactacccggtacctacggtactaacgcccgacaaccggacccctacgtgaccgttacgtcccgttaccttcccgtacccctcctcccg

SEQ ID NO: 259490 - DNA, 779 bp, Homo sapiens
  misc_feature: GYAE6OF01ES6CQ.15.66.F11.1.454.CMB.1.raw
  modified_base (445)..(445): a, c, t, g, unknown or other
  misc_feature (445)..(445): n is a, c, g, or t
  modified_base (519)..(519): a, c, t, g, unknown or other
  misc_feature (519)..(519): n is a, c, g, or t
  modified_base (529)..(529): a, c, t, g, unknown or other
  misc_feature (529)..(529): n is a, c, g, or t
tcagtctacgtagccacgaccggtgctcgatttagtcacgcgagaaggggggggtctcaggaggcagcgctctcaggacgtcaccaccatggcctgggctctgcctcctcctcacgccctcctcactcgagggcacgagggtcctcgggcccagtctcgccctagacctcacgtccctccctccgccgtccgggtctccgtggacagtcagtaccacctattcctccgtgacctaccgtacggtaacctgtttcggtagtaatttaacgtaaacttgttaccggtccttccggttacggtaacccagtaccacgtacccaacccgaggaaccaaaacccgaccccaaacgtcacttactatttagcgagtacctacgaaccgtaggccccgtccgtcggtaccgggtcctagacttcgtccttcgtcgtcgtcctacgtagtccncggccgtaccgtccgtccctacccgtcgtacccgtctcggtccggacctacgaccgtaccgaaggtacgtacgnggtaccgttntaagtttcgttactttcggcgtcggtacctacgtagtaggtacgtaactaaccgttataacggtcggtttacctttacgggttaccgggtttagacggggttaaccggaaccggttaccgtaacccggtacccgttaacggtaaaccggtacccgtaacggtaacccccgaacccggtaaccccaacccgtaccgttacgtacccctacccgtttccccttccccggttacccccctcccgttaacccgg

SEQ ID NO: 259491 - DNA, 676 bp, Homo sapiens
  misc_feature: GYAE6OF01E18Y7.15.66.F11.1.454.CMB.1.raw
  modified_base (230)..(230): a, c, t, g, unknown or other
  misc_feature (230)..(230): n is a, c, g, or t
  modified_base (235)..(235): a, c, t, g, unknown or other
  misc_feature (235)..(235): n is a, c, g, or t
  modified_base (481)..(481): a, c, t, g, unknown or other
  misc_feature (481)..(481): n is a, c, g, or t
  modified_base (487)..(487): a, c, t, g, unknown or other
  misc_feature (487)..(487): n is a, c, g, or t
tcagtctacgtagccacgaccggtgctcgatttagtcacgcgagaagggggggtctcgaggaggcagcgctctcgaggacgtcaccaccatggcctgggctctgctcctcctcagcctcctcgactcgagggcacagggtcctgggcccagtctgccctgactcagccctccctcgcgtccgggtctccgtaggacagtccagtccaccatcgcctgcacgtggaacctnttggntattataactgtcgtcctccgtaggtaccagcagccaccaggacaaacgccccaaagtcaactctattactggactctacactaacggccggtccctacgtacgggtccctagtacgtccgtacttcctcgtcggtcctaccgtaagttccgtcggaccgtaccgtccggccctccggtacgtacccgtcgtcggtacgggtccctaccgtacgtcctagaacgtactggacgtcttagtacgttnttccgngcgtacctagacgtagtacgtaacgactaagttccaacgttcgttacgtacgttacgggtaacgtcggtaaccgtaacgtcccgtaaccgttaccgaacggttccgaacccggacccgtaaccggcccctaaaccctcgttaccgtaccgtcccgttaccggttaccccgttccccgtccgttaccccg

SEQ ID NO: 259492 - DNA, 751 bp, Homo sapiens
  misc_feature: GYAE6OF01AWPN6.15.66.F11.1.454.CMB.1.raw
  modified_base (210)..(210): a, c, t, g, unknown or other
  misc_feature (210)..(210): n is a, c, g, or t
  modified_base (220)..(220): a, c, t, g, unknown or other
  misc_feature (220)..(220): n is a, c, g, or t
  modified_base (225)..(225): a, c, t, g, unknown or other
  misc_feature (225)..(225): n is a, c, g, or t
  modified_base (232)..(232): a, c, t, g, unknown or other
  misc_feature (232)..(232): n is a, c, g, or t
  modified_base (236)..(236): a, c, t, g, unknown or other
  misc_feature (236)..(236): n is a, c, g, or t
  modified_base (254)..(254): a, c, t, g, unknown or other
  misc_feature (254)..(254): n is a, c, g, or t
  modified_base (314)..(314): a, c, t, g, unknown or other
  misc_feature (314)..(314): n is a, c, g, or t
  modified_base (465)..(465): a, c, t, g, unknown or other
  misc_feature (465)..(465): n is a, c, g, or t
  modified_base (483)..(483): a, c, t, g, unknown or other
  misc_feature (483)..(483): n is a, c, g, or t
  modified_base (739)..(739): a, c, t, g, unknown or other
  misc_feature (739)..(739): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcgagggcacgtagggtcctgggcccagtctgccctgactcagtccctcctccgcgtccggtctcctggacagtcagtcaccatctcngcatcgaacnttggntacttanactntgtacctcgtaggtaccngacgagtaccgacccgtaaggaccaaaacgtccccgaaaagtctaataccagttttaacnggacgtacgtacgtaaccgttaacgccgggtacccctacggacggggttacccctagtacgtcgtaccttcgtctaccggtcctactaacggtctccgggactaccgtcccgccgtaccgtcgacccgtcgttcggtaccggtcttacccngttcccgagtaaaccgtntccgggtaacgggtactacggtttaacttaaccgttttcgtaccgggacggttactaacgtaaccgttgtaaccgggtaacctaaacgggttaacttaccggaagttaccggtttcttacccgggtaaaggttaaccgggtacggaaccgtaaaggtccctaaccggttcctaacggtaccgtacgtaacccgaaccgtaaccccctaaaccggtaccttaactacccgtaccttacccgggttccccttaacccnccccgttacccg

SEQ ID NO: 259493 - DNA, 694 bp, Homo sapiens
  misc_feature: GYAE6OF01BVKJD.15.66.F11.1.454.CMB.1.raw
  modified_base (277)..(277): a, c, t, g, unknown or other
  misc_feature (277)..(277): n is a, c, g, or t
tcagtctacgtagccacgaccggtgctcgatttagtcacgcgagaaggggggggtctcaggaggcagcgctctcaggacgtcaccaccatggcctgggctctgctcctcctcagccctcctcactcagggcacgacgggtcctgggcccagtctcgccctgactcacgccctcccgtccgccgtccggtctccgtggactagtcagtccaccatcctcctgcacgtaggaaacctgttggtataatttaataactagtcgtcctccgtacggaaccngcacgaccaaccgacgaaccgaaaccgtacccctaaagtctacgttactaatttacgtagacgtccttaaccgaacgtaccggcccggtcccgtacggtaccgggtccctagtcgtccgtcttccgtcgtcgtcctacgtacgtcgtacggccgtaccgtcccggtcctcccgtcgtaccgtccgtcggtacccggcctaccggtacgtaccgtaggaacgtgtacggtacgtcgttaagttactttcgttccgtcgtccgtactactagtacggtaggtaactaagttacgtacgtgtttcgttcgttacggtacggtacggtacggtacgtacgccgtaacgttacgacgtccgaaccgaccgacccgacccaccgtactcgtaccctcgttaccctcccgtcccctcgtacccg

SEQ ID NO: 259494 - DNA, 810 bp, Homo sapiens
  misc_feature: GYAE6OF01CFIYL.15.66.F11.1.454.CMB.1.raw
tcagtctacgtagccacgaccggtgctcgatttagtcacgcgagaagggggggggtctcaggaggcagcgctctcaggacgtcaccaccatggcctgggctctgctcctcctcagcctcctcactcgagggcacgaggggttccctgggcccaggtctcgccctgactcacgccctccctccgcggtccgggtcctccgtggactaggtcacgtccacctactcctcctgcctacgtacgggaaccctaggtttgggtataactttaactaactgttcgtccttccgtacggtaccagcgaacgccacccgtacggaccaaaccgacccctaaagtcattctaatttacgagacgtctacgacgtaacggcccggtaccttcgggaccgggtccctagacgtccgttaccgttcgtacgtcggaccgttaccgtaggttccgtgggtacccgtaacgttccccgggtacccttcccggtaccggtacccgttccgttcggttcccgggtccttacccgtacggtacccggtagaaacggttcggtacggtaacggttcttaacgttacgtttcgtttaccggtcgttacgggccttagtaacgttacggtacggaaaccgttaacgttaaacgtttccgaacggttttccggtttacgttacggggttaccgggaagggtttaaccgggactaaccgggttcccgtaaccgttacggaccgtaccgaccggtaacccggaaccggacccctaaccctaggttcccctcgttacccgttaccctttcccggtacccccctccgttacccgg

SEQ ID NO: 259495 - DNA, 762 bp, Homo sapiens
  misc_feature: GYAE6OF01EAD5V.15.66.F11.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
tcagtctacgtagccacgaccggtgctcgatttagtcacgcgagaaggggggggtctcaggaggcagcgctctcaggacgtcaccaccatggcctgggctctgcctcctcctcagccctcctcactcgagggcacgagggtcctgggcccagtctcgccctgactcacgcctccctccgcggtccggtctccgtggactgtcngtcaacctntccgtcctgctaacgtacggaacctagtttggtacgtaatttaacttaaaccttagttcgttccttaccggtacggtaaccagtacgacgaccaacccgaaggaaccaaaacccggaacccccgtaaagtactacttacttaactttagtgaacggtcctaaccgtaacgtaaccgggtcccggtcccgttacggggacccggggttaccctagtaccttccggttaccctttcgtaccgttcggaccttaccgtaacggttccggtcggacccgtaccggtcccgtcccgtaccgtcggtaccgtccgtcggtccggcctacgacgtccgaggaaacgtgtacggacgttatagtttaactttcgtcggtcggtacctctaacgtagtacggagtaataaacgttacgtacgttacgttctttagtacggttacggaacgtcggaacgtcggtacctaaccggtacctaacggaccaccggaaccgtaacccggaccccaaccgttcgtacgttaccctcgtttaccccgcccgtccccgtctaccggg

SEQ ID NO: 259496 - DNA, 759 bp, Homo sapiens
  misc_feature: GYAE6OF01EJI0I.15.66.F11.1.454.CMB.1.raw
  modified_base (195)..(195): a, c, t, g, unknown or other
  misc_feature (195)..(195): n is a, c, g, or t
  modified_base (246)..(246): a, c, t, g, unknown or other
  misc_feature (246)..(246): n is a, c, g, or t
  modified_base (423)..(423): a, c, t, g, unknown or other
  misc_feature (423)..(423): n is a, c, g, or t
tcagtctacgtagccacgaccggtgctcgatttagtcacgcgagaaggggggggtctcaggaggcagcgctctcaggacgtcaccaccatggcctgggctctgctcctcctcagccctcctcactcacgggcacgagggtccgtgggacccagtctgccctgactcacgcctcctccgcgtccggtctctggacngtcagtcacatcctctgcacgtacggaacctgttggtactattaataactntcgtccttacgtacggtaccagcacgaccaccgaggaccaaacgcccctaaagtcaactctaatttatcggtactcgtacctaacgtaaccggcccggtacctaccggtaccgggtccctagacttccggtcttctcgtcgacctacgtacgtcgtcggtacgcctcggcccttccncggtacccgtctcgtacgggccctaccgacgtaccgtaagaacgtagacggtacgtcgttagttaacgttacgtttaccgtcgggtccggttacttacgtaagttacggtacgtaaacgttaacctaaagtttcgttacggtttaacggtttccggttttacggttaaccggggttaaaggttccgggaaacgttacccgggtaacccgttacgttaaccgttaaacggtaaccccggaccggttaaccccgaaaccgggttacccaaccccgtttacggaccttaccgttacccggttaccccttccccgggtttccccgtacccgttaccccgg

SEQ ID NO: 259497 - DNA, 933 bp, Homo sapiens
  misc_feature: GYAE6OF01BL6ZG.15.66.F11.1.454.CMB.1.raw
  modified_base (191)..(191): a, c, t, g, unknown or other
  misc_feature (191)..(191): n is a, c, g, or t
  modified_base (207)..(207): a, c, t, g, unknown or other
  misc_feature (207)..(207): n is a, c, g, or t
  modified_base (225)..(225): a, c, t, g, unknown or other
  misc_feature (225)..(225): n is a, c, g, or t
tcagtctacgtagccacgaccggtgctcgatttagtcacgcgagaaggggggggtctcaggaggcagcgctctcaggacgtcacaccatggcctgggctctgctcctcctcagcctcctcactcagggcacgacgggtcctgggcccagtctgccctgactcagcctccctccgcgtccggtctcctgacngtcagtcacatctctncactggaacctattggtntaattataactatcgtccttccgtcggtaccagacacgaccaacccgacggaccaaaaccggtaccccaaagttacacttactaacgttttacgtacgaacggtaccttaccgtaaaacggttaaccggccccgggtaccccggtaccgggttaccgggggttaccctacgttaccgttcccgttacgttttccgttaccggtccgggtacccttaccgtaaccggttcggtccggggtaccgtaccggttccggtcccctcccggtacggtacccgttccgttaccggtgggtccctcccgtaacggtcccgtaagggaacgtacggtacgggtacgggtacccgttagttttaaccggttttaccgtttaccggtacggggttaccgtacccgtttaaacggtaaggtttaaacgggtaacggttaaacgtaaaccggtttaactttaacccggttacggttttaccggtttttacgggttaaaccggggttttaaggggtaaccggggtttaaccgggtaaacccgggtaacggttaacccccggttaaaccgggttaccccgtaaacggggttaaccccgaaccccggtaaccccgggttaaccccgtaacccccggtaaaccccgttacccggtaccccgtttacccggttacccctttaaccccggttaccccgtttaccccccgttcccgttacccccggg

SEQ ID NO: 259498 - DNA, 889 bp, Homo sapiens
  misc_feature: GYAE6OF01B6TC5.15.66.F11.1.454.CMB.1.raw
tcagtctacgtagccacgaccggtgctcgatttagtcacgcgagaagggggggggtctcaggaggcagcgctctcaggacgtcaccaccatggcctgggctctgctcctcctcagcctcctcactcgagggcacgagggtcctagggcccagtctcgccctgactcacgccctccctccgcgtccgggtctccgtggacacgtcacgtccaaccattcctccgtgacctacgtacggaacctagttggtataacttaagttaaacttagttcggttcctccgtacggtaaccaacgacacggaccctaacccggaacggaacccgaaaacccgtaccccccgaaaaaggttccctaaacttaacctttaaagttttaacgaccggtaacggtaccccttaaccgtaaaccggtaaacccggtccccggggtacccccgttaccgggggttaaacccgggggtttccccctaagggttaacccgttcccggttacccgtttccgttacccggtcggtacccgttaccgtaacgggttccgtacggggtacccgtaccgtccccgttacccgtcccgttaacggtcccgttaccgtcgtccggtaccctccgaacgtcctaggaagtcgtacggacgtacgttagttaactttcgtcgtcggtccgttctacgttaagtacggtaacgtaacgtaaccgtaacgttaacggtacgttttacggtttcgtttaacggtaacgggtacgggttaacggtaaccgtaccggttacccgtaaccggttaccgtaaaccggtaccgaacccgggaaccaacccggtaacccctaacccgtcgttacctaccgttccgtaaaccctttccccgtaaccccgttcccgttaaccccgg

SEQ ID NO: 259499 - DNA, 710 bp, Homo sapiens
  misc_feature: GYAE6OF01B2XRA.15.66.F11.1.454.CMB.1.raw
  modified_base (311)..(311): a, c, t, g, unknown or other
  misc_feature (311)..(311): n is a, c, g, or t
tcagtctacgtagccacgaccggtgctcgatttagtcacgcgagaaggggggggtctcgaggaggcagcgctctcaggacgtcaccaccatggcctgggctctgctcctcctcagcctcctcactcagggcacgagggtcctgggcccagtctgccctgactcagccctccctcgcgtccggtctccgtggacagtcagtccaccatcctcctgcacgtcggaacctgttggtataatttaataaactgtcgtcctccgtggtaccagcacgccacccgagaccaaacgaccccaaagtcatctatttagngacgtctacacgtaacggcccggccctacggtacgggtccctagtactccgtcttctcgtcggcctactacgtcgtcggccgtaccgtcccgaccctccgtacgtcccgtcgtcggtcggaccctccgcgtacctggaacgtgtaggacgtcttagttatttacgtttcgcggtcgtactacgtattaggtaggaactaacgttaacttacgtcggttacttttacggttaacggttacggggtaacgggtaccggtaaccgtacggttacccgtaacggttacctaacggtaccgaacccggaaccccgaacccgggtaccccaacccccgttacggttacccgttaaccctacccgttacccgttttcccccggtacccccttcccccgttacccgg

SEQ ID NO: 259500 - DNA, 715 bp, Homo sapiens
  misc_feature: GYAE6OF01BTTXO.15.66.F11.1.454.CMB.1.raw
  modified_base (207)..(207): a, c, t, g, unknown or other
  misc_feature (207)..(207): n is a, c, g, or t
  modified_base (502)..(502): a, c, t, g, unknown or other
  misc_feature (502)..(502): n is a, c, g, or t
  modified_base (536)..(536): a, c, t, g, unknown or other
  misc_feature (536)..(536): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggccagtctgccctgactcagcctcctccgcgtccgggtctccgtggacagtcagtcaccatctccngcacgtggaacctagttcgggtgtaactttaactaaccgtagttcgttcctaccctggggttaacccaggtaccgaggtcccaacccgtacgggtacaaaaccggcccccctaaaagtccgaacttccgtaatttttaacgcgaacgtccgtacctaacgtaacgccggtaccctacgaccggggtcccctggtcttaccgtcttaccgttcgacggtcctccgtaacgtccgtacggcgtaccgtcggccctcgtcgaccggttctcgtcgggtctcgacgtccgagtaaccgntcgaggtcctgtacttacgttcgtgcggtcctanaacgtcgttaacgtaacggtttataaacctacgttaacttacgttaaccggttacgaccgggtaaggtaacccgagtacgttacggtaccccgtagttcggacccgtctacccggacccggaggtcccctccggacccccgttaggtcccaacgttcccttacccgtcccccgttcccg

SEQ ID NO: 259501 - DNA, 1200 bp, Homo sapiens
  misc_feature: GYAE6OF01BWM1Z.15.66.F11.1.454.CMB.1.raw
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatcctcctgcacgtacggaacctagtttggtgtaatttaactaaaccttagttcgttccttacccgttggggtaacccacggtaccaacgacccgaaccccgaacgggaacccaaaaacccggaccccccccgtaaaaaggttcccaaacgtttacccttaaagtttttaaacgtacggtaaccggtacccgttaaccgtaaacccggtttaaaaccgggtcccccggggtacccccgtttaccggggttaaccccgggggggtttacccccttagggtaaccctttccccgggttaccccttttcccgttaccggttccgggtaccccttaaccccggtaaacggggtttccccgttaccgggggaacccccggttaaccccggtttccccccggggttacccccccgttttaccccccggttaccggggttaaccccccgggttttcccgggttttaccccggggttcccgggggtttaccccctttaacccccgggtaaaccgggttacccccggtttaaaggggtaaaaccgggttacgggtttaaccgggggtaaccggggttaccccgtttttaaagggtttaaaccggtttttttaccggtttttacccgggtacccggggtttacccgggttaacccgtttaacgtttaaaaccggtttaaccgggttaaccggggtaaaaccgtttaaacccggtttaaaacgttttaacccggttaaccgggtttttcccggttttttaacgggtttaacccggggttttaacccgggggtaaaacgggggtttacccggggtaaaaccccggttaaaaccggggtttcccccgttaaaaccccgggtttaccccggttaaaccccgggttaaccccgggtaaaacccccgggttaacccccccgggtaaaaacccccgggttaaccccccccccgttaaaaaccccccggttacccgggttttaacccccggttaaaccccccgtttaacccccgg

SEQ ID NO: 259502 - DNA, 757 bp, Homo sapiens
  misc_feature: GYAE6OF01BACHT.15.66.F11.1.454.CMB.1.raw
  modified_base (571)..(571): a, c, t, g, unknown or other
  misc_feature (571)..(571): n is a, c, g, or t
tcagtctacgtagccacgaccggtgctcgatttagtcacgcgagaagggggggtctcaggaggcagcgctctcaggacgtcaccaccatggcctggctctgcctcctcctcagccctcctcactccagggcacagggtccctgggcccagtctgccctgactcagccctcctccgcgtccgggtctcctggacagtcagtccacctatcctcctgcctaactcggaaacctgtttcgggtataactttaattaaaccgtattgttccctccgttacggtaacccagcacgacccgaacccaggacccgaaaaccggacccccccaaaaaggttcccaattccgttaatttttacgacggtaacgtcccttaccaaccgttaacggcccggtccccgttacgtacggggtccctagacgtccgtcttactcgtcggtcctccgtaacgtcgtcggaccgtacgtcccggtacccctcccgttacggtacccgttcgtccgtcgggtcccttacccgacggacccgttaggaacgtacgtacgggacggttctaggttattttacgtttccgnggtccggtacttcgaactggtacgaacgtaattactacgtacgtttagtttccgttaccgttagggacgttacgggaactccggttacccgaccgttccgtaacgcccgacccgtaacccgaccacccccgaaccttccgcttacccgtcttaccccgttacccggtcccccttcccgttaacccg

SEQ ID NO: 259503 - DNA, 695 bp, Homo sapiens
  misc_feature: GYAE6OF01A8XK2.15.66.F11.1.454.CMB.1.raw
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
  modified_base (301)..(301): a, c, t, g, unknown or other
  misc_feature (301)..(301): n is a, c, g, or t
  modified_base (341)..(341): a, c, t, g, unknown or other
  misc_feature (341)..(341): n is a, c, g, or t
  modified_base (357)..(357): a, c, t, g, unknown or other
  misc_feature (357)..(357): n is a, c, g, or t
tcagtctacgtagccacgaccggtgctcgatttagtcacgcgagaaggggggggtctcaggaggcagcgctctcaggacgtcaccaccatggcctgggctctgctcctcctcagccctcctcactcagggcacagggtcctgggcccagtctgccctgactcagcctccctccgcggtccgggtctcctggacagtcagtcaccatctcctgcactggaaccagttggtntattataactnttcgtctccgtaggtaccagcagccaccgaggaccaaacgccccaaagtcatcactttangagctcactacgccgccgtcgcgggtcctgactcgcttcncgtcgctacgagtcgnggccgacgtccggtccctccgtcgtcccgttcgtccgtcgggtcctaccgacgtccgtaggaacgagtcggaggtcgttagttacgtttacgtttccgtcgggtaccgtcttacgtagttaacgtacgggtaacaacgttaacttagtaccgttcgttttacggttacggttacgggtaacggttaccgggtaaccgttaacgggtaccgttaacccgttacgtaaacggttcccgtaaaccggaccccggaaaccgttacccccgaaacccccgtcttacccggtaccctaacccggtttcccttacccccgtttcccccgtaccccgttaccccgg

SEQ ID NO: 259504 - DNA, 845 bp, Homo sapiens
  misc_feature: GYAE6OF01D56JJ.15.66.F11.1.454.CMB.1.raw
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcacgcctccctccgcgtccgggtctccgtggacagtcacgtccaccattcctccgtgccacgttcgggaaaccagtttgggtactaatttaactaaaccttattggttacctccgtacggtaccagctacgacccaacccgaggaccaaaaccgacccccaaaagttaccaacttaccttaagttttaacgtaggacgtaccgttaaccaaccgttaaaacgggtccccgggtaccccgttacgggtaacccggggggttcccttacgggtaaccttccggttccgtttacccgtttcggttaccgggtcccttacccggtaaacggtttccggtacgggtacccggtaacccgtttccccgggacccctttcccgttaccgggtaccccgtttccgttccggtacgggtcccttacccgacgacccgttaaggaacgtacgtagggtacggtacttagtaacgttttgttaccggtcgtaccggtacctagtacgttagtacgggaacgtaaacctaagttaacgtacgtttcgttttacgttaccggttaacggttaacgggtcgggtaacccgtacggtacccgtacgtaccgtaacggtccgaaccgtaccccgaaacggcccctaaacccgtcgttaccgacccttacctacccgttccccttacccctacccgttcccg

SEQ ID NO: 259505 - DNA, 560 bp, Homo sapiens
  misc_feature: GYAE6OF02HEAKF.15.66.F11.1.454.CMB.1.raw
  modified_base (389)..(389): a, c, t, g, unknown or other
  misc_feature (389)..(389): n is a, c, g, or t
tcagtctacgtagccacgaccggtgctcgatttagtcacgcgagaaggggggggtcggtcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattgggtgattataactatgtctcctggtaccagcagcaccaggcaaagcccccaaagtcatcattatgagctcactaagcggccctcaggggtccctgatcgtcttctctggctcaagtctggcgactcggcctccctgaccgtctctcgggctccagcctggaanagttggaggtctgtagtttacttttcgtggtccggtctacaattacgtggaagactaatttacagtctttgtcttcgggaattcggggacaaggtcaccgtctaagtccgagacccaaggacccaacccctagtccgtaccacttcccgttacgttcccccgcccttcccg

SEQ ID NO: 259506 - DNA, 524 bp, Homo sapiens
  misc_feature: GYAE6OF02H6HL9.15.66.F11.1.454.CMB.1.raw
  modified_base (192)..(192): a, c, t, g, unknown or other
  misc_feature (192)..(192): n is a, c, g, or t
  modified_base (423)..(423): a, c, t, g, unknown or other
  misc_feature (423)..(423): n is a, c, g, or t
  modified_base (474)..(474): a, c, t, g, unknown or other
  misc_feature (474)..(474): n is a, c, g, or t
  modified_base (515)..(515): a, c, t, g, unknown or other
  misc_feature (515)..(515): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacngtcagtcaccatctcctgcactggaaccatttggtgatttaataactatgtctcctggtaccagcagcacccaggcaaagcccccaaagtcatcatttatgagctcactaagcggccctcaggggtccctgatcgcttctctggctccaagtctggcgactcggcctccctcgacctctctgggctccagcctgaagatgaggctgatttatttctgcggctcatatgganacaatttacagtctttgtcttcggaagtggacaagtcaccgtcctaagtcngacccaagcccaaccccactcgtcaccttcctcgttccccnccttccccg

SEQ ID NO: 259507 - DNA, 542 bp, Homo sapiens
  misc_feature: GYAE6OF02I5NET.15.66.F11.1.454.CMB.1.raw
  modified_base (391)..(391): a, c, t, g, unknown or other
  misc_feature (391)..(391): n is a, c, g, or t
  modified_base (408)..(408): a, c, t, g, unknown or other
  misc_feature (408)..(408): n is a, c, g, or t
tcagtctacgtagccacgaccggtgctcgatttagtcacgcgagaagggggggtctcaggaggcagtgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcaccaggcaaagccccaaagtcatcatttatgagctcactaagcggccctcgacggggtccctgatcgcttctctggctccaagtctggcgactcggcctcccgtgacccgtctcgtcgggcctccagcctgaagntgaggctgattatttcnggcggtctcattatgggacgactaaattacagttcttttgtctttcgggaagttgggaccaaggtccaccgtctaagtccgaacgcccaaggcccaaccccgactgcctacttcctcgttaccccaccctcccg

SEQ ID NO: 259508 - DNA, 511 bp, Homo sapiens
  misc_feature: GYAE6OF02HCRCK.15.66.F11.1.454.CMB.1.raw
  modified_base (416)..(416): a, c, t, g, unknown or other
  misc_feature (416)..(416): n is a, c, g, or t
  modified_base (504)..(504): a, c, t, g, unknown or other
  misc_feature (504)..(504): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcaccagcaaagccccaaagtcatcatttatgagctcactaagcggcctcgaggggtccctgatcgcttctctggctccagtctggcgactcggcctcctgaccgtctctgggctccagcctgaacgatgaggctgtattatttctgcggctcatatgganacaattacagtctttgtcttcggaagtcgggacaaggtcaccgtctaagtcaacgcccaaggcccaacccatcgtcactctcgtcccnccctccg

SEQ ID NO: 259509 - DNA, 520 bp, Homo sapiens
  misc_feature: GYAE6OF02IMYMS.15.66.F11.1.454.CMB.1.raw
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcagggtccctgactcgcttctctggctccaagtctggcgactcggcctcctgaccgtctctgggctccagcctgaagatggaggctgattatttctgccggctcatagtgagaacaattacagtctttgtcttcggaagtgggaccaaggtcaccgtctaagtcagcccaaggcccaacccgatcgtaccacttctcgttaccccacctccc

SEQ ID NO: 259510 - DNA, 528 bp, Homo sapiens
  misc_feature: GYAE6OF02I0OS0.15.66.F11.1.454.CMB.1.raw
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcgacggggtccctgactcgcttctctggctccaagtctggcgactcggcctcctgaccgtctctgggcctcagcctgaagatgagctgattattctgcggtctacatagtggagactaagttacagtctttgtcgttacggaagttcgggaccaaggtcaccgttctaagtcacgcccaaggcccaacccagtcgtccacttctcgttccccgccctcccg

SEQ ID NO: 259511 - DNA, 532 bp, Homo sapiens
  misc_feature: GYAE6OF02FH4R1.15.66.F11.1.454.CMB.1.raw
  modified_base (389)..(389): a, c, t, g, unknown or other
  misc_feature (389)..(389): n is a, c, g, or t
  modified_base (408)..(408): a, c, t, g, unknown or other
  misc_feature (408)..(408): n is a, c, g, or t
  modified_base (425)..(425): a, c, t, g, unknown or other
  misc_feature (425)..(425): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcgccctcaggggtccctgatcgcttctctggctccaagtctggcgactcggcctcctgaccgtctcgtgggcctccgagcctgaacgtntgaggctgtatttattcgngcggtctcatagtgganactaattacagtctttgtcttacggaagtcggaccaggtccaccgtctaagtcgacgcccaaggcccaaccccgactcgtccaccttctcgttacccacccttcccg

SEQ ID NO: 259512 - DNA, 704 bp, Homo sapiens
  misc_feature: GYAE6OF02I664M.15.66.F11.1.454.CMB.1.raw
  modified_base (210)..(210): a, c, t, g, unknown or other
  misc_feature (210)..(210): n is a, c, g, or t
  modified_base (239)..(239): a, c, t, g, unknown or other
  misc_feature (239)..(239): n is a, c, g, or t
  modified_base (253)..(253): a, c, t, g, unknown or other
  misc_feature (253)..(253): n is a, c, g, or t
  modified_base (255)..(255): a, c, t, g, unknown or other
  misc_feature (255)..(255): n is a, c, g, or t
  modified_base (664)..(664): a, c, t, g, unknown or other
  misc_feature (664)..(664): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcccgnactacgtacgaactgtgatataactactntctctcgtacgacngnacgaccaccggcgaacaaccccgaaccctaagtactacacttaatttacgagactcctactaacgtacggcccgtcccaggggtaccggtccagtacgtccgttccttctcggtcgtccctaacgtacgttcggtacggacctaccgggtcccgtcccttccgtaccggtcccgttcctcgggccggtccctacggccgtccgaaggaacgtgtacgggcgtcttaagttaacttttcgttccggcgggtccgttacttaactaagttacgggtaaggtaaacctaaactttaacgttaacggtctttttccgttttacggttaccggtaacgggtaagggtacccgtaacggaacgtcccgtaccgttagtacacggacccgtaaccgaccgtaacccctaaccgttntcccggacttcccgtccgttccccgttcccgcccttccgg

SEQ ID NO: 259513 - DNA, 525 bp, Homo sapiens
  misc_feature: GYAE6OF02HPC3S.15.66.F11.1.454.CMB.1.raw
  modified_base (289)..(289): a, c, t, g, unknown or other
  misc_feature (289)..(289): n is a, c, g, or t
  modified_base (424)..(424): a, c, t, g, unknown or other
  misc_feature (424)..(424): n is a, c, g, or t
  modified_base (498)..(498): a, c, t, g, unknown or other
  misc_feature (498)..(498): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttangagctcactaagcgccctcgacgggtccctgactcgcttctctgctccagtctggcgactcggcctccctgaccgtctcgtcggctccgagcctgaagatgaggtctgtattatttcgtgcggtctcatatgganactaattacagtctttgtcgttcggaagtcggacctagtccaccgtactaagtcgacgcccaaggcccaacccntcgtacacctctcgttccccacctccg

SEQ ID NO: 259514 - DNA, 520 bp, Homo sapiens
  misc_feature: GYAE6OF02GZJQ3.15.66.F11.1.454.CMB.1.raw
  modified_base (386)..(386): a, c, t, g, unknown or other
  misc_feature (386)..(386): n is a, c, g, or t
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
  modified_base (492)..(492): a, c, t, g, unknown or other
  misc_feature (492)..(492): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaaagtcatcatttatgagctcactaagcgccctcacgggtcctgatcgcttctctggctccaagtctggcgactcggcctcctcgaccgtctctgggctccgagcctgaagntgaggctgattattctgcggctcatntgganacaattcagtctttgtcttacggaagtcgggacctaaggtcaccgtcctaagtcgagacccaaggcccaacccgntcgacctactctacgttcccaccctccg

SEQ ID NO: 259515 - DNA, 535 bp, Homo sapiens
  misc_feature: GYAE6OF02GGJUJ.15.66.F11.1.454.CMB.1.raw
  modified_base (391)..(391): a, c, t, g, unknown or other
  misc_feature (391)..(391): n is a, c, g, or t
  modified_base (426)..(426): a, c, t, g, unknown or other
  misc_feature (426)..(426): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcgaggggtccctgatcgcttctctggctccaagtctggcgactcggcctccctgaccgtctcgtgggctccgagcctgaagntgaggctgatttatttctgcggtctcatagtgganactaattacgagtcttttgtcgttcggaagttgggaccaaggtccaccgtacctaagtcacgacccaacggcccaaccccatcgtcacctcctcgttccccaccctccc

SEQ ID NO: 259516 - DNA, 505 bp, Homo sapiens
  misc_feature: GYAE6OF02F6HG3.15.66.F11.1.454.CMB.1.raw
  modified_base (225)..(225): a, c, t, g, unknown or other
  misc_feature (225)..(225): n is a, c, g, or t
  modified_base (384)..(384): a, c, t, g, unknown or other
  misc_feature (384)..(384): n is a, c, g, or t
tcagtctacgtagccacgaccggtgctcgatttagtcacgcgagaaggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtnattataactatgtctcctggtaccagcagcacccaggcaaagcccccaaagtcatcatttatgagctcactaagcgccctcaggggtccctgatcgcttctctggctccaagtctggcgactcggcctcctgaccgtctctgggcctccagcctgaagntgaggctgattattctgcggctcatatggagacaattacagtctttgtcttcggaagtggaccaggtcaccgtctagcagcccaaggcccaacccatcgtcactctcgttcccaccctccg

SEQ ID NO: 259517 - DNA, 688 bp, Homo sapiens
  misc_feature: GYAE6OF02J3W4N.15.66.F11.1.454.CMB.1.raw
  modified_base (246)..(246): a, c, t, g, unknown or other
  misc_feature (246)..(246): n is a, c, g, or t
  modified_base (306)..(306): a, c, t, g, unknown or other
  misc_feature (306)..(306): n is a, c, g, or t
  modified_base (312)..(312): a, c, t, g, unknown or other
  misc_feature (312)..(312): n is a, c, g, or t
tcagtctacgtagccacgaccggtgctcgatttagtcacgcgagaagggggggtctcaggaggcagcgctctcaggacgtcaccaccatggcctgggctctgctcctcctcacgcctcctcactcgacgggcacgcgggtcctcggcctagtctcgcctgactcacgcctcctccgcgtccggtctcgtaggacagtcacgtcactctctctgctacgtacggaactgttggtataattactactntcgtctccgtacgacagctaccgaccaccgacgaccaaccgacccaatcactactattanacgacncgactacgacggtccgcgtcggtacgtctagtctctcgtcgtacgtcgtactacgtacgtcgacgtcgtccgtccgtcctcgtacgtccgtcgtacggcgtacacgcgtagtacgtaacgtgacggtacttacgtagttacgtttcgcgacggttcctataacgttacgtaacgtacgtaactttacttacgttacgtcggtttacgttaccggttaacgggtaacggttaccgggaaacccttacgtaccgttacccgtaacgttaccgaccgtaacccgaaaccccgtccgtaaaccccgttaccccgtacgttccgttacccgtacccgtttccggtacccctttaccccggaccctttaccggttaacccgg

SEQ ID NO: 259518 - DNA, 685 bp, Homo sapiens
  misc_feature: GYAE6OF02GX3LE.15.66.F11.1.454.CMB.1.raw
  modified_base (227)..(227): a, c, t, g, unknown or other
  misc_feature (227)..(227): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtnattataactatgtctcctggtaccagcagcacccaggcaaacgcccccaaagtcatcatttatgagctcactaagcggccctcgacggggtccctgatcgcttctctggctcaagtctggcgactcggcctccctgaccgtctcgtgggcctccgacgccctagaacgagttggacggtccttaggtactttaattttccgtgggtccggtccttccgtaattagtgggtaacgaacctaaagttaccgaaggttccgtttttaggttaccgtttaccggggtaaaggttccgggggtaaaccctaaaagggggttcccaaccccgggtttacccgttaaacggtacccgaaaccggtacccccgtaaacggggaccccctaaaccccccgtacgttccggttaccctacccgtttacccgttacccggtttacccccctaaccccgtttacccccgg

SEQ ID NO: 259519 - DNA, 539 bp, Homo sapiens
  misc_feature: GYAE6OF02IK95W.15.66.F11.1.454.CMB.1.raw
  modified_base (392)..(392): a, c, t, g, unknown or other
  misc_feature (392)..(392): n is a, c, g, or t
  modified_base (409)..(409): a, c, t, g, unknown or other
  misc_feature (409)..(409): n is a, c, g, or t
  modified_base (416)..(416): a, c, t, g, unknown or other
  misc_feature (416)..(416): n is a, c, g, or t
  modified_base (425)..(425): a, c, t, g, unknown or other
  misc_feature (425)..(425): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagccggccctcgacggggtccctgactcgcttctctggctccaagtctggcgactcggcctccctgaccgtctcgtggcctccagcctgaagntgaggctgattatttcngcgtctnatagtgganactaattacagttcttttgtcgttacgggaagttcgggacctaaggtccaccgtctaagtccacgacccaaggcccaacccgtatcgtacctactcctcgttccccacttcccg

SEQ ID NO: 259520 - DNA, 617 bp, Homo sapiens
  misc_feature: GYAE6OF02HMQJ5.15.66.F11.1.454.CMB.1.raw
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgaattataactatgtcctcctggtaccagcagcacccaggcaaacgcccccaaagtcatcatttatgagctcactaagccggccctcgacgggtccctgactcgcttctcgtcggctacaagtcgtggcgacgtcggccctccgtcgaccgtctcgtcggtcctccgacgtcctagaagtagtggacggtctagtatttactttcgtcggtccggtcttcaagttagtgggaacgaactaatttaccgtagttcgttttcgttacgttacgggtaaaggttcgggaacctaacggtaccgtacccgttaccgtaacgtccgaacgacccgaacggaccccaaccccgtacgtaccgtcctaccgttccgtccgttaccccacccgttcccg

SEQ ID NO: 259521 - DNA, 766 bp, Homo sapiens
  misc_feature: GYAE6OF02JN7ND.15.66.F11.1.454.CMB.1.raw
  modified_base (238)..(238): a, c, t, g, unknown or other
  misc_feature (238)..(238): n is a, c, g, or t
  modified_base (252)..(252): a, c, t, g, unknown or other
  misc_feature (252)..(252): n is a, c, g, or t
tcagtctacgtagccacgaccggtgctcgatttagtcacgcgagaaggggggggtctcgaggaggcagcgctctcaggacgtcaccaccatggcctgggctctgcctcctcctcagcctcctcactcagggcacgagggtcctgggcccagtctggtccctgactcagtcctcctccgcgtccgggtctcctggacagtcagtcaccatcgtcctgcactggaacctaggttcgggtnaatttactaacctntgtcctcctggtacccagcagtcaccctaggacaaaggacccccaaagtcatcgactttatgagcttacgactaacgccggtcctcgacggggtccctaggtactcgcgttcctcgtggccttacgaagtccgtggactacgtcggccctccgtacgcccgtcgttccgcgggtcctaccgcgtacccgtaggaaacgtatacggacggtaccgttaggtaactttaaccgttttcgttacgggtccggttacttaacccgtagttaacgttacgggaaacggtaccttaaacgttaaccgacggttaccgtttttcggaccgttttaccggggaaacggtttacggggaaacccctaaagggggtttacccctaaccgggttaccccgttaaacgggtttaccgaaacccgggtacccggtaaaccggtacccccgtaaaccccgttaccgttacgggtacccttaaccgttcccgttttaccgggtttacccccttacccccggttccccgg

SEQ ID NO: 259522 - DNA, 547 bp, Homo sapiens
  misc_feature: GYAE6OF02HBFCG.15.66.F11.1.454.CMB.1.raw
  modified_base (227)..(227): a, c, t, g, unknown or other
  misc_feature (227)..(227): n is a, c, g, or t
  modified_base (430)..(430): a, c, t, g, unknown or other
  misc_feature (430)..(430): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtnattataactatgtctcctggtaccagcagcacccaggcaaacgccccaaagtcatcatttatgagctcactaagccggccctcgacgggtccctgatcgcttctctggctccaagtctggcgactcggcctcctgacccgtctcgtggcctccgagcctgaagatggacggtctagtatttattcgtgcggtctcatagtganactaattacagtctttgtcgttacggaagtcgggaacctaaggtccaccgttactaagtccacgcccgaacggccccaacccacgtcgtccaccttcgtccgttccccgcccttccg

SEQ ID NO: 259523 - DNA, 599 bp, Homo sapiens
  misc_feature: GYAE6OF02I183N.15.66.F11.1.454.CMB.1.raw
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctctggtaccagcagcaccaggcaaacgcccccaaagtcatcatttactgagctcaactaacgccggcctcgacggggtccctggactcgctttctcgtcggtctccaacgtctcgggcacgttccggcccttaccctcgacccgttctcgtcgggctccgagcctagaagacgtaggacggtctgtatttatttcgtcgcggtctacattagtggtaagaactaaacgttacaacgttctttagttcgttacggaaggtcgggtaaacctaagggtccaaccgttctaacgttcgaacgacccgaacggcccaaacccgacgttcgtccgaaccttccgtacgttccccgcccttcccg

SEQ ID NO: 259524 - DNA, 521 bp, Homo sapiens
  misc_feature: GYAE6OF02HJT8R.15.66.F11.1.454.CMB.1.raw
  modified_base (418)..(418): a, c, t, g, unknown or other
  misc_feature (418)..(418): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcttccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctcctgaccgtctctgggctccagcctgaagatgaggctgattattctgcggtctcattatgganacaattacagctttgtcttcggaagttgggaccaaggtccaccgtcctaagtcgagcccaaggcccaaccccgactcgtcacctctcgttccccaccctcccg

SEQ ID NO: 259525 - DNA, 584 bp, Homo sapiens
  misc_feature: GYAE6OF02GLRGC.15.66.F11.1.454.CMB.1.raw
  modified_base (438)..(438): a, c, t, g, unknown or other
  misc_feature (438)..(438): n is a, c, g, or t
  modified_base (574)..(574): a, c, t, g, unknown or other
  misc_feature (574)..(574): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcaccaggcaaagcccccaaagtcatcatttatgagctcactaagcggccctcacggggtccctgatcgcttctctggctccaagtctggcgactcggcctcctgacccgtctctcgggcctccgacgccctaggaagatggaggctagtatttattctggtccggtctcgtattatgggaanactaaattacagttcttttgtaccgtttagggaagttgggacctaaggttccaacccggttaccttaaacggtcgtaacggacccaaacggtaccccaacccgtacgtcgtacctaccgttcctccggtttccccncccttccccg

SEQ ID NO: 259526 - DNA, 643 bp, Homo sapiens
  misc_feature: GYAE6OF02IF8EQ.15.66.F11.1.454.CMB.1.raw
  modified_base (196)..(196): a, c, t, g, unknown or other
  misc_feature (196)..(196): n is a, c, g, or t
  modified_base (211)..(211): a, c, t, g, unknown or other
  misc_feature (211)..(211): n is a, c, g, or t
  modified_base (223)..(223): a, c, t, g, unknown or other
  misc_feature (223)..(223): n is a, c, g, or t
  modified_base (231)..(231): a, c, t, g, unknown or other
  misc_feature (231)..(231): n is a, c, g, or t
  modified_base (237)..(237): a, c, t, g, unknown or other
  misc_feature (237)..(237): n is a, c, g, or t
  modified_base (242)..(242): a, c, t, g, unknown or other
  misc_feature (242)..(242): n is a, c, g, or t
tcagtctacgtagccacgaccggtgctcgatttagtcacgcgagaaggggggggtctcgagggagcagcgctctcaggacgtcaccaccgactgggcctgggctctgctcctcctcagcctcctcactcagggcacagggtcctgggcccagtctgccctgactcagcctccctcgcgtccgggtctccgtggacngtcagtcacatctcngcactggaaccngttcggtnattaanaactntgtcctctgtaccagcacgcaaccaggacaaacgccccaaagtcacgtactatttagagagctacgactaaggccgcccgtacgacgggtccctgactccgtcttctcgtcggtcctaccgaacgttcgtcgggaccgtaccgtccggtcctaccgtcggacccgttcgtcgtcgggcctaccgagtaccgttgaaagtgttcggaacggtcttagagtttacttcggacgtcggttactgtaacgtagtaggacgtaactaagttactagtttctttcgttacgtacggaagttcgggaactaacgttccgacgtactacggtccgtaacgtaccgaaccggtaccctaaacccgtgttccgtaccaacccgttcgttaccctccccgtacccttcccgg

SEQ ID NO: 259527 - DNA, 591 bp, Homo sapiens
  misc_feature: GYAE6OF02JB5ON.15.66.F11.1.454.CMB.1.raw
  modified_base (394)..(394): a, c, t, g, unknown or other
  misc_feature (394)..(394): n is a, c, g, or t
  modified_base (436)..(436): a, c, t, g, unknown or other
  misc_feature (436)..(436): n is a, c, g, or t
tcagtctacgtagccacgaccggtgctcgatttagtcacgcgagaagggggggtcgtcgaggaggcagcgctctcaggacgtcaccaccatggcctgggctctgctcctcctcagcctcctcactcaggcacagggtcctgggcccagtctgccctgactcagcctccctccgcgtccgggtctcctggacagtcagtcaccatctcatgcactggaaccatttggtgaatttataactatgtactcctggtaccagcagcacccaggcaaacgcccccaaagtcatcatttatgagctcactaagcgccctcacgggtcctgatcgcttctctcgctcaagtctggcgactcggcctcctcgaccgtctcgtcgggcctccacgcctggaagntcgaggtctagtatttactttcgtgcggtctcagttatgganacgtaaattacagtcttttcggtctttacgggaagtcggtacctaagggtctacccgttacgtaacggttccgaacggcccgtaaccgggacccctaaaccccccgtacttccggtaccctaacccgttccgttaccgttccccccgtaaccccc

SEQ ID NO: 259528 - DNA, 557 bp, Homo sapiens
  misc_feature: GYAE6OF02IX3C5.15.66.F11.1.454.CMB.1.raw
  modified_base (420)..(420): a, c, t, g, unknown or other
  misc_feature (420)..(420): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaacgcccccaaagtcatcatttatgagctcactaagcggccctcgacgggtccctgactcgcttctctgctccagtctggcgactcggcctccctgaccgtctcgtgggcctccgacgtcccgtagaagatggaggtcctagtatttagtttcncgcgtctcatataggatactaattacagtctttgtcgttcggaagttcgggacctaaggtccaccgtcctaagtccaacggacccgaacggcccaacccctagtcgtaccacgttcctccgttccccgccccttccg

SEQ ID NO: 259529 - DNA, 636 bp, Homo sapiens
  misc_feature: GYAE6OF02FQYG2.15.66.F11.1.454.CMB.1.raw
  modified_base (289)..(289): a, c, t, g, unknown or other
  misc_feature (289)..(289): n is a, c, g, or t
tcagtctacgtagccacgaccggtgctcgatttagtcacgcgagaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcaccaggcaaacgccccaaagtcatcatttangagctcactagccgcctcgacgggtccctgactcgcttctctgctcagtctgcgactcggcctcctcgacccgtctcgtcgggcctccgacgtcctagaacgtagtcggaggtctgtatttattccgtggccggtctctatacgtaggacgtaactaacttacgagttcgttttcggttacgttaccgggtaaggttacgggtaacccgtaaggttacccgtaacccggttaccgttaacgtccggaaccggtaaccccgaaaccgggtacccccaaacccccgtacgttaccggttaccctacccgtttccgttacccggtttacccccctaccccgttaccccgg

SEQ ID NO: 259530 - DNA, 556 bp, Homo sapiens
  misc_feature: GYAE6OF02JYEE7.15.66.F11.1.454.CMB.1.raw
  modified_base (422)..(422): a, c, t, g, unknown or other
  misc_feature (422)..(422): n is a, c, g, or t
  modified_base (455)..(455): a, c, t, g, unknown or other
  misc_feature (455)..(455): n is a, c, g, or t
tcagtctacgtagccacgaccggtgctcgatttagtcacgcgagaagggggggtcgtcgaggaggcagcgctctcaggacgtcaccaccatggcctgggctctgctcctcctcagcctcctcactcagggcacagggtcctgggcccagtctgccctgactcagcctgcctccgtgtctgggtctcctggacagtcgatcaccatctcctgcactggaaccagcagtgatgttggggttatcgaccttgtctcctggtaccaacaccaccccggcacgacgccccccaaactccaatgatttatgacggaccactaagccgaccctcagggctttacaatcgcttctctgctccaagtctggactaacacggcctccctgacaatctctagggctccaggctgacgacgagctaatcttacngctgctcatactggtaagttactaacacgttanacgttacgttcggacggtaacggacctaagctacgaccgttccgtggtacctcaacgtacccgaaggcctacggcccccgttggtcctacgtccttacccg

SEQ ID NO: 259531 - DNA, 533 bp, Homo sapiens
  misc_feature: GYAE6OF02GULFN.15.66.F11.1.454.CMB.1.raw
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcgagggtccctgactcgcttctctggctccaagtctggcgactcggcctcctgacccgtctctcgggcctccgacgcctgaagatggaggctgtattactttctgcggtctcatagtggagacaattacagtctttgtcttcggaagtcgggacctaaggtccaccgttctaagtcaacgcccaaggcccaacccgctcgtccacttctccgttccccacctccc

SEQ ID NO: 259532 - DNA, 558 bp, Homo sapiens
  misc_feature: GYAE6OF02I2JOY.15.66.F11.1.454.CMB.1.raw
  modified_base (229)..(229): a, c, t, g, unknown or other
  misc_feature (229)..(229): n is a, c, g, or t
  modified_base (366)..(366): a, c, t, g, unknown or other
  misc_feature (366)..(366): n is a, c, g, or t
  modified_base (431)..(431): a, c, t, g, unknown or other
  misc_feature (431)..(431): n is a, c, g, or t
  modified_base (443)..(443): a, c, t, g, unknown or other
  misc_feature (443)..(443): n is a, c, g, or t
  modified_base (551)..(551): a, c, t, g, unknown or other
  misc_feature (551)..(551): n is a, c, g, or t
tcagtctacgtagccacgaccggtgctcgatttagtcacgcgagaagggggggggtctcaggaggcagcgctctcaggacgtcaccaccatggcctgggctctgctcctcctcagccctcctcactcagggcacagggtcctgggcccagtctgccctgactcagcctccctccgcgtccgggtctcctggacagtcagtcaccatctcctgcactggaaccattggtnattataactatgtctcctggtaccagcagcacccaggaccaaacgcccccaaagtcatcatttatgagctcactaagcggccctcgacggggtccctgactcgtcttctctgctccaagtctggcgactcgcctccncgtaccgtctcgtcgggtcctccgagcccgtagaagactggaggtctgtatttattctcggcgtntctatagtgganactaattacgagtctttgtcgttacggtagtacggtaccaaggtcctaccggtctaagtccaacgcccgaacgacccaacccgtctacgtcctacgtctccgttcccncctcccg

SEQ ID NO: 259533 - DNA, 686 bp, Homo sapiens
  misc_feature: GYAE6OF02I02BF.15.66.F11.1.454.CMB.1.raw
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattaataactatgtctcctggtaccagcagcaccaggacaaacgccccaaagtcatcatttatgagctcactaagcggccctcgagggtccctgatcgcttctctcggctaccgaagtctggccgactcggccctcctgacccgtctcgtacggcctccgagtcctaggaagtagtaggaggccttaggtaattttacttttccgtcggtccggttccttacgtagttaagttacgggaacgtaaacctaaagtttaaccgtaggtttacctttttacggttccgtttaacgggtaaaggtttacggggaaacccctaaaggggttaccctaacccggttaccgttaaacggttccgaaccggtaaccccaaaacggggtcccccaaaacccccgtcgtttaaccggtacccttaacccgttccgttaaccccggttttccccctaaccctttccccgg

SEQ ID NO: 259534 - DNA, 530 bp, Homo sapiens
  misc_feature: GYAE6OF02G5Q0H.15.66.F11.1.454.CMB.1.raw
  modified_base (222)..(222): a, c, t, g, unknown or other
  misc_feature (222)..(222): n is a, c, g, or t
  modified_base (229)..(229): a, c, t, g, unknown or other
  misc_feature (229)..(229): n is a, c, g, or t
  modified_base (393)..(393): a, c, t, g, unknown or other
  misc_feature (393)..(393): n is a, c, g, or t
  modified_base (406)..(406): a, c, t, g, unknown or other
  misc_feature (406)..(406): n is a, c, g, or t
  modified_base (411)..(411): a, c, t, g, unknown or other
  misc_feature (411)..(411): n is a, c, g, or t
  modified_base (418)..(418): a, c, t, g, unknown or other
  misc_feature (418)..(418): n is a, c, g, or t
tcagtctacgtagccacgaccggtgctcgatttagtcacgcgagaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccnttgggtnattataactatgtctcctggtaccagcagcacccaggcaaacgcccccaaagtcatcatttatgagctcactaagcggccctcgacggggtccctgatcgcttctctggctccaagtctggcgactcggcctcctgaccgtctcgtgggcctccagcctgaagngtgagctgtattntttcngcggctnatatgagacattacgagtctttagtcgtttacggagttcgggacacggtactaccgtcgtaagtcgacgacccacgacccacccgatcgtccactctccgtcccgcctcccg

SEQ ID NO: 259535 - DNA, 588 bp, Homo sapiens
  misc_feature: GYAE6OF02JF2NE.15.66.F11.1.454.CMB.1.raw
  modified_base (227)..(227): a, c, t, g, unknown or other
  misc_feature (227)..(227): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtnattataactatgtctcctggtaccagcagcacccaggcaaacgcccccaaagtcatcatttatgagctcactaagcggccctcgacgggtccctgatcgcttctctggctccaagtctggcgactcggcctccctcgacccgtctccgtcgggtcctccgacgcctagaacgagtggaggcttagtatttactttcgtcggccggtctctagtagtggaacaactaattacagtcttttcgtcgttacggtaaggttcgggaacctaagggtcctaccgttacctaaggtccaacggacccaacggaccccaaccccgtactacgtacctaccgtccgttccggttccccgtcccttcccg

SEQ ID NO: 259536 - DNA, 719 bp, Homo sapiens
  misc_feature: GYAE6OF02HZ1NK.15.66.F11.1.454.CMB.1.raw
  modified_base (289)..(289): a, c, t, g, unknown or other
  misc_feature (289)..(289): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataaactatgtctctggtaccagcagcacccaggcaaacgccccaaagtcatcatttangagtctacactaacgcggccctcgacgggtccctgactcgtcttctcgtcggtcctaccgaacgtctcggccgtaccgtccggcccttcccgtcgacccgttctccgtcgggtcctcccgaggtccctaggaaacgtagttcggaacggtcgttaggttaactttacgtttcgtacgggtccggttcttacgaagttacgttacgggaacgtaaacgttaaacgttttaaaccgtacggtttactttttacgggttaccgtttaacggggttaaaggttaccggggtaaacctaaacgggttccgtaacccggtttaccgtaacggtacccgaaaccggtaccccgaaacggtaaccccctaaaccccgtaccgttacgttaaccctacccgtttaccttaccccgtttacccccaccccgtttaccccg

SEQ ID NO: 259537 - DNA, 546 bp, Homo sapiens
  misc_feature: GYAE6OF02FQGQE.15.66.F11.1.454.CMB.1.raw
  modified_base (390)..(390): a, c, t, g, unknown or other
  misc_feature (390)..(390): n is a, c, g, or t
  modified_base (435)..(435): a, c, t, g, unknown or other
  misc_feature (435)..(435): n is a, c, g, or t
  modified_base (516)..(516): a, c, t, g, unknown or other
  misc_feature (516)..(516): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagcctggcgactcggcctccctgaccgtctcgtcggcctccacgcctgaagntaggacggtctgtatttatttctggtcggtctctagttatggganaacaattacagtctttgtcgttacggaagttgggaccaaggtccaccgttccgtaagtccacgcccaacggccccaacccntcgtccacttccgtcgttcccgcccttccg

SEQ ID NO: 259538 - DNA, 570 bp, Homo sapiens
  misc_feature: GYAE6OF02INMDE.15.66.F11.1.454.CMB.1.raw
  modified_base (427)..(427): a, c, t, g, unknown or other
  misc_feature (427)..(427): n is a, c, g, or t
  modified_base (438)..(438): a, c, t, g, unknown or other
  misc_feature (438)..(438): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggaccaaacgcccccaaaagtcatcatttatgagctcaactaagccgccctcgacgggtcccttatcgcttctcgtgctcaagtctggcactcggcctccgtcgaccgtctcgtcgggcctccgacgtcctagaagtatggagctgtatttattcgtgcggtctnactagtagganaactaagttacagttctttgtcgttacggagtcggaaccgtaggtacctaccgtactagacaccgacccaacgccccaacccgtacgtcgtacctaccgtccttacccggttccccgtcccctccgtacccg

SEQ ID NO: 259539 - DNA, 623 bp, Homo sapiens
  misc_feature: GYAE6OF02F6Y6S.15.66.F11.1.454.CMB.1.raw
  modified_base (292)..(292): a, c, t, g, unknown or other
  misc_feature (292)..(292): n is a, c, g, or t
  modified_base (433)..(433): a, c, t, g, unknown or other
  misc_feature (433)..(433): n is a, c, g, or t
  modified_base (444)..(444): a, c, t, g, unknown or other
  misc_feature (444)..(444): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtcctcctggtaccagcagccacccaggcaaacgcccccaaagtcatcatttangagctacactaagccggcctcgacgggtccctgactcgcttctctggcctcaagtctggcgactcggcctccctgtacccgtcgtcgtcgggtcctccgacgtcctaggaacgtactggacggtctagtatttactttcgnggtcggtcctntagttagtggaacgtaactaacgtttacagttcgttttagttccgttacgggtaacgttcgggaaacctaacgggtccgtaaccgttaccgtaagtccgaacgtaccccgaaacggtaccccaaacccctacgttacgtacctaccgttccgttcccggttaccccgcccctttacccg

SEQ ID NO: 259540 - DNA, 669 bp, Homo sapiens
  misc_feature: GYAE6OF02IBUS3.15.66.F11.1.454.CMB.1.raw
tcagtctacgtagccacgaccggtgctcgatttagtcacgcgagaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccatttggtgatttaataactatgtctcctggtaccagcagcaccaggcaaacgcccccaaagtcatctatttatgagtctacacgtaagcggtccctcgacgggtccctgactcgtcttctcgtcgtctaccaagtctcggcgtactcggcctcctcgtacccgtctcgtcggcctccgacgccgtagaacgtacgtcggacggtctagtactttacgtttcgtaggtccggtacttacaagttagtagggactaactaactttaacgaaggtttcttttacggttaccgtttacgggtaacgggttccgggaaaccgtaacgggttacccgaccgttacccgttaaacgtcccgaaacgtaccccgaaaccgggtaccccctaaaccccgtacgttaccgtaacccgtaccgttacccgtttccggttccccccgaccccgttacccg

SEQ ID NO: 259541 - DNA, 648 bp, Homo sapiens
  misc_feature: GYAE6OF02IYW5A.15.66.F11.1.454.CMB.1.raw
  modified_base (221)..(221): a, c, t, g, unknown or other
  misc_feature (221)..(221): n is a, c, g, or t
  modified_base (227)..(227): a, c, t, g, unknown or other
  misc_feature (227)..(227): n is a, c, g, or t
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
  modified_base (239)..(239): a, c, t, g, unknown or other
  misc_feature (239)..(239): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccggtctcctggacagtcagtcaccatctcctgcactggaacctnttggtnattanaactntntcctcctggtaccagcacgccaccaggacaaacgacccccaaagtcatacatttaatgagctcactaagccggccctcgacgggtccctgatccgcttcgtctcggtctaccgaagttcctgggctaccgtcggccctcccgtcgtacccgttcgtccgtcgggtcctccgaccgtccgtaggtaacgtaggtcgtaggtccgtagtactttacgttcgtcggcggtctacgtaattagtaggtacgtactaacgttacgtaagttcgtttacgttacgttacgggtaaggttcggaacgttaacggtacctaccggtacctaacggtccgaaccggtaacccgtacggaaccccgtaacccgacgttacgacctaccgtaccgtttaccgtaccccctaccctcccgg

SEQ ID NO: 259542 - DNA, 602 bp, Homo sapiens
  misc_feature: GYAE6OF02JAI55.15.66.F11.1.454.CMB.1.raw
  modified_base (392)..(392): a, c, t, g, unknown or other
  misc_feature (392)..(392): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagccggccctcgacgggtccctgactcgcttctctggctcaagtctggcgactcggcctcctcgaccgtctcgtgggtcctccagcctgaagngtggaggtctgtatttatttcgtggtccggtctacgattagtagggactaactaatttacagttcttttaggttcgtttacgggaaggttcggggaacctaagggttcctaacccggttaccttaacgtccgtaacggacccgaacgggacccctaaccccgacgttaccgtacctaccttccgttccgtttcccccgccccttaccccg

SEQ ID NO: 259543 - DNA, 643 bp, Homo sapiens
  misc_feature: GYAE6OF02G2MAC.15.66.F11.1.454.CMB.1.raw
  modified_base (220)..(220): a, c, t, g, unknown or other
  misc_feature (220)..(220): n is a, c, g, or t
  modified_base (225)..(225): a, c, t, g, unknown or other
  misc_feature (225)..(225): n is a, c, g, or t
  modified_base (322)..(322): a, c, t, g, unknown or other
  misc_feature (322)..(322): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagccctccctccgcgtccggtctcctggacagtcagtcaccatctcctgcactggaaccnttggngattaataactatgtctcctggtaccagcagccaccagaccaaacgcccccaaagtcatctattatgagctacactaagcgccctcgacgggtcccngatcgtcttcgtctggcctaccgtaagtctggcactccggcctccgtcgtaccgtctcgtcggctccgagtcctagaacgtgtggacggtactagtacgtttacgttcgtcggtcggtacctactacgtagtggtaaacgtacctaaatttaccgagttccgtttttcggtaccgtttacgggtaaggtccgggtaaaccgtaacggttccctaaccggtttaccgtaacgtccgaaacggtaccccaaacggtaaccccctaaaccccgtacttccggtaccctaaccgttccttacccgttaccccaccccgttacccg

SEQ ID NO: 259544 - DNA, 644 bp, Homo sapiens
  misc_feature: GYAE6OF02FQUAL.15.66.F11.1.454.CMB.1.raw
  modified_base (291)..(291): a, c, t, g, unknown or other
  misc_feature (291)..(291): n is a, c, g, or t
  modified_base (431)..(431): a, c, t, g, unknown or other
  misc_feature (431)..(431): n is a, c, g, or t
tcagtctacgtagccacgaccggtgctcgatttagtcacgcgagaagggggggggtatcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaacgcccccaaagtcatcatttangagctacactaagccggccctcgacggggtccctgactcgcttctctggctccaagtctggccgactcggccctccctgtacccttctcgtcgggcctccgacgcctaggaagtagtggtacggcttgatttactttcgngtccggtcttacagttagaggacgaactaattacgtagttcttttgttaccgttacgggtaaggtcgggtaaccctaaagggttcccaacccggttaccgtaacggtccgtaacccggaccccgtaaaaccgggcccctaaaacccccgtacgtttaccggtaccttaacccgttccgttaccccggtttcccccgtacccccgttaccccgg

SEQ ID NO: 259545 - DNA, 609 bp, Homo sapiens
  misc_feature: GYAE6OF02JIQC3.15.66.F11.1.454.CMB.1.raw
  modified_base (229)..(229): a, c, t, g, unknown or other
  misc_feature (229)..(229): n is a, c, g, or t
  modified_base (441)..(441): a, c, t, g, unknown or other
  misc_feature (441)..(441): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgccactggaaccattggtnattataactatcgtctcctggtaccagcagcacccaggcaaacgccccaagtcatcattatgagctcactaagccggcctcgacgggtccctgatcgcttctctcggctccaagtcgtcggcgtactcggccctccctcgacccgtctcgtcgggccttccgacgtccctaggaacgtagtacggaggtccttggtacttttaagtttccgnggtccggtctactagtagttcgggaacaactaacttacgacgttactttgttacgttacggtaaggttcggaaccgtaaggtcctaaccgttacgtaacgtcgacgacccgaacggaccctaacccgtacgtacgtccaccgttccttccgtacccctacccttcccg

SEQ ID NO: 259546 - DNA, 606 bp, Homo sapiens
  misc_feature: GYAE6OF02FPWSE.15.66.F11.1.454.CMB.1.raw
  modified_base (424)..(424): a, c, t, g, unknown or other
  misc_feature (424)..(424): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcaccaggcaaaacgccccaaagtcatcatttatgagctacactaagccggccctcgaggggtccctgactcgcttctctggctcaagtctggcgacgtcggccctccgtcgtacccgtctcgtgggcctccgcgcctaggaagtactggacggctgtatttatttcgnggtcggctctatagtggactaactaattacagttcgttttcgtcgtttacggaaggttcgggaaccgtaaggtccgaaccgttacctaacggtaccgaacggtaccccgaaacggaccccctaaaccccgtacgttaccgtacctacccgtttcctacccgtttccccctaccccgttcccg

SEQ ID NO: 259547 - DNA, 721 bp, Homo sapiens
  misc_feature: GYAE6OF02IYYY8.15.66.F11.1.454.CMB.1.raw
  modified_base (231)..(231): a, c, t, g, unknown or other
  misc_feature (231)..(231): n is a, c, g, or t
tcagtctacgtagccacgaccggtgctcgatttagtcacgcgagaagggggggggtctcaggaggcagcgctctcaggacgtcaccaccatggcctgggctctgctcctcctcagcctcctcactcagggcacagggtcctgggcccagtctgccctgactcagccctccctccgcgtccgggtctccgtggacagtcagtcaccatcctcctgcactggaaccattggtnattataactatgtctcctggtaccagcagcaccaggacaaacgaccccaaagtcatcatttatgagctacactaagccggccctcgacgggtccctgactcgcttctcgtcggctacgaagtcgtggcgactccggcctccgtcgacccgtctcgtcgggtcctaccgacgtccgtacgaaaggtacgtaggtacgggtacttaggttagtttaacttttccgtacggtaccgggtaccttacgtaacttagtaacgggtaacgtaaccttaaaacgtttaaccgtaaggtttccgtttttacggttaccgtttacggggtaaacgggttaccggggaaaccttaaacgggttaccgtaaccccggttaccgttaaacggttaccgaaaccggtacccccgtaaaacggggtaaccccctaaaaccccgtacgttacccgttaccgtaaccgttcccgttacccggtttcccccgtacccccttacccgg

SEQ ID NO: 259548 - DNA, 629 bp, Homo sapiens
  misc_feature: GYAE6OF02HRIHH.15.66.F11.1.454.CMB.1.raw
  modified_base (298)..(298): a, c, t, g, unknown or other
  misc_feature (298)..(298): n is a, c, g, or t
  modified_base (582)..(582): a, c, t, g, unknown or other
  misc_feature (582)..(582): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaaccattggtgattataactatgtctcctggtaccagcacgccacccgaggaccaaacgacccccaaagtcatctatttangagcctacactaacgccggccctcgacgggtccctgactcgcttctcgtcgcctccgtagtctggcgacgtccggcctcccgtgacccgttctcgtcggcctccgacgtcctagaagtacgtaggacggtcttagtatttactttcgtggccggtctatagttagtaggaagtaactaattactacgttcgttttacgtcgttacgggtaacgttcgggaacgtaacggtcctacccgttacttaacgtaccgaacggtacccgaacggtacccctaaccccgngttaccgtacctaccgttccgttaccccgttccccgtacccttcccg

SEQ ID NO: 259549 - DNA, 850 bp, Homo sapiens
  misc_feature: GYAE6OF02IK2NP.15.66.F11.1.454.CMB.1.raw
  modified_base (604)..(604): a, c, t, g, unknown or other
  misc_feature (604)..(604): n is a, c, g, or t
  modified_base (772)..(772): a, c, t, g, unknown or other
  misc_feature (772)..(772): n is a, c, g, or t
tcagtctacgtagccacgaccggtgctcgattttagtcacgcgagaagggggggggtctcaggaggcagcgctctcagggacgtcaccaccagtcggccgtgggctctcgcctcctcctcacgtcctcctcactcgacgggcacgtcgggtccgtcgggacccagtctcgccctgacctcgaccgtccccttcccgtccggtccggttcccggtccttccggtaggactacgtacgactccaacctcttccgtccgtcgaccgtacgtaacggtaacttaggttaggtattaacttaacttaacttcgttcgtccgttacggtaccggtaaccgacgaccgaaccgaaccgaacccgaaacggaaaaccccgtaaaaccccaacccgtaagttactaacgttaactttaagttaacggacgtaccgtacctaaccggtaaccggtaccgggtcccgtccggtaacggggtccggttaccttcggtaccttccgtttacctacggttcggtaccgtccgtaaccgttcgggtccggtaccggtaccctcccgggttcccgttcccgttaccgtccggttacccgttcgtaccgggaccgttaccncggtaacgtaggtacgaggtcggtacggttacgttatttacgtttcgttgtcggtcgaccttaagtaatacggtactaaacggtaacttcgtttaagtcgtttacgtttacgggtacgtaagggtaacggacgttaccggaacttaccgtacgtactaaccggtaccnccggtaaacccacccggtaacctaccctaccgttacgtccgttaacctccccgttaaccgtcccctacccgcgtaacg

SEQ ID NO: 259550 - DNA, 783 bp, Homo sapiens
  misc_feature: GYAE6OF02GUPW6.15.66.F11.1.454.CMB.1.raw
  modified_base (299)..(299): a, c, t, g, unknown or other
  misc_feature (299)..(299): n is a, c, g, or t
tcagtctacgtagccacgaccggtgctcgatttagtcacgcgagaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtagattataactatgtctccgtggtaccagcagccacccaggacaaacgacccccaaagtcaatactatttangagctacaactaacgccgccctcgacgggtccctgactcgtccttcgtctcgcctaccgaagtcgtcggcgtaccgtccggtccctcccgtcgtacccgttctccggtcgggtcctccgtacgtcccgtaggaaacgtagtcggtacggtcttacggttaactttacgtttccggtcgggtccggtcttacgtagttacgtacggtaactaaccgttaaagtttaccgaacggtttccgtttttacggttaccggtttaaccggggtaacgggttaccggggtaaaacccgttaaacgggttaccccgtaaaccccggttttaccgtaaaccgggttcccgtaaacccgggtaaacccccgtaaacccggggtaaccccccccttaaaaacccccggttcccgtttaaccggttaccccgttaaaccccgttttccccggtttacccccggtttaccccccccgtaacccccttttccccccgg

SEQ ID NO: 259551 - DNA, 688 bp, Homo sapiens
  misc_feature: GYAE6OF02IC27Q.15.66.F11.1.454.CMB.1.raw
  modified_base (233)..(233): a, c, t, g, unknown or other
  misc_feature (233)..(233): n is a, c, g, or t
  modified_base (238)..(238): a, c, t, g, unknown or other
  misc_feature (238)..(238): n is a, c, g, or t
tcagtctacgtagccacgaccggtgctcgatttagtcacgcgagaaggggggggttctcgaggagcagcggctctcaggacgtcaccaccatggccctgggctctgtctcctcctcagccctcctcactcgagggcacagggtcctggggcccagtctgccctgactcagcctcctccgcgtccgggtctcctggacagtcagtcaccatctcctgcactgaaccatttcggnattanaaactatgtctcgtggtaccagcagcaaccaggcaaagcccccaaagtcatcattatgagctacactaagcggacctcgagggtcctgatacgcttctctgctacgaagtctcggcgtactcggtcctacccgtgtaccctctcgtcgggctcccgacgccctagaacgtactacggaggcttacggtaactttacgtttacgtgtaccggtcttactaggtaacttacgggaaagtaacctaaactttaaccgtaaggttccttttacggttaccggtttacgggaaacgggttaccgggaaacccgttaaacgggttaccgtacccgttaaccgttaaacgttaccgaaccggtacccgaaaccgggacccccgtaaaccccgtacgtaccggttaacctaacccggttaccgtttacccggtttaccccccggaccctttaccccgg

SEQ ID NO: 259552 - DNA, 552 bp, Homo sapiens
  misc_feature: GYAE6OF02IU2KN.15.66.F11.1.454.CMB.1.raw
  modified_base (228)..(228): a, c, t, g, unknown or other
  misc_feature (228)..(228): n is a, c, g, or t
  modified_base (518)..(518): a, c, t, g, unknown or other
  misc_feature (518)..(518): n is a, c, g, or t
  modified_base (545)..(545): a, c, t, g, unknown or other
  misc_feature (545)..(545): n is a, c, g, or t
tcagtctacgtagccacgaccggtgctcgatttagtcacgcgagaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtnattataactatgtctcctggtaccagcagcacccaggcaaagcccccaaagtcatcatttatgagctcactaagcggccctcgacgggtccctgatcgcttctctcggctccaagtctcggcgactcggcctcccgtgacccgttctcgtgggcctccgacgcctgaagatggaggtctgtattactttcgtgcggtctctatatggatacaattacagtctttgtcgttacgggaagtgggaacctaaggtccaccgtctaacgtcgtacgcccaacggacccaacccncgtcgtacctccttctccgttaccccnccctccc

SEQ ID NO: 259553 - DNA, 663 bp, Homo sapiens
  misc_feature: GYAE6OF02H2UNB.15.66.F11.1.454.CMB.1.raw
  modified_base (225)..(225): a, c, t, g, unknown or other
  misc_feature (225)..(225): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctcgcgtccggtctcctggacagtcagtcaccatctcctgcactggaaccattggtnattataactatgtctctggtaccagcacgcaccaggacaaacgacccccaaagtcatctatttatgagctcactaagccgaccctcgacgggtcctagactcgtcttctctcggctacaagtctggcgacgtccggcctcctcgacccgtctcgtacggccttccgacgtccgtagaacgtacgtacggaggtcttagtacttttacgtttcgtcggtaccggtaccttacgtaattaacggttcggaaacgtaacctaaagtttaaccgtaagttccgtttttacggttacgttaacgggttaaaccggttaaccggggaacctaaccggggttaccttaccggttacccgtagtacccgtacgaccccgaaacggccccctaaacccgtcgtacgtacccgttacctttcccgttaccttacccccacccttcccg

SEQ ID NO: 259554 - DNA, 635 bp, Homo sapiens
  misc_feature: GYAE6OF02I8TBI.15.66.F11.1.454.CMB.1.raw
  modified_base (227)..(227): a, c, t, g, unknown or other
  misc_feature (227)..(227): n is a, c, g, or t
  modified_base (622)..(622): a, c, t, g, unknown or other
  misc_feature (622)..(622): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtnattataactatgtctcctggtaccagcagcaccaggcaaacgcccccaaagtcatcattatgacgctcactagccggcctcgacgggtcctgactcgtcttctcgtgctcagtctggcgactccgcctcctgtacctctcgtcggcctccgagcctagaacgtgtggaggtcttagtactttacgtttcgtcggaccggtctagtaacttaggtacggaagtaacctaaagttaccgtaacggttccttttaggttaccggtttaccgggaaggttacggggaaaccctaagggtccctacccggttaccgtaacggtccgaacccggtaccccgaaacggtacccccaaccccgtacgtaccgtacctaccgttcccgttcccggttacccccnccccgttaccccg

SEQ ID NO: 259555 - DNA, 722 bp, Homo sapiens
  misc_feature: GYAE6OF02H6JFU.15.66.F11.1.454.CMB.1.raw
  modified_base (230)..(230): a, c, t, g, unknown or other
  misc_feature (230)..(230): n is a, c, g, or t
  modified_base (357)..(357): a, c, t, g, unknown or other
  misc_feature (357)..(357): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcgagggcacagggtcctgggcccagtctgccctgactcagcctccctcgcgtccggtctccgtggacagtcagtccacctatctcctgcactggaacctattggtnattaataactatgttctccgtggtaccagcacgcacccgaggacaaacgcccccaaagtcatctaatttatgagcttacacgtaacggccggacccgtcgaccggggtccctagacgtcgtctttcnctcggcctaccgaacgtctcggccgacgttccggccctccgtacgtaccgtcgttccgtcgggtccctaccgacgtccgtaacgtaaacgacgttagggaccggtacgttagtaattttacgtttaccgtcgggtaccggttacttacgtagttaacgtcggggtaaactaaccgtttaaacgtttaccgtaaggttttccgtttacggtttaccggtttaccggggtaaaggtaccggggtaacctaaacgggtaccctaaccggttaccgtaaacgtcgaaccgaccccgtaacgggaccccctaaacccgacttcggtaacctaccgttcccggtttcccgttacccccctaccgttacccg

SEQ ID NO: 259556 - DNA, 725 bp, Homo sapiens
  misc_feature: GYAE6OF02IB59T.15.66.F11.1.454.CMB.1.raw
  modified_base (216)..(216): a, c, t, g, unknown or other
  misc_feature (216)..(216): n is a, c, g, or t
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcgagggcacgagggtcctgggcccagtctgccctgactcgacgtccctcccgtccgcggtccgggtctccgtggacagtcagtcaccatctcngcacgtggaacngttggntaattacaatntcgtctcgtggtaccagtcacgcaccgaggacaaacgcccaaagtcaatcgtattacgacgaagctacgaacgtaaacggtccggtccgtacggtacggggtccctagtacgttccggtcttcgtcgtccggtacgtaccgtaagttccgacgggtaacgtccggtcgtcccgtaccgtcggtacccgttcgtaccggtccgggtctaccgacgtccgtaaggaatacgtacggagtccgttagtaacgtttactcggtcgacggtacttaacgtaagttacggtaacgaacgaaaccgttaaccgttaaggtacgtttcgtttacggttaccggttaacgggaaacgggtttccggaaaacggttcggtaaccgttacccggtaacgttaaggacccgtaaccggaacccgtaaccgtaaccccgtaaccctggtccttacggtaccgtttaccgttcccggtaccccttacccgtccg

SEQ ID NO: 259557 - DNA, 715 bp, Homo sapiens
  misc_feature: GYAE6OF02HIJVA.15.66.F11.1.454.CMB.1.raw
  modified_base (294)..(294): a, c, t, g, unknown or other
  misc_feature (294)..(294): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagccctcctccgcgtccgggtctcctggacagtcagtcaccatctcctgcactggaaacctattcggtgtaattaataactatgtctcctggtaccagcagcaccaggcaaacgccccaaagtcatcatttangagctacactaagccggcctcgacgggtccctgactcgtcttctcgtcgctaccaagtcgtggcgacgtccggcctcccgtgaccgtctcgtcggcctccgacgtccctaggaacgtagtcggaacggtctaggtatttacgtttcgtcggaccggttcttacgtaagttacggtagggtaaactaaccgttaaacgtttaccgtaacggtttaccgtttttacggtttaccgggtttacggggtaaacggtttccggggtaaaccctaaacggggttacccgtaacccggttaccgttaaacggttacccggaaccggtaacccccggtaaaccggaacccccctaaaccccgtacgtttaccggttaccctaccgtttaccccggtttacccgtttaccccccctacccgttaccccgg

SEQ ID NO: 259558 - DNA, 737 bp, Homo sapiens
  misc_feature: GYAE6OF02F6WOH.15.66.F11.1.454.CMB.1.raw
  modified_base (197)..(197): a, c, t, g, unknown or other
  misc_feature (197)..(197): n is a, c, g, or t
  modified_base (231)..(231): a, c, t, g, unknown or other
  misc_feature (231)..(231): n is a, c, g, or t
  modified_base (239)..(239): a, c, t, g, unknown or other
  misc_feature (239)..(239): n is a, c, g, or t
  modified_base (251)..(251): a, c, t, g, unknown or other
  misc_feature (251)..(251): n is a, c, g, or t
  modified_base (310)..(310): a, c, t, g, unknown or other
  misc_feature (310)..(310): n is a, c, g, or t
  modified_base (496)..(496): a, c, t, g, unknown or other
  misc_feature (496)..(496): n is a, c, g, or t
  modified_base (516)..(516): a, c, t, g, unknown or other
  misc_feature (516)..(516): n is a, c, g, or t
tcagtctacgtagccacgaccggtgctcgatttagtcacgcgagaaggggggggtctcgagggaggcagcgctctcaggacgtcaccaccgatggcctgggctctgctcctcctcagcctcctcactcagggtcacagggtcctgggcccagtctgccctggactcagcctccctccgcgtccgggtctcctggacngtcagtcaccatctccgtgcaccgtcggaaaccngttcggtnattataaacgtntgtcctacctggtaccagcagccaccaggacaaacgccccaaagtccagtctactttanagacgctacaacgtaagccggtacccgtacgacggggtcccctagtacttaccgtcttcgtaccgtcggtacctacccgtaaggttcccgttacgggaccggtaccgttccgggcccttcccgtacggtacccgtccgttccgtcggggcctaccgacgtcccgtagaacgtacttcggaacggtnttacggtattacgtttccgnggtccggtcctacgtacgttagtggacgtaacgtaacgtttactacgtttcgttttaggttaccgttacgggtaacgttaacgggtaaaccttaacgggttaaccctaccggttaccctaaggtacccgtaacggtaccccgtaaacgggaccccctaaacccgtagtttacccggtacttacccgtaccgttacccggtttaccccacccccgttacccg

SEQ ID NO: 259559 - DNA, 700 bp, Homo sapiens
  misc_feature: GYAE6OF02JTKBZ.15.66.F11.1.454.CMB.1.raw
  modified_base (320)..(320): a, c, t, g, unknown or other
  misc_feature (320)..(320): n is a, c, g, or t
  modified_base (324)..(324): a, c, t, g, unknown or other
  misc_feature (324)..(324): n is a, c, g, or t
tcagtctacgtagccacgaccggtgctcgatttagtcacgcgagaagggggggggtctcagggaggcagcgctctcaggacgtcaccaccatggcctgggctctgctcctcctcagcctcctcactcagggcacagggtcctgggcccagtctgccctgactcacgcctcctccgcgtccgggtctcctggacagtcagtcaccatctcctgcactcggaacctagttcgggtagtatttaactaaacttatgttcctaccgttacggtaaccagtccagaccacccgaggactaaaccgccccaaagtcatctatttangacnctaccaagtacgccggtccctggaccgggtcctggctcgtcttctcgtcgactacgtaagtcgtacgccgtacgtccggtccctccgtcgtaccgtcttcggcggtcctaccgacgtaccttaggtaaacgtcgtaacggtacgccgtttaaggtaactttccggttcgtacggtcggtaccttagttaacgtacgtaaggtaaccgtaacttaacgttaaccgtaggtttaccgttttacggtacggttaaccgggtaagggttaccggtaaacctacgggtacccttaccggttacgtacgtaccgaacggtacccgacggtaaccccaacctcggtactacctaccgttccgtaccgtcccccggtcttccgg

SEQ ID NO: 259560 - DNA, 737 bp, Homo sapiens
  misc_feature: GYAE6OF02FYI1L.15.66.F11.1.454.CMB.1.raw
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
  modified_base (301)..(301): a, c, t, g, unknown or other
  misc_feature (301)..(301): n is a, c, g, or t
tcagtctacgtagccacgaccggtgctcgatttagtcacgcgagaagggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtccaccatctcctgcactggaaccnttggtntattaataactatgttctcctggtaccagcagccacccaggacaaaccgacccccaaagtcatctatttangagctcactaacggccggccctcgacggggtccctgctcgcttctcgtggcctcagtctcggccgacgtccggcctcccgtcgtacccgtctccgtcgggccctccgacgtcccgtaggaacgtcgtacggtagtcgttagttaactttacgtttcgtcgggtccggttcttacgtaagttacgtcgggaaacgtaaccgttaacgttaccgtacgtttccgttttttacggttaccggtttacggggtaaacgggttaccggggtaaacccggtaaacgggtttacccgtaacccggtttacccgtaaccggtacccggaaacccgggtaaccccggtaacccggaaccccccgtaaacccccgttacggttacccggttacccttacccgttccccgtttaccccgtttacccccccggtacccctttccccgg

SEQ ID NO: 259561 - DNA, 629 bp, Homo sapiens
  misc_feature: GYAE6OF02IQZSD.15.66.F11.1.454.CMB.1.raw
  modified_base (227)..(227): a, c, t, g, unknown or other
  misc_feature (227)..(227): n is a, c, g, or t
tcagtctacgtagccacgaccggtgctcgatttagtcacgcgagaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggngtattataactatgtctcctggtaccagcagccacccaggacaaacgccccaaagtccatcatttatgagctcactaagccggccctacgacgggtccctgatcgtcttctctgctcaagtctggccgactcggcctcctgtaccgtctcgtggcctaccgagtcctggaacgataggacggtactggtactttatttcgtagtccggtctacattagtcggaacgaactaattacgagtttcgttttaggttactttacgggaaggttcgggaacccgtaaacgggtccgtaaccggttcccgtaaacgttccgaacgtaccccgaaacgggtacccctaaacccccgtacgttaccggtaacttcccttaccgtcccgttacccccgtaacccttccccg

SEQ ID NO: 259562 - DNA, 731 bp, Homo sapiens
  misc_feature: GYAE6OF02I646U.15.66.F11.1.454.CMB.1.raw
  modified_base (496)..(496): a, c, t, g, unknown or other
  misc_feature (496)..(496): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctccctggacagtcagtccaccatcctcctgccactacggaacctagttcggtagtaatttaacgtaaaccttagttcggtccttacccgttcgggttaacccaaggtccacgaccgaccccgacggacctaaaccgaccccccgaaaagtccacttacctattttaatcgaacgtctactacgtaaaggcccggtacccctcggtaccggggtcccctaggactcctcgttactcgtcgcctaccagtccgtacggaccgtaccgtccgtccctcgccgaccgtcctcgtcggcctccgagccctaggacgngtaggacgtacttcgtatttacgttcgtcggacgttcgtactaagtacgtaggacctaaagtaactttcgagtttccgtttaggtcgtttaacgggaacggttaccgggtaaaccctaaacggttcccgtaccggttaccctaaggtaccgaaccggtaacccgaaccgaaccccctaacccgtagtccgtaccttacccgttcccgtcccggttaccccccgtcccttacccgg

SEQ ID NO: 259563 - DNA, 637 bp, Homo sapiens
  misc_feature: GYAE6OF02GRYLZ.15.66.F11.1.454.CMB.1.raw
  modified_base (227)..(227): a, c, t, g, unknown or other
  misc_feature (227)..(227): n is a, c, g, or t
  modified_base (291)..(291): a, c, t, g, unknown or other
  misc_feature (291)..(291): n is a, c, g, or t
  modified_base (322)..(322): a, c, t, g, unknown or other
  misc_feature (322)..(322): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtnattataactatgtctcctggtaccagcagcacccaggcaaacgcccccaaagtcatctatttangagctcactaagccggcctcgacgggtcccngactcgcttctcgtcgctaccgaagtctggccacgtccggcccttccgtcgtacccgtctcgtcgggcctccgacgtcctaggaacgagtcggaggtccgtagtaatttagtttcgtcggtccggtcttacgtattagtggaactacgtaaattacgacgttcttttggtccgttacgggtaacgtcgggaaccgtaacggtcctaacccgttaccgtaagtccgtaaccggtacccgaaccggtaccccctaaaccccgtaccgttacgtaccctaccgttacccgttaccgttaccccccgaccctttccccg

SEQ ID NO: 259564 - DNA, 619 bp, Homo sapiens
  misc_feature: GYAE6OF02JZHLG.15.66.F11.1.454.CMB.1.raw
  modified_base (246)..(246): a, c, t, g, unknown or other
  misc_feature (246)..(246): n is a, c, g, or t
  modified_base (308)..(308): a, c, t, g, unknown or other
  misc_feature (308)..(308): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
  modified_base (448)..(448): a, c, t, g, unknown or other
  misc_feature (448)..(448): n is a, c, g, or t
  modified_base (477)..(477): a, c, t, g, unknown or other
  misc_feature (477)..(477): n is a, c, g, or t
  modified_base (606)..(606): a, c, t, g, unknown or other
  misc_feature (606)..(606): n is a, c, g, or t
tcagtctacgtagccacgaccggtgctcgatttagtcacgcgagaagggggggtcgtcaggaggcagcgctctcaggacgtcaccaccatggcctgggctctgctcctcctcagcctcctcactcgagggcacagggtcctgggcccagtctcgccctgactcagcctccctccgcgttccgggtctcctgggacagtccacgtcaccatctcctagcactcggaacctattggtcgattacaatntcgtctcgtggtaccagctagccaccgagactaacgacccaacgcaatctagttataaggcnctactactaacgccgtcctcgtacgggtcctgacgtccgtcttctacgtcgtctaccgaagtcgtcgcgtacgtccgcctaccgtcgacctcgtcgtcggacctccgacgctacgaanacgngtcgntntactttctcgngtcgctacgatacgtgactaactatacgngttccgtttgtccgtacgggtactacgggaacctacggtaccgtcgttactaaccgttacgacggttaacccgacgtacccctaacccgtacgtacccggttacaccggtttcccgtaccggttccccnccccgttaccccg

SEQ ID NO: 259565 - DNA, 712 bp, Homo sapiens
  misc_feature: GYAE6OF02GWENF.15.66.F11.1.454.CMB.1.raw
  modified_base (290)..(290): a, c, t, g, unknown or other
  misc_feature (290)..(290): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
  modified_base (419)..(419): a, c, t, g, unknown or other
  misc_feature (419)..(419): n is a, c, g, or t
tcagtctacgtagccacgaccggtgctcgatttagtcacgcgagaagggggggggtctcaggaggcagcgctctcaggacgtcaccaccatggcctgggctctgctcctcctcagcctcctcactcagggcacagggtcctgggcccagtctgccctgactcagcctccctcgcgtccgggtctcctggacagtcagtcaccatctcctgcactggaacctattggtcattaataactatgtctcctggtaccagcagcaccaggacaaacgccccaaagtcatcattangagctacactaagcgccctcgacggggtccctgactcgtcttctctcggactccaagtctcggctactccggcctcctcgccgtctcgtcggcctcgacnccgtagaagtntaggaggtctgtaatttnttacgtcggtcggtcttacgaattacgagggtaacgtaaactaaacgtttaacgaacggttttcgttttacggttaccggtttaacggggtaaacgggtttaacggggaaacccgttaaacgggtacccggtaaaccccggtttaccgttaaaacgggttcccaaaccgggtaacccccgttaaaacccggggaaccccctaaaaccccccgtagtttaacccgggttaacccctttaaccgttacccggtttaacccccggttttacccccccgtacccgtttaccccccgg

SEQ ID NO: 259566 - DNA, 766 bp, Homo sapiens
  misc_feature: GYAE6OF02HENHC.15.66.F11.1.454.CMB.1.raw
  modified_base (225)..(225): a, c, t, g, unknown or other
  misc_feature (225)..(225): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctcctccgcgtccgggtctcctggacagtcagtcaccatctcctgcactggaaccattggnattataactatgtctctggtaccagcagcaccgaggcaaacgcccccaaagtcatctatttatgagctcactaacgcgccctcgacgggtccctgactcgcttcgtctcggctccgaagtcgtggcgactcggcctaccgtcgaccgtctcgtcggctccgacgtcctaggtaacgagttcggaacggtccgtaggtaacttttaacgtttccgtcgggtaccgggttcttacccgtaaagtttaccggttacggggtaaacctaaccgttaaaacgtttaacccgtaacggttttacccgtttttaccggtttacccgggtttaacggggtaaaccgggttttacccgggggaaaaccccgttaaacggggtttacccgtaaccccgggtttaaccctttaaacgggttaccccaaccggggtaaacccccgttaaaccggggaaccccccgttaaaccccccgtaccgtttaaccggttaacccttaacccgtttccccggtttaaccggtttccccccctaaccccgtttacccccgg

SEQ ID NO: 259567 - DNA, 653 bp, Homo sapiens
  misc_feature: GYAE6OF02IHM09.15.66.F11.1.454.CMB.1.raw
  modified_base (233)..(233): a, c, t, g, unknown or other
  misc_feature (233)..(233): n is a, c, g, or t
  modified_base (481)..(481): a, c, t, g, unknown or other
  misc_feature (481)..(481): n is a, c, g, or t
tcagtctacgtagccacgaccggtgctcgatttagtcacgcgagaagggggggggtctcaggaggcagcgctctcaggacgtcaccaccatggcctgggctctgctcctcctcagcctcctcactcgagggcacagggtcctgggcccagtctgccctgactcagcctccctccgcgttccgggtctcctggacagtcagtcaccatctcctgcacgtggaacctagttggtntaattaataactagtgttcctacgtggtaaccagcagcacccaggcaaacgacccccaaagtcatactatttatgagtacgtacaacgtaagcccggtcctcgacgggtccctgacgtctcttcctcgtcgtcctctaagtcgtcggacgtctaccggcctcccgtcgacgtctcgtcgggcctccgacgctagagtgtacggacgcgtgtatttacttcgtgtcgtactctaattagtagacgtaanaacgttacgacgttctttaggttaccgttagggtaacggttacgggtaaacgaccggttaccgtaaccgttaccgtaacgttccgaaccgtacccggaaccggtaacccctaaccccgtacgtacggttacctacccgttccctttaccgtcccccttaacccttaccccgg

SEQ ID NO: 259568 - DNA, 825 bp, Homo sapiens
  misc_feature: GYAE6OF02JCJZS.15.66.F11.1.454.CMB.1.raw
  modified_base (342)..(342): a, c, t, g, unknown or other
  misc_feature (342)..(342): n is a, c, g, or t
tcagtctacgtagccacgaccggtgctcgatttagtcacgcgagaagggggggggtctcaggaggcagcgctctcaggacgtcaccaccatggcctgggctctgctcctcctcagcctcctcactcagggcacagggtcctgggcccagtctgccctgactcagccctcctccgcgtccggtctccgtggactgtcacgtccaacctatcctccgtgacctacgtacggaaaccttgttgggtataacttaacttaactacgttcgttcccgttaccgttacgggtaaccagaccgtacgacccaccgagaccaaacccgtaccccaagtctatctaatttnacgactcctactaacgtaacgcccggtccctagggaccgggtcctagactccgtcttctacgtcgtcctacgtacgtcgacggccgtaccgtcccggtccctccggtacgtacccgttcgtccgggtacggtccctacggacgtccgtaaggtaacgtgtacgggtacgtacgtttagttaacgtttacgtttccggccggtaccgttacgtttaactagttacgggtacgggtaactaaaccgttaacgttaccgtacggttttccgtttacggttaccggttaacggggaacgggttacccgggtaaaccgttaccgggttaacccgttacccggtttaaccggtaacgttaccccggtaacccggtaacccccggaaaccgggtaacccccccttaacccgttaggtttaccccggtaacccgttaccccggtttacccggttttcccccggttacccccccgttccccgttaacccggg

SEQ ID NO: 259569 - DNA, 559 bp, Homo sapiens
  misc_feature: GYAE6OF02GARBZ.15.66.F11.1.454.CMB.1.raw
  modified_base (227)..(227): a, c, t, g, unknown or other
  misc_feature (227)..(227): n is a, c, g, or t
  modified_base (288)..(288): a, c, t, g, unknown or other
  misc_feature (288)..(288): n is a, c, g, or t
  modified_base (397)..(397): a, c, t, g, unknown or other
  misc_feature (397)..(397): n is a, c, g, or t
  modified_base (522)..(522): a, c, t, g, unknown or other
  misc_feature (522)..(522): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtnattataactatgtctctggtaccagcagcacccaggcaaagcccccaaagtcatcatttangagctcaactaagccggccctcgacgggtccctgatcgcttctctggctccagtctggcgactcggcctcctgtacccgtctcgtcgggcctccgagcctagaacgtanggagctgtatttattcgtgcggtctacatagtggataactaattacagtctttcgtcgttcggaagttcgggaacctaagtccaccgttacgtaagtccgacgacccgaacggcccctaacccgngtacgtctaccgttcctccgttaccccacccttcccg

SEQ ID NO: 259570 - DNA, 711 bp, Homo sapiens
  misc_feature: GYAE6OF02JMLD6.15.66.F11.1.454.CMB.1.raw
  modified_base (193)..(193): a, c, t, g, unknown or other
  misc_feature (193)..(193): n is a, c, g, or t
  modified_base (237)..(237): a, c, t, g, unknown or other
  misc_feature (237)..(237): n is a, c, g, or t
  modified_base (250)..(250): a, c, t, g, unknown or other
  misc_feature (250)..(250): n is a, c, g, or t
  modified_base (521)..(521): a, c, t, g, unknown or other
  misc_feature (521)..(521): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctcgccctgactcagcctccctccgcgtccgggtctcctggacngtcagtccaccatcctcctgaccactcgggaacctagtttgggnactttaataactnttgtcctccgtggtaccagcagccaccgacggccaaaaccgcccccaaaagtcactactaatttatagacgtacctacaacgttaaacgcccggtaccctaccggtaccggggttccctacggtacttccgtcctttactcgtacggtcctaccgtaagtccgttcggcgtaccgtccggtaccctccgtacggtacccgttcgtcgtccggggtcctacccgtagacccgtagtaagcgtcgggaacggtcgtgttaactttagtttccncggtccggtactacgtattacgaggtacgataactacgtagttcgtttacgttcgtcggtaacggtacgggtaaccgtaacggtcccgtaccggttaccgtacgtaccggtaaccgtaacccgaaccggtaacccaacccgtagttaccgccttaaccgttcccgtacccttccccgtaaccccttccgg

SEQ ID NO: 259571 - DNA, 568 bp, Homo sapiens
  misc_feature: GYAE6OF02HSM5D.15.66.F11.1.454.CMB.1.raw
  modified_base (221)..(221): a, c, t, g, unknown or other
  misc_feature (221)..(221): n is a, c, g, or t
  modified_base (226)..(226): a, c, t, g, unknown or other
  misc_feature (226)..(226): n is a, c, g, or t
  modified_base (290)..(290): a, c, t, g, unknown or other
  misc_feature (290)..(290): n is a, c, g, or t
  modified_base (399)..(399): a, c, t, g, unknown or other
  misc_feature (399)..(399): n is a, c, g, or t
  modified_base (413)..(413): a, c, t, g, unknown or other
  misc_feature (413)..(413): n is a, c, g, or t
  modified_base (421)..(421): a, c, t, g, unknown or other
  misc_feature (421)..(421): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccnttggnattataactatgtctcctggtaccagcagccaccaggacaaacgcccccaaagtcatcatttangagctcaactaacggccggccctcgacgggtccctggactcgtcttctcgtcgctccagtctggccgactccggcctcctcgcctctcgtggctccgacgcctagaagngtgaggctgtattntttcgcgngtctcatagtgacactaatctagtctttgtacgttcggaagtcggaactaagggtccaaccgttccgtaagcccgaacggaccccaagggtccccaacccgtacgtacgttaccgaccttccgtacccgttaccccgccccttccgg

SEQ ID NO: 259572 - DNA, 701 bp, Homo sapiens
  misc_feature: GYAE6OF02G9SOZ.15.66.F11.1.454.CMB.1.raw
  modified_base (308)..(308): a, c, t, g, unknown or other
  misc_feature (308)..(308): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctccgtggacagtcagtcaccatcctcctgctactggaacctagttcggtgtaattaactaaactatcgtcctccgtggtaccagcacgccaccgaggacaaaccgccccaaaagtcatctattangatctacaaagtaacgccggccctacggtacggggtccctagactccgtctttcgtcgtcggtcctaccgtagtcgtcggtaccgtacgtccgtccctccctacgtacccgttccgtcggtccgggccttacccgacggtcccgtagaaacggtacgtacgggaacgggttcttaagttaactttacgttttccgacggtccggttacttacgtaacgtagtacggtaaactaacgtaacttacgtacgttcgtttacgggttactacgggtaacgttcgggaacctaacgggtcctaacccgttacgtacgtaccgaccgtaacccggaaccgtacccctaacccgtcgttcgtaccctaccttccgttcccgttaccccgccccttaccgg

SEQ ID NO: 259573 - DNA, 642 bp, Homo sapiens
  misc_feature: GYAE6OF02H9TIB.15.66.F11.1.454.CMB.1.raw
  modified_base (328)..(328): a, c, t, g, unknown or other
  misc_feature (328)..(328): n is a, c, g, or t
  modified_base (366)..(366): a, c, t, g, unknown or other
  misc_feature (366)..(366): n is a, c, g, or t
  modified_base (613)..(613): a, c, t, g, unknown or other
  misc_feature (613)..(613): n is a, c, g, or t
tcagtctacgtagccacgaccggtgctcgatttagtcacgcgagaagggggggggtctcaggaggcagcgctctcaggacgtcaccaccatggcctgggctctgctcctcctcagcctcctcactcagggcacgacgggtcctgggcccaggtcctcgccctgactcacgcctccctccgcgtccgggtctccgtggacagtcacgtccaccactcctcctcgccactacggaacctagttgggtagtatttaactaactatcgttctacgttcggtaccacgcacgaccaccgagaccaaacgaccccaaagtcatctaatttacgngactctacacgtacgcgccgtcgcgggtacctgtaccncgttcttctcgtcgactaccgaacgtcgtcggacgtaccgtccggccttaccggtcgaccgttcgtcggcgtctccgacgtcgtagagtacgtcggacgtcttagtactttacgtcgtcgcttcgtatagtacgtagaacaacgtacgttacgtcttcgttcgttacgtacggttacggtcggaacgtacgtaccgtaccgtacgtaacgccgaaccgaccgtaacgacccctaacctggccttacnccgttccctaccgttcccctaccgtaccg

SEQ ID NO: 259574 - DNA, 821 bp, Homo sapiens
  misc_feature: GYAE6OF02F41NT.15.66.F11.1.454.CMB.1.raw
tcagtctacgtagccacgaccggtgctcgatttagtcacgcgagaaggggggggtctcagggaggcagcgctctcaggacgtcaccaccatggcctgggctctgctcctcctcagcctcctcactcagggcacaggggtcctgggcccagtctgccctgactcagcctccctccgcgtccgggtctcctggacagtcagtccaccatcctcctgcctacgtcggaaaccctagtttgggtactaatttaactaaaccttattcgttccttcccgtagggtaacccagtaccaacgcccaaccccgaaggaccaaaaccggaccccccaaaaggtccaatctaactttacagtacgcttacaactaacggccggccctacgacggggtccctaggacttccggtctttactcgtcggccttaccgaagtcgttcggggaccaccggtcccggtcccttcccctacggtacccgttcgtaccggtccggggcccttaccgacggtacccgtaagggaacgtacgtacgggtaaggtcgttaacgttaacgttttacgtttccgtacggttccggttaccgtttacgtaaacgttaacggttacgggaaacgttaacgtaaacgtttaccggtagtttaccgttttacggtttaccggtttacgggtaacgggttaaccgggtaaccggtaaccgggtaccttaacccggttaccgtaacggttaccgaaaccggtacccgtaaaccggacccctaaccccgtacgttaccgttaccctaacccgttcccgttaacccgtttcccccgtaaccccttaccccgg

SEQ ID NO: 259575 - DNA, 773 bp, Homo sapiens
  misc_feature: GYAE6OF02GKG0Q.15.66.F11.1.454.CMB.1.raw
  modified_base (318)..(318): a, c, t, g, unknown or other
  misc_feature (318)..(318): n is a, c, g, or t
  modified_base (324)..(324): a, c, t, g, unknown or other
  misc_feature (324)..(324): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacgagggtcctgggcccagtctgccctgactcagccctccctccgcgtccgggtctcctggacagtcagtccaccatctcctgacctactacggaaacctgttggtataattaactaacttatcgttcctccgtaggtaccagcacgccacccgaggaccaaaccgaccccaaagtcatactatttanacgtancctacacgtaacgccggtccctcggaccgggtccctagaccttccgtcttccgtcgtcgacctccgtaacgtcgcggtcgaccgtccggtaccctccgtacgtacccgttctccgtacggtccctaccgcgtacccgtaggaaactggtacggtacgtcgttagttacgtttaacgtttccgtcggtaccggtcttaaccgtagttaacggtagggtaaacctaagtaaacgtttaacccgtagtttacccgttttccgttaaccgggttacgggtaacgggtaacccggggtaaccttaacgggttacccgtaacccgtttaaccgtacggtaacccggtaacccggaaccccggtaaccggtaacccccgtaaacccttccgttaccgttaaccccgaacccgttttcccgttaacccccgttaccccccgtacccgttaacccccg

SEQ ID NO: 259576 - DNA, 635 bp, Homo sapiens
  misc_feature: GYAE6OF02I0M1C.15.66.F11.1.454.CMB.1.raw
  modified_base (426)..(426): a, c, t, g, unknown or other
  misc_feature (426)..(426): n is a, c, g, or t
tcagtctacgtagccacgaccggtgctcgatttagtcacgcgagaagggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatcctcctgcactggaaccattggtgattataactatgtctcctggtaccagcagcacccaggaccaaacgcccccaaagtcatcatttatgagctacactaagccggccctcgacgggtccctgactcgcttctctggcctcaagtctggcgactcggcctcctgaccgtctcgtcggcctccgagtcctagaagcgtgaggtcttgtatttacgtttcgnggtccggtctactagttagtggaactaactaaacttacagttcttttcggtaccgtttacgggaacggttacgggaacccttaaagggtccctaacccggttaccgttaacggtaccgtaacggtaaccccgaacgggtacccccaaaccccgttacgttaccggtcctaacccgttccctttcccggtttaccccctaccccttcccg

SEQ ID NO: 259577 - DNA, 667 bp, Homo sapiens
  misc_feature: GYAE6OF02FXCP5.15.66.F11.1.454.CMB.1.raw
  modified_base (220)..(220): a, c, t, g, unknown or other
  misc_feature (220)..(220): n is a, c, g, or t
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
  modified_base (236)..(236): a, c, t, g, unknown or other
  misc_feature (236)..(236): n is a, c, g, or t
  modified_base (248)..(248): a, c, t, g, unknown or other
  misc_feature (248)..(248): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctggcccagtctgccctgactcagcctccctccgcgtccgggtctcctggacagtcagtcaccatctcctgcactggaaccnttggngattanaactntgtctctgtacngcagcaccagacaaacgccccaaagtcactctattatgagctacactagccgcctacgacgggtccctgactcgtcttcgtctcggctcgaagtcgtcggcgtaccgtccggtccctaccgtcgtaccgtcgtcgttcgggtccctaccgacggtcccgtaggaaacgtacgtacggaggtccttagttaactttactttcggtcggtccggtaccttaccgtaacgttaagcggggtaaactaaacgtaacgtttaaccgtagttaccgttttacggttacgttaccgggtaaggtacgggtaaaccgtacgtacccgttaccgtaccgtacgtactaaccggacccgtaacgtacccccaaaccggttcttaccggccttaccgttacccgtttccgttacccccgacttcccccgg

SEQ ID NO: 259578 - DNA, 670 bp, Homo sapiens
  misc_feature: GYAE6OF02HOI7A.15.66.F11.1.454.CMB.1.raw
  modified_base (232)..(232): a, c, t, g, unknown or other
  misc_feature (232)..(232): n is a, c, g, or t
  modified_base (295)..(295): a, c, t, g, unknown or other
  misc_feature (295)..(295): n is a, c, g, or t
tcagtctacgtagccacgaccggtgctcgatttagtcacgcgagaagggggggggtctcaggaggcagcgctctcaggacgtcaccaccatggcctgggctctgctcctcctcagccctcctcactcagggcacagggtcctgggcccagtctgccctgactcagcctccctccgcgtccgggtctcctggacagtcagtccaccatctcctgcacgtggaaccagttggtnattataactatgtctccgtggtaccagcagccacccaggcaaacgccccaaagtcatcattangagctcacgtacgcggccctcgacgggtccctggactcgtccttctcgtcggcctaccgtaacgtcgtcggcctaccgtccggtccctcccgtacgtacccgtcgtccggtcgggtcctcccgacgtccgtaggaacggtatggacggtctacgtaactttgtttaccgtcggtccggtctacgacgttcgtagggactaactaacgttacgtacgttccgtttagttccgttacgggtaacggtccgggaaaccgtaacgggtacccgaccgttacccgtaagtaccgaacccggacccgaaccggacccctaaccccgtacgttacgtacccgtaccttcccgttacccgtttaccccctaccccttccccgg

SEQ ID NO: 259579 - DNA, 698 bp, Homo sapiens
  misc_feature: GYAE6OF02FKOFI.15.66.F11.1.454.CMB.1.raw
  modified_base (227)..(227): a, c, t, g, unknown or other
  misc_feature (227)..(227): n is a, c, g, or t
  modified_base (290)..(290): a, c, t, g, unknown or other
  misc_feature (290)..(290): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtnattataactatgtctcctggtaccagcagcaccaggacaaacgccccaaagtcactcatttangagctacactaagcgcctcgacgggtcctagatccgtcttcgtctcggactcaagtcgtcgcgacgtccgcctccgtcgaccgttctcgtcggctccgacgtccgtagagtacgtcggaggtctagttactttaacgtttcgtacggtcgttacttacgtaagttaccgtaggaaacgtaaccgttaaactttaaccgagtttccggttttagtttaccggtttaacggtaacgggttacgggtaacccgtaaacggttacccgtaacccgtttacccgtaaagttacccggaaccggtaaccccggtaaaacccggggtaccccctaaaacccccgttacgttacccggttaacccttacccgttacccgtttaccccggttacccccttacccccgtttaccccgg

SEQ ID NO: 259580 - DNA, 616 bp, Homo sapiens
  misc_feature: GYAE6OF02FKN76.15.66.F11.1.454.CMB.1.raw
  modified_base (258)..(258): a, c, t, g, unknown or other
  misc_feature (258)..(258): n is a, c, g, or t
  modified_base (337)..(337): a, c, t, g, unknown or other
  misc_feature (337)..(337): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcaggcacagggtcctgggcccagtctgccctgactcagcctccctcgcgtccgggtctcctggacagtcagtcaccatcgtctgcactggaacctagttggtcgattaatactatgtctccgtggtaccagcancacccaggacaaacgtcccccaaagtcatctaatttatgagctcactaagcggcctcgagggtccctgatcgcttactntcggctcaacgtcgtgccgtacgtcccgtcctccctagacccgttctcgcggtctccgacgtcctagacgagtggacgtctggtatttaacttgtcggaccgtctacgttatacgttagggacaaccttaattccaagttcgtttaggttaccgttacgggtaagttaccgggacgtaagggtcctaacccgttcgtaaccggtcgaaccggtcccgaaacggtacccgaaccccgtagtccgtactaccgttcgtcccggttacccgcccgttacccg

SEQ ID NO: 259581 - DNA, 855 bp, Homo sapiens
  misc_feature: GYAE6OF02GYAJZ.15.66.F11.1.454.CMB.1.raw
  modified_base (311)..(311): a, c, t, g, unknown or other
  misc_feature (311)..(311): n is a, c, g, or t
tcagtctacgtagccacgaccggtgctcgatttagtcacgcgagaagggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatctcctgcactggaacctagttggtagtaattaataaactatcgtcctccgtaggtaccagtcgacgccaccgagaccaaaccgacccccaaagtcactctatttntagacgcctacaacgtaacggcccggtaccctacggtaccggggtccctagtacgttccggtcctttccgtccggttcggacccttaccgtaacggttccgtacgggccggtaccgttccccggggtcccttccccggttaccggtacccgtttccgtccgggttccgggtacccttacccgtaccggtccgttaaacgggaacgttacggtcgggtacgtacgtttaagttaacgttttacgtttccggtcgggtaccggttaccttacggttaaacgttcgggttaaccgggtaacgttaaacctttaaacggttaccgtttaaccgggtttccggttttaaccgggtttccggtttaacgggtaacggggttaacccgggtaaacccgttaacggttaccccggtaaccggtttacccgttaacgtacccggaacccggtaacccggtaaacccggtaccccctaaccccggttatacccggttacccttacccggttaccccgtttacccccggtttaccccccgcccgtttaaccccgg

SEQ ID NO: 259582 - DNA, 876 bp, Homo sapiens
  misc_feature: GYAE6OF02FIB9W.15.66.F11.1.454.CMB.1.raw
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctgacagtcagtcaccatctcctgcactcgggaaacctagttgggtagtaatttaataaacttagttcgttccttacccgttgggtaaccccagtccaagccacccgaagggaccaaaacggaccccccctaaaaggtccaactacctaactttttaatacggtaaggccttaccaacttaaacggccggccccttaccgacgggggttcccctggtaacttccggtcctttccgtcgttcgggccttacccgtaaaggttccgttcgggaccggtaaccgtcccgggtccccttccccgtaccgggtaccccgtttccttcccggttacgggggtcccttacccgaccgggtaccccttagggaaacggtacgttacgggtaacgggtccttaggttaacttttacgttttaccgtcgggttccggtccttaccgttaacgttacggttacgggtaacgtaaaccttaaacgtttaaccgacgtttaccgtttttacggtttaccgtttacggggtaaacggttcggggtaaaccgtaacgggttaccccgtaacccggtttacccgttaacggtaccgtaacccggaccccggtaaacccgggaacccccgttaacccccgtaccgttaccgtacccttaacccgttcccggtttaccccggtttcccccgtaccccgtttacccccgg

SEQ ID NO: 259583 - DNA, 673 bp, Homo sapiens
  misc_feature: GYAE6OF02GIYA5.15.66.F11.1.454.CMB.1.raw
  modified_base (465)..(465): a, c, t, g, unknown or other
  misc_feature (465)..(465): n is a, c, g, or t
  modified_base (471)..(471): a, c, t, g, unknown or other
  misc_feature (471)..(471): n is a, c, g, or t
  modified_base (487)..(487): a, c, t, g, unknown or other
  misc_feature (487)..(487): n is a, c, g, or t
tcagtctacgtagccacgaccggtgctcgatttagtcacgcgagaagggggggggtctcaggaggcagcgctctcaggacgtcaccaccatggcctgggctctgctcctcctcagcctcctcactcagggcacagggtcctgggcccagtctgccctgactcagcctccctccgcgtccgggtcctcctggacagtcagtcaccatctcctgcactcgggaacctagttcggtagtatttaactaaccttatcgttcctccgttggtaaccagctacgccaacccgaggaccaaaaccgacccccaaaagtcactactatttactgagtcctacaacgtaacgccggccctacgacgggtcctgtacgtccgtcttctcgtcggcctccgtaagtcgtacggtccgtaccgtcccggtccctccgtacgtcccgtcgtccgtcggtcctccgacgtccgtagagngtaggngtctgtacttattcgngcggtctcgtagtcgtaggaactacgttactacgacgtttcgttaggttaccgttacggaggttacggaaacgtacgtacccgtaccgttacgtagtaccggaaccggacccgaaacccgtaccccaacccgttacgtaccgttcctaacccgttcgttaccccgttacccctaccgttaccccgg

SEQ ID NO: 259584 - DNA, 814 bp, Homo sapiens
  misc_feature: GYAE6OF02GX5JD.15.66.F11.1.454.CMB.1.raw
  modified_base (328)..(328): a, c, t, g, unknown or other
  misc_feature (328)..(328): n is a, c, g, or t
tcagtctacgtagccacgaccggtgctcgatttagtcacgcgagaagggggggggtctcaggaggcagcgctctcaggacgtcaccaccatggcctgggctctgctcctcctcagcctcctcactcgagggcacgagggtcctcgggcccagtctcgccctgactcacgccctccctccgcggtccgggtctccgtggacagtcagtccaccatcctcctgcacgtacggaacctagttcggtatattaatactattcgtctcgtcggtaccgacgtcacgccaccgaggaaccgaaaccgacccccaaagtccaagtactattacgngacgtcctaccgtaacgtaacggcccggtcccgtacgggtaccgggttcccctacggtactccggtacctttccgtcgtaccggtcctaccgtaacggtccgtacggtaccgtaccgtccggaccctccgtaccgtacccgtctccgggtcgggtccctacgtacggtcgtacggtaacgtacgtaggacggtacgttacgttactttacggtttcggacggtaccggttactacgttacgttaacggtacggtaaacgtaacgttaacgttacggtacgttttcgggttttaccgtaaccggggtttaccggaacggggttaacggtaaacccggttaaccggttcccgttaaccgggttaccgttaacggtaacccggtacccggtaaacccggtacccggtaaccccgtaacccgtacccgttacgttaacccgtacccgtttaccccgtttaccccgtttaccccctacccggttaccccgg

SEQ ID NO: 259585 - DNA, 851 bp, Homo sapiens
  misc_feature: GYAE6OF02GMXYZ.15.66.F11.1.454.CMB.1.raw
tcagtctacgtagccacgaccggtgctcgatttagtcacgcgagaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctctgcactggaaccattggtgattataactatgtctcctggtaccagcagcaccagacaaacgaccccaaagtcatctatttatgagtctcacgtaacgccggtccctcgacggggtccctagtactccgtcttccgtacgtcggcccttaccgaagtccgtgggaccgtaccgtcccggcccttcccgtacggtacccgttccgttcggtcgggtccctcccgacggtcccgttaaggaacgtatacgggtacggtccgttaagttacttttaacgttttccggtacggtccgggttacccttaccgtaacgtttacggttaacggggtaagttaaaaccgttaacgttttaaccggtaaacgttttccggtttttttaacccggttccggttttaaacccgggggtaaacgggtttacggggtaaacccccggtttaaaacggggttcccccgttaaaccccgggttttaccgttaaacccgggttaacccgggaaaccccgtaaccccgggttaaaaccccgggtaaaccccccctaaaaccccccggttaccggtttacccggttaaaccccggttacccgttttacccccggttttaccccgtttaacccccccctttaccccggttttaacccccccgg

SEQ ID NO: 259586 - DNA, 701 bp, Homo sapiens
  misc_feature: GYAE6OF02I81SX.15.66.F11.1.454.CMB.1.raw
  modified_base (252)..(252): a, c, t, g, unknown or other
  misc_feature (252)..(252): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccngcagccaccaggcaaacgccccaaagtcatcatttatgagtcctcaactaagccggtcctcgacggggtcctgactcgtcttctcgtcggcctacaagtcgtcggcgtaccgtccggcccttacccgtcgtacccgttcgtccgttcgggccctccgacgtccctaggaacggattgggacggtcttaggtaactttacgtttcgtacggtcggtccttacgtaacgttagtacgggtaacgtaacctaaacgtttaacgtacgttccgtttttcggttaccggtttaccgggaaacggtttccggggaaaaccctaacgggttacccgtaacccgttacccgttaaacggtaccgaacccggtaccccgaaaccgggtaccccctaaccccgtagttcccggtaccctaccgttaccctttacccgttacccccctaccccgttcccg

SEQ ID NO: 259587 - DNA, 738 bp, Homo sapiens
  misc_feature: GYAE6OF02JFLPC.15.66.F11.1.454.CMB.1.raw
  modified_base (233)..(233): a, c, t, g, unknown or other
  misc_feature (233)..(233): n is a, c, g, or t
  modified_base (259)..(259): a, c, t, g, unknown or other
  misc_feature (259)..(259): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctcgggcccagtctcgccctgactcagcctccctccgcgtccgggtctcctggacagtcagtcacctatcctcctgcactggaacctgttcggtnattataactattcgtctccgtgtacngcagcaccgaggaccaaacgccccaagtcactctattatgacgtctacgaactaacggcccgtccgtaccgacgggtccctaggtacttccggtacttttctaccgtcggtacctaccgtaacggttcctacgggccgtaacccgtcccgtcccgtccgttccgtacctcgttccgtcgggtaacctccgtaccggtaccgtacggaacgttacggtaccgtacggttgttaaacgttaacgtttcgttttacccgcggttaccggttacctaccgttaagtttagggaggttaaccaaacgttaaacgttcgttaagtttcgtttaacggtaccgtttaacggggacgtttaaccggaccggttaaacgttcccgtaaccgttaaccgttacggaacctaaccggaccccgtaaacgggaaccccctaacccgtcgtacgtcaaccgtttccgttacccgtaccccttcccgtacccg

SEQ ID NO: 259588 - DNA, 682 bp, Homo sapiens
  misc_feature: GYAE6OF02H2LT1.15.66.F11.1.454.CMB.1.raw
  modified_base (225)..(225): a, c, t, g, unknown or other
  misc_feature (225)..(225): n is a, c, g, or t
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
  modified_base (403)..(403): a, c, t, g, unknown or other
  misc_feature (403)..(403): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctcgccctgactcagcctcctccgcgtccgggtctcctggacagtcagtcacatctcctgcactggaaccattggngtattaataacgtatgtctcctggtacancagcaccagacaaacncccctaaaagcactcatttaatgacgctcaacgtaacgacgccctcgaagggtccctgactcgccttcgtcgtcgggtcctacgtaacgtcgtacggcgacctcgggtccctccctcgggacccttcgttccncggctccacgtcctagaagacggttagcggtcttcgtaagtttactttacgtgccgggttactacctaagttattaaccggggaataaacgtaaactttaaccgtacgttaccgttttggttaccggtttagggaacggttaccgggggaaacgtaaaccgttacccgtaacccggttacctaacggttaaccaacggtacccgtaaaccgggaaccccaacccgtaccgtttacgaccctaccgttaccgtttaccccgtcccgttaccccttacccg

SEQ ID NO: 259589 - DNA, 548 bp, Homo sapiens
  misc_feature: GYAE6OF02FO19Z.15.66.F11.1.454.CMB.1.raw
  modified_base (229)..(229): a, c, t, g, unknown or other
  misc_feature (229)..(229): n is a, c, g, or t
  modified_base (292)..(292): a, c, t, g, unknown or other
  misc_feature (292)..(292): n is a, c, g, or t
  modified_base (337)..(337): a, c, t, g, unknown or other
  misc_feature (337)..(337): n is a, c, g, or t
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
  modified_base (436)..(436): a, c, t, g, unknown or other
  misc_feature (436)..(436): n is a, c, g, or t
  modified_base (517)..(517): a, c, t, g, unknown or other
  misc_feature (517)..(517): n is a, c, g, or t
  modified_base (538)..(538): a, c, t, g, unknown or other
  misc_feature (538)..(538): n is a, c, g, or t
tcagtctacgtagccacgaccggtgctcgatttagtcacgcgagaagggggggggtctcaggaggacagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtnattataactatgtctcctggtaccagcagcacccaggcaaacgcccccaaagtcatcatttangagctcactaagccgccctcgacggggtccctgactcgcttctcnggctccaagtcgtggcgtactcgcctccctgaccgtctcgtgggcctccacgcctagaaacgtatggacggctgtaatttactttcngtcgctnatagngtaacgataactacgagtctttgtcgttcggaagtcggacaggtcaccgtctaacgtcgacaccgaacgaccctaacccgntacgtccactctccgtacccncccttacccg

SEQ ID NO: 259590 - DNA, 692 bp, Homo sapiens
  misc_feature: GYAE6OF02G0KGI.15.66.F11.1.454.CMB.1.raw
  modified_base (305)..(305): a, c, t, g, unknown or other
  misc_feature (305)..(305): n is a, c, g, or t
tcagtctacgtagccacgaccggtgctcgatttagtcacgcgagaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtccaccatctcctgcactggaacctattggtagtattaataacttatgtctcctggtaccagcagccacccaggccaaacgcccccaaagtcatctattatgagtcncaacgtaagccggtccctacgacggggtcctagtactcgtccttctcgtgtcctacctaagtctcggccgtacgtccggtccctccgtacgtacccgttctccgtacgggtccttacccgacgccgtaaggaacgtagtagacggtcttagtaatttacgtttcgtcgggtacggttcttacgaagttacgagggtaactaactaaacgtttacaagtttcctttagggtttaccggttaacgggtacgggttacgggtaaaccgtaaacggtccgtaaccgttaccggtaacgtaccgaaccggtaaccccgaaaccggtacccctaaaccccgttgtaccgtacccttaccttaccgtacccgtttcccccaaccccgttcccgg

SEQ ID NO: 259591 - DNA, 628 bp, Homo sapiens
  misc_feature: GYAE6OF02GZ0H2.15.66.F11.1.454.CMB.1.raw
  modified_base (227)..(227): a, c, t, g, unknown or other
  misc_feature (227)..(227): n is a, c, g, or t
  modified_base (291)..(291): a, c, t, g, unknown or other
  misc_feature (291)..(291): n is a, c, g, or t
tcagtctacgtagccacgaccggtgctcgatttagtcacgcgagaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggnattataactatgtctctggtaccagcagccaccaggacaaagcaaccaaattcatagtatttangaggtacaacgtaactcggtaccctcgtacgggtttcaatcgtcttctctggtcctccgaagtcgtgtaccaacgaccggcctaccctgaacctatctcgtcggctccgagcgagagacgaggtactgtaatttattagtcgactattactactaataactaaacccaaaccgaacacgtacctaaccgttacgtaccgtaacgttgggttaactccggggacggaacgggtacccaagggtcctacggtacccgtaaccgtaacggtccgaaaccgaaccccgtaggtacccttacccggcccccgttaaccggtcctacccgttcgttacccccg

SEQ ID NO: 259592 - DNA, 816 bp, Homo sapiens
  misc_feature: GYAE6OF02J0LHU.15.66.F11.1.454.CMB.1.raw
  modified_base (233)..(233): a, c, t, g, unknown or other
  misc_feature (233)..(233): n is a, c, g, or t
tcagtctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagccctcctccgcgtccggtctccgtggacagtcagtccaccatcctcctgccacgtggaaacctgttgggtnaactttaactaaacttgtcgtccttccgtaggtaccagtccagccacccgaggcaaaccgcccccaaagtccattacctaatttatcgacgcctacaacgtaacgcccggtaccctcggaaccgggttcccctagtacgtccgtccgtttctcgtcggtccgtaccgtaacggtccgttacgggcccgaaccgtccggtaccccgtacccgttaccggtaaccccgttccgttccgggttaccgggcccttacccgtaacgggtcccgtacgggtaaaacgtcggttacgggacggtaccgttaggttaacttttaccgtttccggcggtacccggttactaccgttagttaacggtacgggtaaactaaaccgttaacggttaccgtacgtttaccgttttacgggttaccggtttaaccggggtaacggttaccgggtaaacccgtaacgggttaacccgttacccggtaccttaacggtacccggtaacccgacccggtaaccggaacccctaaccccggtacgttaccgttacccgaaccgtttccccgtaccggtttacccccgtcccgttaaccccg

SEQ ID NO: 259593 - DNA, 648 bp, Homo sapiens
  misc_feature: GYAE6OF02HYSVG.15.66.F11.1.454.CMB.1.raw
  modified_base (233)..(233): a, c, t, g, unknown or other
  misc_feature (233)..(233): n is a, c, g, or t
  modified_base (257)..(257): a, c, t, g, unknown or other
  misc_feature (257)..(257): n is a, c, g, or t
  modified_base (294)..(294): a, c, t, g, unknown or other
  misc_feature (294)..(294): n is a, c, g, or t
  modified_base (363)..(363): a, c, t, g, unknown or other
  misc_feature (363)..(363): n is a, c, g, or t
tcagtctacgtagccacgaccggtgctcgatttagtcacgcgagaagggggggggtctcaggaggtcagcgctctcaggacgtcaccaccatggcctgggctctgctcctcctcagcctcctcactcagggcacagggtcctgggcccagtctgccctgactcagccctccctccgcgtccgggtctccgtggacagtcagtcaccatctcctgcactggaacctattggtanattataactatgtctctggtaccngcagcaccaggacaaacgccccaaagtcatctattangacgctacacgtaacgccggtccctcgacggggtccctgtacgtcgcttctcgtcggtctaccgagtcngggccgacgtccggtcctcccgtcgtcccgtcgtcgtcggtcctccgacgtaccgtggaacgtagtcgggtacggtcttggttaactttcgttccgtacggtcggtactactagttagtacggacgtaacgtaagttacgacggttcttttacggtgttacgggaagttacgggaaacgtaccggtcgaacccgttacgtacgtaccgaaccgaccgtaaccggacccctaacccgacgttcgtaacctccgttaccgttcccggtttacccccgcccttaccgg

SEQ ID NO: 259594 - DNA, 665 bp, Homo sapiens
  misc_feature: GYAE6OF02IXO3Z.15.66.F11.1.454.CMB.1.raw
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
  modified_base (513)..(513): a, c, t, g, unknown or other
  misc_feature (513)..(513): n is a, c, g, or t
tcagtctacgtagccacgaccggtgctcgatttagtcacgcgagaagggggggggtcgtcaggaggcagcgctctcaggacgtcaccaccatggcctgggctctgctcctcctcacgcctcctcactcgagggcacagggtcctgggcccagtctcgccctgactcagcctccctccgcgtccggtctcctggacagtcagtccacatctcctgcactggaactnttggtnattactaactntcgtactcgtaggtaccagcacgccaccgacggaccaaaaccgaccccctaaaagtacactaccgtatttatacgacgtcctacaacgtaacggcccggtccctacggtacgggtccctgactcgtccttcgtctcggactaccgtaagtcgtacggccgtaccgtccgtccctccgtcgtaccgttcgtccggtcggtcctccgacgtcgtacgtaagactggcggtactacgtaatttccttcgtgtccgtctatacgttagacggtanaacttaacttagtcgttgtttcgttaacgtacgggtaaggtacggaccttaacgggtacctaccgtacttacgtaccgtaaccgaccggtaacgtacccctaaccgtactacggtacctaccgtttccctacccgttaccctacccgtcccg

SEQ ID NO: 259595 - DNA, 667 bp, Homo sapiens
  misc_feature: GYAE6OF02IX5NN.15.66.F11.1.454.CMB.1.raw
  modified_base (227)..(227): a, c, t, g, unknown or other
  misc_feature (227)..(227): n is a, c, g, or t
  modified_base (295)..(295): a, c, t, g, unknown or other
  misc_feature (295)..(295): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtnattataactatcgtctcctggtaccagcagccacccaggacaaacgccccaaagtcatctattatganctacaactacgccggccctacgacgggtccctagctcgtcttctcgtcggtctaccgaagtctcggcgtaccgtccggtccctcccgtcgtacccgttctcggtcgggccttccgacgtcccgtaggaacgtagtacgggacggtacgtggttaactttacgttttccgtgggtccggtaccttacgaagttacggtagggaaacgtaacctttaaagtaccgtacgttccgtttttacggtccggtttaacgggaagggttccgggaaacctacgggttaccctacccgtacttaacggtccgaaccgaacccgaacgaaccccaaccctacgtactcctaccttcccgtaccgtttcccctaccctcccg

SEQ ID NO: 259596 - DNA, 681 bp, Homo sapiens
  misc_feature: GYAE6OF02G3DAQ.15.66.F11.1.454.CMB.1.raw
  modified_base (218)..(218): a, c, t, g, unknown or other
  misc_feature (218)..(218): n is a, c, g, or t
  modified_base (224)..(224): a, c, t, g, unknown or other
  misc_feature (224)..(224): n is a, c, g, or t
  modified_base (235)..(235): a, c, t, g, unknown or other
  misc_feature (235)..(235): n is a, c, g, or t
  modified_base (300)..(300): a, c, t, g, unknown or other
  misc_feature (300)..(300): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcaggcacagggtcctgggcccagtctgccctgactcagccctcctcgcgtccggtctcctggacagtcagtcaccatctctgcacgtggaaccnttcggntattataactntgtactcctggtaccagtcagccaccacggacaaacgtacccccaaagtcactactacgttttanagtacgctcaacgtaacgccggccctacggtacggggtccctgactccggtcttcgtcgtcggtctacctaacggtctcgggaccggtacgtccggtcctcccgtacgtacccgtccgttcgtcgggtcctccgacgtccgtagacgtagtggacggtcctggttaactttactttcgtacggtcggtaccttcgtaacgttagggtagtaacggtaactaacttacgtacggttctttacgttacgttagggtaacggtcggtaaacgtaacgttacgacccgttacgtacgtacggtacccgaaccgtaaccggacccctaacccggtacgtaccgtaccgtaccgttcccttcccggttaccccctcccggttacccc

SEQ ID NO: 259597 - DNA, 844 bp, Homo sapiens
  misc_feature: GYAE6OF02G19V8.15.66.F11.1.454.CMB.1.raw
tcagtctacgtagccacgaccggtgctcgatttagtcacgcgagaagggggggggtctcagggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaacctattggtgaattaataactatgtctcctggtaccagcagcaacccaggacaaacgacccccaaaagtcaactactaactttaatgaacgtctacctaacgtaaacgccggtacccctacgtaacgggggttcccctaggtaccttcggtacctttccgttacgtcgggtacccttaccgaaacggttccgttacggggacccgtaaccgttcccgggtaccccttaccccgtacggtaccccgtttccgtaccgttacggggtcccttacccgaacgtcccgttaggaaagtacgtagggacgggtccttaggtaacgtttactttaccggtacggtaccgggtaccttactaaacggtttaacgttaggggtaaacgtaaacttaaacgtttaaccgtacggtttaccgttttacggtttaccggtttaccggggtaaaggttaccgggggtaaaccctaaaccggggttccgtaaaccccggtttacccggttaaaccggtaccgtaaaccgggtaacccccggaaaccgggtaacccccgaaaacccccgttacgttaaccgtttacccaacccgtttacccgtttacccggtttaccccccgtcccccgttaaccccg

SEQ ID NO: 259598 - DNA, 736 bp, Homo sapiens
  misc_feature: GYAE6OF02JMJX1.15.66.F11.1.454.CMB.1.raw
  modified_base (202)..(202): a, c, t, g, unknown or other
  misc_feature (202)..(202): n is a, c, g, or t
  modified_base (223)..(223): a, c, t, g, unknown or other
  misc_feature (223)..(223): n is a, c, g, or t
  modified_base (421)..(421): a, c, t, g, unknown or other
  misc_feature (421)..(421): n is a, c, g, or t
tcagtctacgtagccacgaccggtgctcgatttagtcacgcgagaagggggggtcgtcaggaggcagcgctctcaggacgtcaccaccatggcctgggctctgctcctcctcagcctcctcactcaggcacagggtcctgggcccagtctgccctgactcagcctccctccgcgtccgggtctcctggacagtcagtcaccntctcctgcactcggaaacctntttgggcgtatttaataacctattcgttcctccgttaggtaaccagcacgcacccaggcaaacgccccaaagtcatacatttatgagactcaacgtaacgcgtccctacgacgggtccctagacttcgcttctccgtggcctaccagttcgtggacgctccggccctccgtcggtacccgtttcctcggtcggtaccncccgttagccgtacggaaacgtcgtacgggacggtacttagtaacgtttactttccgtcggtaccgggttaccttcgtaattacggtacggtaagtaaaccgtaagttttaccgaaagtttccgttttcgggttacctttaaccggggtaacggtttcgggtaaacccgttaagggtacccgttaaacccggtttaccgtttaaacggacccggttaaccggaaccccgttaaacggggtaccccctaaaccccgttaacgtacccggttaaccttacccgttactacccccggtttaccctaccccgtccccgg

SEQ ID NO: 259599 - DNA, 691 bp, Homo sapiens
  misc_feature: GYAE6OF02IWH22.15.66.F11.1.454.CMB.1.raw
  modified_base (248)..(248): a, c, t, g, unknown or other
  misc_feature (248)..(248): n is a, c, g, or t
  modified_base (335)..(335): a, c, t, g, unknown or other
  misc_feature (335)..(335): n is a, c, g, or t
  modified_base (392)..(392): a, c, t, g, unknown or other
  misc_feature (392)..(392): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtcctgccctgactcacgccctccctccgccggttccgggtctcccgtggacagtcagttccacctatcctacctgccacttagggaacctagtttgggtntactttaataaccgtattcggtcctacctacggtaccagcacgccaacccgaggacaaaccgacccccaaagtcaactctagtttancgatacctccaacgtacggccggtaccctacggtacggtccctggactcgtacttcnccggtgtaccctcgtactacgtcgggacttaccgtcccggccccttcgccgttaccgtccgtcggtcgcccgtaccgcgtcctaggtaacgtgtcgggtaagcgttaatttacgtttacgtttcgtacggtcgttcgtaaccgttagttagtacgggtaactaccgttaatagtacgttcgtttgtacggtagtaacgggtccggaactaccgtacgtaccgttacgtaccgccaaccggacccaacgacccttaccgtacctcgtccttaccgtaccgttccctccctacgttccccg

SEQ ID NO: 259600 - DNA, 783 bp, Homo sapiens
  misc_feature: GYAE6OF02JXAAA.15.66.F11.1.454.CMB.1.raw
  modified_base (203)..(203): a, c, t, g, unknown or other
  misc_feature (203)..(203): n is a, c, g, or t
  modified_base (748)..(748): a, c, t, g, unknown or other
  misc_feature (748)..(748): n is a, c, g, or t
tcagtctacgtagccacgaccggtgctcgatttagtcacgcgagaagggggggggtctcaggaggcagcgctctcaggacgtcaccaccatggcctgggctctgctcctcctcagcctcctcactcagggcacaggggtcctgggccccagtctcgccctgactcacgcctcccgtccgcggtccgggtctcctggacagtcngtacacctatctcctcgcacgttacggaaacctgttggtgtaattaactaacgttagttcgtccgttcctacggtaacccacggtaccgacgtaccgaaccccgaacggaccaaaacccgtaaccccccgtaaaagtcctaaattaccggtaactttaagtacggtagccctacctaacgtacgtacccggtccctaccgggtacggggttaccctagtaacgtccgttcgttcctccgtaccggtctacccgtaaggtccggtcggtaaccgtccggtacccggtcccttccgtacggtcccgttccgtcggtccgggtactcccgtacggccttaaggacgtagttacggcgtagttgtactttcggttacgtcggacgtacgttactaaggtacgtagggtaacctaagttactaaaccggttgttacgtttaggttaccgttacgggtaacgggtccgggaaacgtaacgttccgtaaccctacggtacgttacccggcggaaaccgtaccggaaccccgttacccaagttccggtaaccnccgtttacccgttacctaccccgttccgttacccg

SEQ ID NO: 259601 - DNA, 809 bp, Homo sapiens
  misc_feature: GYAE6OF02INFA3.15.66.F11.1.454.CMB.1.raw
tcagtctacgtagccacgaccggtgctcgatttagtcacgcgagaaggggggggtctcaggaggcagtgctctcaggacgtcaccaccatggcctgggctctgctcctcctcagcctcctcactcgacgggcacgagggtcctgggcccaggtctcgccctgacctcacgtcctccctccggccggtccgggtctccgtggacagtcacgtccacctatcctcctcggcctacgtaggaaccctagtttgggataactttaactaacctagttcgttaccttcgtacgggtaaccagaccgaacgaccgtaacccgaggaacccgaaaaccgacccccgtaaaagtacctactaacttactttaacgtcgacgtacctactaaccgtacggtcccgtacccgtcgggtaccgggttaccctgtacgttccgttcctttcctaccgggtaccgtacccttaccgtaacgtcgggtaccgggtacccggtaaccggttcccggtccccttacccggtaccgttaacccgttccgttccgggtccggtaccgtcccgtaccgtaccgtacgggtaaacgtcggttacgggacggttcgttacgttaacgtttaccgttcggaccggtaccgtcttacgtaacgttaggtacgaacgttaaaccttacgttccgtacgtttacgttaccgtacggtaacggtaacgggccgtaacggtaccgtaccgtaccgttagtaccggtcgaaacccgaccgacgtaccccaaccgtcgttacgcccgttaccgtccttacccgtcccgttacgtcccg

SEQ ID NO: 259602 - DNA, 818 bp, Homo sapiens
  misc_feature: GYAE6OF02JU5P2.15.66.F11.1.454.CMB.1.raw
  modified_base (153)..(153): a, c, t, g, unknown or other
  misc_feature (153)..(153): n is a, c, g, or t
  modified_base (194)..(194): a, c, t, g, unknown or other
  misc_feature (194)..(194): n is a, c, g, or t
tcagtctacgtagccacgaccggtgctcgatttagtcacgcgagaagggggggggtctcaggaggcagcgctctcaggacgtcaccaccatggcctgggctctgctcctcctcagcctcctcactcgagggcacagggtcctgggcccagtcngccctgactcagcctccctccgcgtccggtctccgtggacngtcagtccacgactctcctgccacgtaggaacctgttggtagtaacttaataactatcgttctaccgtggtaccagctacgcctaccgaggaccgaaaccgcccccgaaagtccataccgtattagtacgagtacctctaacgttaacggcccggtacccgtacggtaaccggggttccctacggtacttaccgtccgtttaccgtccgttacggtccctaccggtaagttccgaggtccgtaccgttcccggtaccctcccgttacgtaacccgttccgtccggtcggttacccgtcccgtacgtaccgtacggtaaacggtcgttaacggtaccgggtactttaaccgttacgttttacggtttacccgttcgggttacccgttaccttacgtaacgttaacggtacggtaaaccgtcgttaaaacgttcttaacggtttcccgtttagttacgttaacggggtaacgttacgggtaaaccgtacgttaacccggtacccgtttacggtaaccgttccggtaaccggttaacccccgtaaacggtacccccgttaacccgtacgttcccgttaaccgttaccccgtttacgttccccggttaccccctccccggtttacccg

SEQ ID NO: 259603 - DNA, 716 bp, Homo sapiens
  misc_feature: GYAE6OF02G0LKJ.15.66.F11.1.454.CMB.1.raw
  modified_base (283)..(283): a, c, t, g, unknown or other
  misc_feature (283)..(283): n is a, c, g, or t
  modified_base (329)..(329): a, c, t, g, unknown or other
  misc_feature (329)..(329): n is a, c, g, or t
  modified_base (333)..(333): a, c, t, g, unknown or other
  misc_feature (333)..(333): n is a, c, g, or t
  modified_base (348)..(348): a, c, t, g, unknown or other
  misc_feature (348)..(348): n is a, c, g, or t
  modified_base (448)..(448): a, c, t, g, unknown or other
  misc_feature (448)..(448): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcgagggcacagggtcctgggcccagtctcgccctgacctcacgccctcctccgcggtccgggtctcctggaccagtcgagtccaaccattcctcctgcacgtggaaaccctgtttgggataattaactaaacttgtcgttccttccgtacgggtaaccngcacgccacccgaggacaaaccgtaccccaaagtcatctatttagngacnctcactaacgcgccncgacggtcctgactcgcttcgctcggctacaagtccgtggccacgtccgtacctccgtcgaccgttctcggtcggtccttaccgagttccgagtaacggngttacggacggttaccgtaggttaacttttacttcggtcggtaccgttactaccttagtaccggttagaacggttaactaacgtttaacgacgtttaccgttttgtaacccggttagggttaaacgtccgggggtaaaacccttaaagggtccccgttaaccggttacgttaaccgttaccgaaacgggtccccaaaccgggtacccctaaaacccgtcgttcgtaaccctcgttacccgtttccgttaccccgaacccctttcccgg

SEQ ID NO: 259604 - DNA, 640 bp, Homo sapiens
  misc_feature: GYAE6OF02GVBOJ.15.66.F11.1.454.CMB.1.raw
  modified_base (203)..(203): a, c, t, g, unknown or other
  misc_feature (203)..(203): n is a, c, g, or t
  modified_base (208)..(209): a, c, t, g, unknown or other
  misc_feature (208)..(209): n is a, c, g, or t
  modified_base (213)..(213): a, c, t, g, unknown or other
  misc_feature (213)..(213): n is a, c, g, or t
  modified_base (220)..(220): a, c, t, g, unknown or other
  misc_feature (220)..(220): n is a, c, g, or t
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
  modified_base (251)..(251): a, c, t, g, unknown or other
  misc_feature (251)..(251): n is a, c, g, or t
  modified_base (269)..(269): a, c, t, g, unknown or other
  misc_feature (269)..(269): n is a, c, g, or t
  modified_base (278)..(278): a, c, t, g, unknown or other
  misc_feature (278)..(278): n is a, c, g, or t
tcagtctacgtagccacgaccggtgctcgatttagtcacgcgagaaggggggggtctcaggaggcagcgctctcaggacgtcaccaccagtggcctgggctctgctcctcctcagcctcctcactcgagggcaacgagggtcctgggcccagtctcgccctgactcacgcctcctcgcgtcggtctcctggacagcagtcacntctcnncacncgaacantgagtgatnttactacttgctcgngtacaanacacagacaacgaccaancatctattnagagtctactacgcgcctacgaggtatacgtactcgtcttctcgtcggtactaccgtaattcgcggacaaccggtaccgtcccttacccgtcggtaacccgtcctcggttaccggtccctacgacgtactcgggacggtacggacggtcgtactattactcgtacactactctaatacgtaagtaactaacgtacttataccgttggttcgggttaccggagggacggtaaccgacgtacggtaccgtaccgttacggttaacgtccgtaccgaccggttaaccggtcgtccccggtaaccccggtcgttccgaaccgttttcccgtccgttccccggtccccttacgttcccggtaacccg

SEQ ID NO: 259605 - DNA, 701 bp, Homo sapiens
  misc_feature: GYAE6OF02G3HQN.15.66.F11.1.454.CMB.1.raw
  modified_base (211)..(211): a, c, t, g, unknown or other
  misc_feature (211)..(211): n is a, c, g, or t
  modified_base (403)..(403): a, c, t, g, unknown or other
  misc_feature (403)..(403): n is a, c, g, or t
tcagtctacgtagccacgaccggtgctcgatttagtcacgcgagaaggggggggtctcaggaggcagcgctctcaggacgtcaccaccatggcctgggctctgcctcctcctcagcctcctcactcgaggcacgagggtcctgggcccagtctgccctgactcacgcctccctcgcgttccgggtctccgtaggacaggtcagtccaaccntcctcgtgactacgtaggaacctgtggtcattaactactatcgtctccgttaggaccagtctaacgccaacccgagaccgaaaccgacccctaaagtcactacgtaatttacgacgtacgctacgaacgttaaccggccgtccgtacgtacgggtccctagacgtctccgttctcgtacgctacctaggtcncgggtccacgtcggtaccctcctagtaccgtcgtacggtcggtacctaccgaccgtactaggtaacgtacgtcgtgacgttgttattaaccgttgaccgtcgttaccgtctagtacggttacgagtaaacgttactaacggtcttacggttacgttcgtaacgggtcgtaaacggtaaccgtaacgttccgtaccgttacgtacgttaccgaacgtaacccggtacctaaccccggacctttaaccgcgttaccgttaccgtttacccgtttacccgacccttaccccgttaacccgg

SEQ ID NO: 259606 - DNA, 690 bp, Homo sapiens
  misc_feature: GYAE6OF02JEXOS.15.66.F11.1.454.CMB.1.raw
  modified_base (210)..(210): a, c, t, g, unknown or other
  misc_feature (210)..(210): n is a, c, g, or t
tcagtctacgtagccacgaccggtgctcgatttagtcacgcgagaagggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctccngcactaggaacctagttggtgattataactatgtacctccgtaggtaccagcacgccacccgaggaccaaaaccgacccccaaagtcatctaattatgacgctacacgtacggcccggaccctcggccgggtccctgacgtcgtcttctcgtcgacctcgtaagtcgtaggccgtacgtcgccctccgtcgtacccgtcgtcgtcggtcctccgacgtccgtacgaacgtgtacggacgtcggtagtaatttacgtttcgtcggtaccggttctactagttaggttaggtaaacctaccttaaagttacccgtagttttaccgtttgttaccggtttaacgggtaagggtaccggggtaaccgtaacggttaccgtacccgttacgttaacggtaccgtaacccgtacccgaaccggacccctaacccggtcttacgtacctaccgttcccgtacccgttacccccgtacccttacccgg

SEQ ID NO: 259607 - DNA, 725 bp, Homo sapiens
  misc_feature: GYAE6OF02I67CL.15.66.F11.1.454.CMB.1.raw
  modified_base (513)..(513): a, c, t, g, unknown or other
  misc_feature (513)..(513): n is a, c, g, or t
tcagtctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagccctccctccgcgtccgggtctcctggacagtcagtcaccatcctcctgcactggaacctattggtagtattactaacttatcgttcctccgtggtaccaggcagccaccgagacaaaccgccccaagtcatctatttagtcgagcctactaacgtaacgcccggtacccgtacggtaccggggtcccctggtactccgtccttcgtcgtcggtaccttaccgtaacgtcgtacggtccgtaccgtccggtccctccgtcgccgttcctcggtacggtcctacccgacgtccgtaaggtaacgtacggtcggtagtacgttagttactttacgttccgtacggtccgttntccgttaatacgtaggacgtaaacgttaacgttacgtacgttcgttttagtaccggttaacgggtaacgggttacgggtaaaccgttaaccggttccgtaaccccgttacgttaaccggtccggaaaccggaccccgtaaacggccccctaacccgtcgttaccgtaacccgttcgttacccggttccccgttaccccgtcccgttacccgg

SEQ ID NO: 259608 - DNA, 754 bp, Homo sapiens
  misc_feature: GYAE6OF02FR47R.15.66.F11.1.454.CMB.1.raw
  modified_base (208)..(208): a, c, t, g, unknown or other
  misc_feature (208)..(208): n is a, c, g, or t
  modified_base (417)..(417): a, c, t, g, unknown or other
  misc_feature (417)..(417): n is a, c, g, or t
tcagtctacgtagccacgaccggtgctcgatttagtcacgcgagaagggggggggtctcaggaggcagcgctctcaggacgtcaccaccatggcctgggctctgctcctcctcagcctcctcactcgagggcacagggtcctgggcccagtctgccctgactcagccctccctccgcgttccgggtctccgtggacagtcagtcaccntcctctgcacgtaggaacctattcgggtatattactaacttatcgtcctccgtcggtaccagcacgccaccggagaccaaaaccgcccctaaagcattcgtattttagcgactctactaacgtacgcccggtccctgggtaccgggtccctgtactccgacttcctctcggtcctacggtagttcgcggacctaccgtccgtccctccncgtccgttctccggtacggtccctaaccgtcgtacccgtaggtaaccgtaggtaggcggttacttaacggtttacttttaaccgttccggtaccgggtccttaccggttaactaacggtttacggaaacgggtacccgtaaacggttaacctttaaccggtacgggttttaccgttttacgggtaccggttttacggggtaaccgggtttaccggaacccggtaacggttcccgaacccgttacgtaaccgtaccggaacccgtaaccccggacccgtacccaacccgttagtcccgtcctacccggttccttaccccgttccccacccgttaccgg

SEQ ID NO: 259609 - DNA, 709 bp, Homo sapiens
  misc_feature: GYAE6OF02HQE0L.15.66.F11.1.454.CMB.1.raw
  modified_base (208)..(208): a, c, t, g, unknown or other
  misc_feature (208)..(208): n is a, c, g, or t
  modified_base (542)..(542): a, c, t, g, unknown or other
  misc_feature (542)..(542): n is a, c, g, or t
tcagtctacgtagccacgaccggtgctcgatttagtcacgcgagaagggggggggtctcaggaggcagcgctctcaggacgtcaccaccatggcctgggctctgcctcctcctcagcctcctcactcgagggcacgagggtcctcgggccctagtcctgtccctgactcacgccctccctccgccggtccgggtccttccgtggaccngtcagtccacctactcctcctacgcctaccgtacggaaacctaactagttcggttacggttgggtattaacttattaacgttgtcctcgttacggtaacctaaccgaccaacccgtacgaacctaaaccgacccctaaactcacttactattactagtacgtacttacacgtcgtacctcgtacggtattcgtactacgtcttctcgtcgtctactacgtacgtacgacgtaacgccggtccctccgtcgacccgtcttacgtccggtccaccgtagtcgtacgggacgacggacggtctagttaacttacgtactccgactactacagttaanagtaacgtatactcctaggttcgggtttacggtcggtacggacgtaacctcgtccgtaaccggtccgttaccgaccggtacgtacccgacggtacccggtacctccccggtcccgttccgtacccgtcttccgttacccgtaccccgtccttcccgtaccgtaccgg

SEQ ID NO: 259610 - DNA, 722 bp, Homo sapiens
  misc_feature: GYAE6OF02H4N5J.15.66.F11.1.454.CMB.1.raw
  modified_base (192)..(192): a, c, t, g, unknown or other
  misc_feature (192)..(192): n is a, c, g, or t
  modified_base (274)..(274): a, c, t, g, unknown or other
  misc_feature (274)..(274): n is a, c, g, or t
  modified_base (382)..(382): a, c, t, g, unknown or other
  misc_feature (382)..(382): n is a, c, g, or t
tcagtctacgtagccacgaccggtgctcgatttagtcacgcgagaagggggggtctcaggaggcagcgctctcaggacgtcaccaccatggcctgggctctgctcctcctcagcctctcactcagggcacgagggtcctcgggccagtctgccctgctcacgcctccctcgcgttccgggtctccgtggacngtcagtccaccatctcctgaccactggaacctagtttgggtacatttaacgttaaacctgttctaccgttcgtacggtaacngacacgtccaccgacggaccaaacggtaccccctaagtacctataccgtatttacgtcgaacgtccttacacgttaacgcccgtccgtacgtaccgggtcctagtacncgttaccttctacgtcggtactccgtacgtcgtcgaccgtccgtccgtaccctcctacgtctacgtcgtacggtcctacgctacgtacgtagtaccgtacgtagccgttagtacgtttacgttttcggacccgttcggtacctaacgttaaacgtccgttaacggaaacgttaaccgtaaacggttcgttacgtttaccggtttcgttaaccgtacggggtaactccggggtaaaacgttaccgtacccgtacgtaccgtacgtaccgacgtacccgaacgtacccctaacccgtagttccgaccgttacgttcccggtttacctcccctacgttacccg

SEQ ID NO: 259611 - DNA, 758 bp, Homo sapiens
  misc_feature: GYAE6OF02H4AKB.15.66.F11.1.454.CMB.1.raw
  modified_base (370)..(370): a, c, t, g, unknown or other
  misc_feature (370)..(370): n is a, c, g, or t
tcagtctacgtagccacgaccggtgctcgatttagtcacgcgagaaccgggggggggtctcaggaggcagcgctctcaggacgtcaccaccatggcctgggctctgcctcctcctcagcctcctcactcgagggcacgagggtcctgggcccagtctgccctgactcacgcctccctccgcgtccggtctccgtggacagtcagtccacatctctgacacgtagaactattggtatattaactaactatcgtcctacgtacggtaaccagcacgaccaacccgaaggacaaacgacccccaaagtcaactactattaagtagacactacaacgtaacggcgtccctacgacgggtcctgactcgtcttcncgtaggtcctaccgtacgtcgtacggcgtaccgtccggtcccttaccgtacgtacccgttcgtcggtcggtacctaccgacgtaccgtaggaacgtagtcggaacggtacgttagttaacgtttacgtttcggtacggccggtaccttaactaagttacggtaaggaactaaaacgtaactttaacgacgtttaccgttttacggttaccgtttaacgggtaaacggttaaccggggaaaccgttaaacgggttacccgtaaccgttaacccgttaacggttacccggaaccggtaccccggtaaacccggaaccccctaaacccgttaccgttacgtaacccgtaacctttacccgttaccgttaccccccctacccgtttaccccg

SEQ ID NO: 259612 - DNA, 669 bp, Homo sapiens
  misc_feature: GYAE6OF02GVJX1.15.66.F11.1.454.CMB.1.raw
  modified_base (192)..(192): a, c, t, g, unknown or other
  misc_feature (192)..(192): n is a, c, g, or t
  modified_base (386)..(386): a, c, t, g, unknown or other
  misc_feature (386)..(386): n is a, c, g, or t
  modified_base (472)..(472): a, c, t, g, unknown or other
  misc_feature (472)..(472): n is a, c, g, or t
  modified_base (514)..(514): a, c, t, g, unknown or other
  misc_feature (514)..(514): n is a, c, g, or t
  modified_base (598)..(598): a, c, t, g, unknown or other
  misc_feature (598)..(598): n is a, c, g, or t
  modified_base (630)..(630): a, c, t, g, unknown or other
  misc_feature (630)..(630): n is a, c, g, or t
tcagtctacgtagccacgaccggtgctcgatttagtcacgcgagaaggggggggtctcaggaggcagcgctctcaggacgtcaccaccatggcctggctctgctcctcctcagccctcctcactcagggcacagggtcctgggcccagtctgccctgactcacgccctccctcgcgtccggtctcctggacngtcagtccacatcctcctgcactgaacctgttggtataattaataactatcgtctccgtggtaccagcacgccaaccgagacaaaccgccccaaagtcacttctatttacagacgtcctacaacgtacggcccggtaccctacggtacgggttccctagtagtccgtacctttcgtctcggtccacgtacgtcncggcgtaccgtcccggtcccttcccgtcgggtacccttcgtaccggtcggtaccctcctacggctaaggaacgtcgtaggacggtnttacgtaactttcgttacgtcggtctacgtacttaagtacgngtaacgtaaccttaattacggtacgtcgttttacggtcgttaacggagttacgggaaccgtaacgtcccgaaccgtcgttaacnccggtaacccgccgtaacccggaccctaaccnccgttcgacttcccttcgtacccgtcccaccgttacccg

SEQ ID NO: 259613 - DNA, 808 bp, Homo sapiens
  misc_feature: GYAE6OF02IUXJQ.15.66.F11.1.454.CMB.1.raw
tcagtctacgtagccacgaccggtgctcgatttagtcacgcgagaaggggggggtctcaggaggcagcgctctcagacgtcaccaccatggcctgggctctgctcctcctcagcctcctcactcaggcacagggtcctgggcccagtctgccccgtagacctacgacgcccttcccgccgtccggtccggtccttcgtacggactacgtacacgtccaacctacttccctaccgtcacctacggtaccgtaaccttaggttggtacttaaacttaactaacttagttccgtccttaccggtacgtaccacgacgtcgacccgtaccgacgaaccaacccgacctaagtccaagttctaagttcgtacgaacgtcctaaccgtaacgtaccgggcccctaccggtacgggtaccccgggtctacggtacccgtccgttccgttactaccggtcgtacccttacgtaaccggtcggtacggtaccccgtccgtccccggttaccctaccggtccgtaacccgtctacgggtaccgtccgttacgcgtaccgtaaggtacgtacggtcggtacggtacgttacgtttacgtttacgtccggttaccggtacttaccgttaagtacgttaggtaccgtaactaacgttacgtacgttacgtttacgtttaccggtacggtaacggttacggttaaaccggactttaacccgggacttacccgtacgttaccgacccggtacgtaacccgaccgtacccaacccgttgaccctaccgttaccgttacccctcgttaccccgtccgttaacccg

SEQ ID NO: 259614 - DNA, 742 bp, Homo sapiens
  misc_feature: GYAE6OF02GKUXW.15.66.F11.1.454.CMB.1.raw
  modified_base (236)..(236): a, c, t, g, unknown or other
  misc_feature (236)..(236): n is a, c, g, or t
tcagtctacgtagccacgaccggtgctcgatttagtcacgcgagaaggggggggtctcaggaggcagcgctctcaggactcaccacatggcctgggctctgctcctcctacagccctcctcactcgagggcacgagggtcctgggcccagtctgccctgactcacgccctccctccgcgtccgggtctccgtggacagtcagtcaccatctcctgcacgtcggaacctgttaggtntaatttaactaactagttcgttcctaccgtaggtaccaggcaaggtccacccgaggaccaaaccggcccccaaaaggttccattactaattttacgacgtaagtcctaccgtaacgtaaacggcccgtacccgtacggacggggttccccgttaggaacttccggtccttttaccgtcgtcgggtaccctaccgtaaacggtccgtacggtaccgtaccgtaccggtcccgttacccgttacggaccggtttcctacgggttcggtacctccgacgtaccgttaggaactattacggacggtcgttagttatttacgttcgtacgtcggtacacttaagtacgttaacggacgtaactaacgtaactcggttatttacgtacgttacgggtaaggtcggtaaccgaacggttaccctaccggttactaacggtaccgaacggtacccgaaccggtaacccaacccgtagtccgtctacctcgttcccgtcccctacccggttcccg

SEQ ID NO: 259615 - DNA, 810 bp, Homo sapiens
  misc_feature: GYAE6OF02GU6HX.15.66.F11.1.454.CMB.1.raw
  modified_base (221)..(221): a, c, t, g, unknown or other
  misc_feature (221)..(221): n is a, c, g, or t
  modified_base (256)..(256): a, c, t, g, unknown or other
  misc_feature (256)..(256): n is a, c, g, or t
tcagtctacgtagccacgaccggtgctcgatttagtcacgcgagaagggggggggtctcaggaggcagcgctctcaggacgtcaccaccatggcctgggctctgctcctcctcagcctcctcactcgagggcacgagggtcctcgggcccagtctcgccctgactcacgccctccctccgccggtccgggtctccgtggacagtcacgtcaccatcctccngcactacggaacctagttggtgtaattaataactntcgtcctcgtacgtaccagccgagccaaccgacggaaccaaaccggacccccaaagtccaacttctaatttacgacgtacgtcctactaacgtaaccggcccggtacccgtacggtaccgggtcctagtacctacgtccgttcgtcgtcgtcctaccgttacgtcgtacggtccgtaccgtcccgtcccgtaccgtcggtacccgttccgtaccggtcggtaccgtaccgaccgacgtaacggtaacgtaggtacggacggttaccgttcgtttaacgtttcgtttaccggccgttaccggttacctaacgttagtacggtaaggtaacctaaacgttaacgttacgtaacggtttccggttttaacggttaccgttaacggggtaccgggttaaccgggtaacccgttaacggttacccggtaaccgttaacccggtaccgtaacccggtaacccggaaccccggtaaacccgtaccccccgtaaaccgttccgttaacccggccctttaacccgttaccccgttccccgttaccccctaccccggtttcccg

SEQ ID NO: 259616 - DNA, 828 bp, Homo sapiens
  misc_feature: GYAE6OF02HM4NI.15.66.F11.1.454.CMB.1.raw
  modified_base (164)..(164): a, c, t, g, unknown or other
  misc_feature (164)..(164): n is a, c, g, or t
  modified_base (255)..(255): a, c, t, g, unknown or other
  misc_feature (255)..(255): n is a, c, g, or t
tcagtctacgtagccacgaccggtgctcgatttagtcacgcgagaaggggggggtctcgagggaggcagcgctctcaggacgtcaccaccatggcctgggctcgtgctcctcctcagcctcctcactcaggcacagggtcctgggcccagtctgccctgactcngcctccctcgcgtccgggtctcctggacagtcagtccaccatcctccgtgcacgtaggaacctagtttgggtactaattaataaaaccgtnttcgttcccgtcctagggtaccaggacacggacccaacccgacgggaccaaaacccgtacccccgaaagttccaacttacgtaaacttttaactcgggtactaccttaccgtaaaccgttaaccggacccgggttacccctacggtacccgggggttaccccttaggaccgtttccggttcctttccggttcgtccggtacccgttaccgtaacggttacggttcggaccgtaccgttcccgggtccccttccgttaccgtacccgtccgtcggtccggggtacctccgacgtccgaggtacgtaacgtggtacgggtcttagggtactttacggttcgtacggcgttacgttacctagtaagttagggacctaagtaaacgtttacgaacgtttcgttttacggttaccggttagggtacggttacccgggaaacgttaccggttacctacccggttaaccgtaacgggtcccgtaaccggaaccccgtaacccggtaacccaaccccggttacgtaccgttacccgtaaccgtttcccggtaccccggtttaccccgtccccgttacccgg

SEQ ID NO: 259617 - DNA, 246 bp, Homo sapiens
  misc_feature: GYAE6OF01CX1GS.45.67.G01.1.454.CMB.1.raw
  modified_base (243)..(246): a, c, t, g, unknown or other
  misc_feature (243)..(246): n is a, c, g, or t
tcagacgcgatcgacacgaccggtgctcgatttagagtatacatattgggtttggggtgtggtggtctccactcccgccttgacgaggccgactattactgcggaacgtgggatgtccgtctatttgcggtgttcggcggagggaccagattgaccgtcctgggtcagcccaaggctgcccctcggtcactctgttcccacctcctctcgatcgcgtctgagcgggctggcaaggcgcatagnnnn

SEQ ID NO: 259618 - DNA, 244 bp, Homo sapiens
  misc_feature: GYAE6OF01EE7ZW.45.67.G01.1.454.CMB.1.raw
  modified_base (244)..(244): a, c, t, g, unknown or other
  misc_feature (244)..(244): n is a, c, g, or t
tcagacgcgatcgacacgaccggtgctcgatttagagtatacatattgggtttggggtgtggtggtctccactcccgccttgacgaggccgactattactgcggaacgtgggatgtccgtctatttgcggtgttcggcggagggaccaagctgaccgtcctaggtcagcccaaggctgcccctcggtcactctgttcccaccctcctctcgatcgcgtctgagcgggctggcaaggcgcatagn

SEQ ID NO: 259619 - DNA, 183 bp, Homo sapiens
  misc_feature: GYAE6OF01CBAEA.45.67.G01.1.454.CMB.1.raw
  modified_base (181)..(183): a, c, t, g, unknown or other
  misc_feature (181)..(183): n is a, c, g, or t
tcagacgcgatcgacacgaccggtgctcgatttagagtatacatattgggtttgggctctgggcaccgtgggcatggggaggtgtgtcacaagatttgggctctgggcacagcggccctgggctgcctggtcaaggactacttcttcgatcgcgtctgagcgggctggcaaggcgcatagnnn

SEQ ID NO: 259620 - DNA, 137 bp, Homo sapiens
  misc_feature: GYAE6OF01A9RSI.45.67.G01.1.454.CMB.1.raw
  modified_base (137)..(137): a, c, t, g, unknown or other
  misc_feature (137)..(137): n is a, c, g, or t
tcagacgcgatcgacacgaccggtgctcgatttagagtatacatattgggtttgggctctgggcacagcggccctgggctgcctggtcaaggactacttcctactgctagtctgagcgggctggcaaggcgcatagn

SEQ ID NO: 259621 - DNA, 244 bp, Homo sapiens
  misc_feature: GYAE6OF01CWVEH.45.67.G01.1.454.CMB.1.raw
  modified_base (242)..(244): a, c, t, g, unknown or other
  misc_feature (242)..(244): n is a, c, g, or t
tcagacgcgatcgacacgaccggtgctcgatttagagtatacatattgggtttgggtgtggtggtctccactcccgccttgacgaggccgactattactgcggaacgtgggatgtccgtctatttgcggtgttcggcggagggaccagattgaccgtcctgggtcagcccaaggctgcccctcggtcactctgttcccgcctcctctcgatcgcgtctgagcgggctggcaaggcgcatagnnn

SEQ ID NO: 259622 - DNA, 237 bp, Homo sapiens
  misc_feature: GYAE6OF01C7BUY.45.67.G01.1.454.CMB.1.raw
  modified_base (236)..(237): a, c, t, g, unknown or other
  misc_feature (236)..(237): n is a, c, g, or t
tcagacgcgatcgacacgaccggtgctcgattagagtatacatattggttgggtgtggtggtctccactccgccttgacgaggccgactattactgcggaacgtgggatgtccgtctattgcggtgttcggcggaggaccagattgaccgtcctgggtcagcccaaggctgcccctcggtcactctgttcccacctcctctcgatcgcgtctgagcgggctggcaaggcgcatagnn

SEQ ID NO: 259623 - DNA, 248 bp, Homo sapiens
  misc_feature: GYAE6OF01B5AO3.45.67.G01.1.454.CMB.1.raw
  modified_base (244)..(248): a, c, t, g, unknown or other
  misc_feature (244)..(248): n is a, c, g, or t
tcagacgcgatcgacacgaccggtgctcgatttagagtatacatattgggtttggggtggtggtggtctccactcccgccttgacgaggccgactattactgcggaacgtggatgtccgtctatttgcggtgttcggcggaggaccagattgaccgtcctgggtcagcccaaggctgccccctcggtcactctgttcccaccctcctctcgatcgcgtctgagcgggctggcaaggcgcatagnnnnn

SEQ ID NO: 259624 - DNA, 247 bp, Homo sapiens
  misc_feature: GYAE6OF01B1AUD.45.67.G01.1.454.CMB.1.raw
  modified_base (245)..(247): a, c, t, g, unknown or other
  misc_feature (245)..(247): n is a, c, g, or t
tcagacgcgatcgacacgaccggtgctcgatttagagtatacatattgggtttggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccaccctcctctcgatcgcgtctgagcgggctggcaaggcgcatagnnn

SEQ ID NO: 259625 - DNA, 174 bp, Homo sapiens
  misc_feature: GYAE6OF01E4VN0.45.67.G01.1.454.CMB.1.raw
  modified_base (174)..(174): a, c, t, g, unknown or other
  misc_feature (174)..(174): n is a, c, g, or t
tcagacgcgatcgacacgaccggtgctcgatttagagtatacatattgggtttgggggaagaggaagactgacggtcctcccaggagttcaggtgctgggcacagcggccctgggctgcctggtcaaggactacttcctcgatcgcgtctgagcgggctggcaaggcgcatagn

SEQ ID NO: 259626 - DNA, 248 bp, Homo sapiens
  misc_feature: GYAE6OF01B6GPY.45.67.G01.1.454.CMB.1.raw
  modified_base (246)..(248): a, c, t, g, unknown or other
  misc_feature (246)..(248): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccaccctcctctcgatcgcgtctgagcgggctggcaaggcgcatagnnn

SEQ ID NO: 259627 - DNA, 202 bp, Homo sapiens
  misc_feature: GYAE6OF01DI6OJ.45.67.G01.1.454.CMB.1.raw
  modified_base (183)..(202): a, c, t, g, unknown or other
  misc_feature (183)..(202): n is a, c, g, or t
tcagacgcgatcgacacgaccggtgctcgatttagagtatacatattgggtttgggctctgggcaccgtgggcatgggggaggtgtgtcacaagatttgggcctctgggcacagcggccctgggctgcctggtcaaggactacttcctcgatcgcgtctgagcgggctggcaaggcgcatagnnnnnnnnnnnnnnnnnnnn

SEQ ID NO: 259628 - DNA, 138 bp, Homo sapiens
  misc_feature: GYAE6OF01CV4O0.45.67.G01.1.454.CMB.1.raw
  modified_base (137)..(138): a, c, t, g, unknown or other
  misc_feature (137)..(138): n is a, c, g, or t
tcagacgcgatcgacacgaccggtgctcgatttagagtatacatattgggtttgggctctgggcacagcggccctgggctgcctggtcaaggactacttcctcgatcgcgtctgagcgggctggcaaggcgcatagnn

SEQ ID NO: 259629 - DNA, 222 bp, Homo sapiens
  misc_feature: GYAE6OF01C4NU0.45.67.G01.1.454.CMB.1.raw
  modified_base (219)..(222): a, c, t, g, unknown or other
  misc_feature (219)..(222): n is a, c, g, or t
tcagacgcgatcgacacgaccggtgctcgatttagagtatacatattgggtttgggggaagaggaagactgacggtcctcccaggagttcaggtgctgggcaccttgggcacgggggaggtgtgtcacaagatttgggctctgggcacagcggccctgggctgcctggtcaaggactacttcctcgatcgcgtctgagcgggctggcaaggcgcatagnnnn

SEQ ID NO: 259630 - DNA, 248 bp, Homo sapiens; identical to SEQ ID NO: 259626
  misc_feature: GYAE6OF01EVU8O.45.67.G01.1.454.CMB.1.raw
  modified_base (246)..(248): a, c, t, g, unknown or other
  misc_feature (246)..(248): n is a, c, g, or t

SEQ ID NO: 259631 - DNA, 247 bp, Homo sapiens
  misc_feature: GYAE6OF01A8KTP.45.67.G01.1.454.CMB.1.raw
  modified_base (246)..(247): a, c, t, g, unknown or other
  misc_feature (246)..(247): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccaccctcctctcgatcgcgtctgagcgggctggcaaggcgcatagnn

SEQ ID NO: 259632 - DNA, 247 bp, Homo sapiens; identical to SEQ ID NO: 259631
  misc_feature: GYAE6OF01B8CLB.45.67.G01.1.454.CMB.1.raw
  modified_base (246)..(247): a, c, t, g, unknown or other
  misc_feature (246)..(247): n is a, c, g, or t

SEQ ID NO: 259633 - DNA, 246 bp, Homo sapiens
  misc_feature: GYAE6OF01CKJCU.45.67.G01.1.454.CMB.1.raw
  modified_base (245)..(246): a, c, t, g, unknown or other
  misc_feature (245)..(246): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgcccctcggtcactctgttcccgccctcctctcgatcgcgtctgagcgggctggcaaggcgcatagnn

SEQ ID NO: 259634 - DNA, 246 bp, Homo sapiens
  misc_feature: GYAE6OF01BCEYC.45.67.G01.1.454.CMB.1.raw
  modified_base (244)..(246): a, c, t, g, unknown or other
  misc_feature (244)..(246): n is a, c, g, or t
tcagacgcgatcgacacgaccggtgctcgatttagagtatacatattgggtttggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccaccctcctctcgatccgtctgagcgggctggcaaggcgcatagnnn

SEQ ID NO: 259635 - DNA, 227 bp, Homo sapiens
  misc_feature: GYAE6OF01CIE2R.45.67.G01.1.454.CMB.1.raw
  modified_base (217)..(227): a, c, t, g, unknown or other
  misc_feature (217)..(227): n is a, c, g, or t
tcagacgcgatcgacacgaccggtgctcgatttagagtatacatattgggtttgggggaagaggaagactgacggtcctcccaggagttcaggtgctgggcaccttgggcacggggaggtgtgtcacaagatttgggctctgggcacagcggccctgggctgcctggtcaaggactactcctcgatcgcgtctgagcgggctggcaaggcgcatagnnnnnnnnnnn

SEQ ID NO: 259636 - DNA, 248 bp, Homo sapiens; identical to SEQ ID NO: 259626
  misc_feature: GYAE6OF01EMM85.45.67.G01.1.454.CMB.1.raw
  modified_base (246)..(248): a, c, t, g, unknown or other
  misc_feature (246)..(248): n is a, c, g, or t

SEQ ID NO: 259637 - DNA, 251 bp, Homo sapiens
  misc_feature: GYAE6OF01A0VSB.45.67.G01.1.454.CMB.1.raw
  modified_base (246)..(251): a, c, t, g, unknown or other
  misc_feature (246)..(251): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccgccctcctctcgatcgcgtctgagcgggctggcaaggcgcatagnnnnnn

SEQ ID NO: 259638 - DNA, 245 bp, Homo sapiens
  misc_feature: GYAE6OF01ESBR3.45.67.G01.1.454.CMB.1.raw
  modified_base (245)..(245): a, c, t, g, unknown or other
  misc_feature (245)..(245): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgcccctcggtcactctgttcccaccctcctctcgatcgcgtctgagcgggctggcaaggcgcatagn

SEQ ID NO: 259639 - DNA, 273 bp, Homo sapiens
  misc_feature: GYAE6OF01CEL8H.45.67.G01.1.454.CMB.1.raw
  modified_base (247)..(273): a, c, t, g, unknown or other
  misc_feature (247)..(273): n is a, c, g, or t
tcagacgcgatcgacacgaccggtgctcgatttagagtatacatattggggtttgggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccaccctcctctcgatcgcgtctgagcgggctggcaaggcgcatagnnnnnnnnnnnnnnnnnnnnnnnnnnn

SEQ ID NO: 259640 - DNA, 185 bp, Homo sapiens
  misc_feature: GYAE6OF01BYVWD.45.67.G01.1.454.CMB.1.raw
  modified_base (181)..(185): a, c, t, g, unknown or other
  misc_feature (181)..(185): n is a, c, g, or t
tcagacgcgatcgacacgaccggtgctcgatttagagtatacatattgggtttgggctctgggcaccgtgggcatggggaggtgtgtcacaagatttgggctctgggcacagcggccctgggctgcctggtcaaggactacttcctcgatctcgtctgagcgggctggcaaggcgcatagnnnnn

SEQ ID NO: 259641 - DNA, 269 bp, Homo sapiens
  misc_feature: GYAE6OF01EF2OP.45.67.G01.1.454.CMB.1.raw
  modified_base (247)..(269): a, c, t, g, unknown or other
  misc_feature (247)..(269): n is a, c, g, or t
tcagacgcgatcgacacgaccggtgctcgatttagagtatacatattgggtttgggggtgtggtgggtctccactcccgccttgacgaggccgactattactgcggaacgtgggatgtccgtctatttgcggtgttcggcggagggaccagattgaccgtcctgggtcagcccaaggctgccccctcggtcactctgttcccaccctcctctcgatcgcgtctgagcgggctggcaaggcgcatagnnnnnnnnnnnnnnnnnnnnnnn

SEQ ID NO: 259642 - DNA, 249 bp, Homo sapiens
  misc_feature: GYAE6OF01EJ1HL.45.67.G01.1.454.CMB.1.raw
  modified_base (246)..(249): a, c, t, g, unknown or other
  misc_feature (246)..(249): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgcccactcggtcactctgttcccgccctcctctcgatcgcgtctgagcgggctggcaaggcgcatagnnnn

SEQ ID NO: 259643 - DNA, 246 bp, Homo sapiens
  misc_feature: GYAE6OF01CRWLL.45.67.G01.1.454.CMB.1.raw
  modified_base (246)..(246): a, c, t, g, unknown or other
  misc_feature (246)..(246): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccaccctcctctcgatcgcgtctgagcgggctggcaaggcgcatagn

SEQ ID NO: 259644 - DNA, 248 bp, Homo sapiens
  misc_feature: GYAE6OF01AOY91.45.67.G01.1.454.CMB.1.raw
  modified_base (246)..(248): a, c, t, g, unknown or other
  misc_feature (246)..(248): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccgccctcctctcgatcgcgtctgagcgggctggcaaggcgcatagnnn

SEQ ID NO: 259645 - DNA, 248 bp, Homo sapiens; identical to SEQ ID NO: 259644
  misc_feature: GYAE6OF01CTLAV.45.67.G01.1.454.CMB.1.raw
  modified_base (246)..(248): a, c, t, g, unknown or other
  misc_feature (246)..(248): n is a, c, g, or t

SEQ ID NO: 259646 - DNA, 249 bp, Homo sapiens
  misc_feature: GYAE6OF01B0ZI0.45.67.G01.1.454.CMB.1.raw
  modified_base (246)..(249): a, c, t, g, unknown or other
  misc_feature (246)..(249): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccaccctcctctcgatcgcgtctgagcgggctggcaaggcgcatagnnnn

SEQ ID NO: 259647 - DNA, 247 bp, Homo sapiens; identical to SEQ ID NO: 259631
  misc_feature: GYAE6OF01EGMS3.45.67.G01.1.454.CMB.1.raw
  modified_base (246)..(247): a, c, t, g, unknown or other
  misc_feature (246)..(247): n is a, c, g, or t

SEQ ID NO: 259648 - DNA, 246 bp, Homo sapiens
  misc_feature: GYAE6OF01CLWU1.45.67.G01.1.454.CMB.1.raw
  modified_base (245)..(246): a, c, t, g, unknown or other
  misc_feature (245)..(246): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccgccctcctctcgatccgtctgagcgggctggcaaggcgcatagnn

SEQ ID NO: 259649 - DNA, 247 bp, Homo sapiens; identical to SEQ ID NO: 259631
  misc_feature: GYAE6OF01C30RO.45.67.G01.1.454.CMB.1.raw
  modified_base (246)..(247): a, c, t, g, unknown or other
  misc_feature (246)..(247): n is a, c, g, or t

SEQ ID NO: 259650 - DNA, 275 bp, Homo sapiens
  misc_feature: GYAE6OF01A4VBA.45.67.G01.1.454.CMB.1.raw
  modified_base (245)..(275): a, c, t, g, unknown or other
  misc_feature (245)..(275): n is a, c, g, or t
tcagacgcgatcgacacgaccggtgctcgatttagagtatacatattgggtttgggggtgtggtggtctccactcccgccttgacgaggctgattatttctgttgctcatatgcagggaccagcacttgggtgttcggcggagggaccaggttgaccgtcctaggtcagcccaaggctgccccctggtcactctgttcccgccctcctctcgatcgcgtctgagcgggctggcaaggcgcatagnnnnnnnnnnnnnnnnnnnnnnnnnnnnnnn

SEQ ID NO: 259651 - DNA, 261 bp, Homo sapiens
  misc_feature: GYAE6OF01CSO37.45.67.G01.1.454.CMB.1.raw
  modified_base (247)..(261): a, c, t, g, unknown or other
  misc_feature (247)..(261): n is a, c, g, or t
tcagacgcgatcgacacgaccggtgctcgatttagagtatacatattgggtttggggggtgtgggtggtctccactcccgccttgacgaggccgactattactgcggaacgtgggatgtccgtctatttgcggtgttcgggcggagggaccagattgaccgtcctgggtcagcccaaggctgccccctggtcactctgttcccacctcctctcgatcgcgtctgagcgggctggcaaggcgcatagnnnnnnnnnnnnnnn

SEQ ID NO: 259652 - DNA, 453 bp, Homo sapiens
  misc_feature: GYAE6OF01EYG1H.45.67.G01.1.454.CMB.1.raw
  modified_base (442)..(442): a, c, t, g, unknown or other
  misc_feature (442)..(442): n is a, c, g, or t
  modified_base (448)..(453): a, c, t, g, unknown or other
  misc_feature (448)..(453): n is a, c, g, or t
tcagacgcgatcgacacgaccggtgctcgatttagagtatacatattgggtttggggtctggagtgggtgggagccgtctcaaaggatggagataaaacatatttcgcagactccgtgtggcgccgattcaccatctccagaaacaatcccgggaacaccctacatctccacatgaaatccctgagaccggaggacacggctgtttatttctgtgccagaggtcgaaggatggcgtggggcgaactcaatccctccgaatactactactacatggacgcctggggcaaagggacctcggtcgccgtctcctcagcttccaccaagggcccatcggtcttcccctggcgccctgctccaggagcacctctgggggcacagcggccctgggctgcctggtcaaggactacttcctcgatcgcgtctgagcgggctggcaaggcncatagnnnnnn

SEQ ID NO: 259653 - DNA, 283 bp, Homo sapiens
  misc_feature: GYAE6OF01DP108.45.67.G01.1.454.CMB.1.raw
  modified_base (275)..(283): a, c, t, g, unknown or other
  misc_feature (275)..(283): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagccgaacggacgtcgtccccgtcccggttcgactccttcgttccctacccctccctcctcgtactcgtccgtctcgaggcgggccgtggcgaacggacggccatagnnnnnnnnn

SEQ ID NO: 259654 - DNA, 462 bp, Homo sapiens
  misc_feature: GYAE6OF01BY609.45.67.G01.1.454.CMB.1.raw
  modified_base (453)..(462): a, c, t, g, unknown or other
  misc_feature (453)..(462): n is a, c, g, or t
tcagacgcgatcgacacgaccggtgctcgatttagagtatacatattgggtttggggtctggagtgggtgggagccgtctcaaaggatggagataaaacatatttcgcagactccgtgtggcgccgattcaccatctccagaaacaatcccgggaacaccctacatctccacatgaaatccctgagaccggaggacacggctgtttatttctgtgccagaggtcgaaggatggcgtggggcgaactcaatccctccgaatactactactacatggacgcctggggcaaagggacctcggtcgccgtctcctcagcttccaccaagggcccatcggtcttccccctggcgccctgcctccaggagcacctctgggggcacagcggccctgggctgcctggtcaaggactacttcctcgatcgcgtctgagcgggctgggcaagggcgcagtagnnnnnnnnnn

SEQ ID NO: 259655 - DNA, 448 bp, Homo sapiens
  misc_feature: GYAE6OF01D0ITC.45.67.G01.1.454.CMB.1.raw
  modified_base (332)..(332): a, c, t, g, unknown or other
  misc_feature (332)..(332): n is a, c, g, or t
  modified_base (346)..(346): a, c, t, g, unknown or other
  misc_feature (346)..(346): n is a, c, g, or t
  modified_base (440)..(448): a, c, t, g, unknown or other
  misc_feature (440)..(448): n is a, c, g, or t
tcagacgcgatcgacacgaccggtgctcgatttagagtatacatattgggtttgggggagccgtctcaaaggatggagataaaacatatttcgcagactccgtgtggcgccgattcaccatctccagaaacaatcccgggaacaccctacatctccacatgaaatccctgagaccggaggacacggctgttatttctgtgccagaggtcgaaggatggcgtggggcgaactcaatccctccgaatactactactacatggacgccgtgggcaaagggacctcggtcgccgtctcctcagcttccaccaagggcccatcggtcttcccctgcnccctgctccaggancacctcgtgggggcacgagcggcccgtgggctgcctggtcaaggactacttcctcgatcgcgtctgtacgcgggcgtggcaaggcgacataggnnnnnnnnn

SEQ ID NO: 259656 - DNA, 249 bp, Homo sapiens
  misc_feature: GYAE6OF01DN14Z.45.67.G01.1.454.CMB.1.raw
  modified_base (246)..(249): a, c, t, g, unknown or other
  misc_feature (246)..(249): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccgccctcctctcgatcgcgtctgagcgggctggcaaggcgcatagnnnn

SEQ ID NO: 259657 - DNA, 246 bp, Homo sapiens; identical to SEQ ID NO: 259643
  misc_feature: GYAE6OF01ES7SE.45.67.G01.1.454.CMB.1.raw
  modified_base (246)..(246): a, c, t, g, unknown or other
  misc_feature (246)..(246): n is a, c, g, or t

SEQ ID NO: 259658 - DNA, 249 bp, Homo sapiens
  misc_feature: GYAE6OF01EBIS7.45.67.G01.1.454.CMB.1.raw
  modified_base (245)..(249): a, c, t, g, unknown or other
  misc_feature (245)..(249): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgccccctggtcactctgttcccgccctcctctcgatcgcgtctgagcgggctggcaaggcgcatagnnnnn

SEQ ID NO: 259659 - DNA, 248 bp, Homo sapiens; identical to SEQ ID NO: 259626
  misc_feature: GYAE6OF01E0QZB.45.67.G01.1.454.CMB.1.raw
  modified_base (246)..(248): a, c, t, g, unknown or other
  misc_feature (246)..(248): n is a, c, g, or t

SEQ ID NO: 259660 - DNA, 246 bp, Homo sapiens
  misc_feature: GYAE6OF01BDLG4.45.67.G01.1.454.CMB.1.raw
  modified_base (245)..(246): a, c, t, g, unknown or other
  misc_feature (245)..(246): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgcccctcggtcactctgttcccaccctcctctcgatcgcgtctgagcgggctggcaaggcgcatagnn

SEQ ID NO: 259661 - DNA, 249 bp, Homo sapiens
  misc_feature: GYAE6OF01DOOV5.45.67.G01.1.454.CMB.1.raw
  modified_base (246)..(249): a, c, t, g, unknown or other
  misc_feature (246)..(249): n is a, c, g, or t
tcagacgcgatcgacacgaccggtgctcgatttagagtatacatattgggtttgggggtgtggtggtctccactcccgccttgacgaggccgactattactgcggaacgtgggatgtccttctatttgcggtgttcggcggagggaccagattgaccgtcctgggtcagcccaaggctgccccctcggtcactctgttcccgccctcctctcgatcgcgtctgagcgggctggcaaggcgcatagnnnn

SEQ ID NO: 259662 - DNA, 257 bp, Homo sapiens
  misc_feature: GYAE6OF01E25OH.45.67.G01.1.454.CMB.1.raw
  modified_base (253)..(257): a, c, t, g, unknown or other
  misc_feature (253)..(257): n is a, c, g, or t
tcagacgcgatcgacacgaccggtgctcgatttagagtatacatattgggtttggggggtgtggtggtctccactcccgccttgacgaggccgactattactgcggaacgtgggatgtccgtctatttgcggtgttcggcgggagggaccagattcgaccgtccgtgggtcagcccaaggctcgccccctcggtcactctcgttcccaccctctctcgatcgcgtctgaggcgggctggcaaggcgacatagnnnnn

SEQ ID NO: 259663 - DNA, 250 bp, Homo sapiens
  misc_feature: GYAE6OF01BN5HC.45.67.G01.1.454.CMB.1.raw
  modified_base (246)..(250): a, c, t, g, unknown or other
  misc_feature (246)..(250): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgccccctggtcactctcgttcccgccctcctctcgatcgcgtctgagcgggctggcaaggcgcatagnnnnn

SEQ ID NO: 259664 - DNA, 226 bp, Homo sapiens
  misc_feature: GYAE6OF01CV13I.45.67.G01.1.454.CMB.1.raw
  modified_base (220)..(226): a, c, t, g, unknown or other
  misc_feature (220)..(226): n is a, c, g, or t
tcagacgcgatcgacacgaccggtgctcgatttagagtatacatattgggcttggggcaaagggacctcggtcgccgtctcctcagcttccaccaagggcccatcggtcttccccctggcgccctgctccaggagcacctctggggcacagcggccctgggctgcctggtcaaggactacttcctcgatcgcgtctgagcgggctggcaaggcgcatagnnnnnnn

SEQ ID NO: 259665 - DNA, 471 bp, Homo sapiens
  misc_feature: GYAE6OF01ES45J.45.67.G01.1.454.CMB.1.raw
  modified_base (454)..(454): a, c, t, g, unknown or other
  misc_feature (454)..(454): n is a, c, g, or t
  modified_base (460)..(471): a, c, t, g, unknown or other
  misc_feature (460)..(471): n is a, c, g, or t
tcagacgcgatcgacacgaccggtgctcgatttagagtatacatattgggtttggggtctggagtgggtgggagccatctcaaaggatggagataaaacatatttcgcagactccttgtggcgccgattcaccatctccagaaacaatcccgggaacaccctacatctccacatgaaatccctgagaccggaggacacggctgtttatttctgtgccagaggtcgaaggatggcgtgggggcgaactcaatccctccgaatactactactacatggacgcctggggcaaagggacctcggtcgccgtctcctcagcttccaccaagggcccatctgtcttcccctggcgccctcgctccaggacgcacctcgtgggggcacgagccggcccgtgggcctcgccgtgggtcaagggactaccttcctcgatcgcgtctgagcggctggcaaggcncatagnnnnnnnnnnnn

SEQ ID NO: 259666 - DNA, 252 bp, Homo sapiens
  misc_feature: GYAE6OF01BX08O.45.67.G01.1.454.CMB.1.raw
  modified_base (247)..(252): a, c, t, g, unknown or other
  misc_feature (247)..(252): n is a, c, g, or t
tcagacgcgatcgacacgaccggtgctcgatttagagtatacatattgggtttggggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccaccctcctctcgatcgcgtctgagcgggctggcaaggcgcatagnnnnnn

SEQ ID NO: 259667 - DNA, 245 bp, Homo sapiens
  misc_feature: GYAE6OF01AO99G.45.67.G01.1.454.CMB.1.raw
  modified_base (245)..(245): a, c, t, g, unknown or other
  misc_feature (245)..(245): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgccccctggtcactctgttcccaccctcctctcgatcgcgtctgagcgggctggcaaggcgcatagn

SEQ ID NO: 259668 - DNA, 253 bp, Homo sapiens
  misc_feature: GYAE6OF01EFUKV.45.67.G01.1.454.CMB.1.raw
  modified_base (245)..(253): a, c, t, g, unknown or other
  misc_feature (245)..(253): n is a, c, g, or t
tcagacgcgatcgacacgaccggtgctcgatttagagtatacatattgggtttggggggtgtggtggtctccactcccgccttgacgaggccgactattactgcggaacgtgggatgtccgtctatttgcggtgttcggcggagggaccagattgaccgtcctgggtcagcccaaggctgccccctggtcactctgttcccaccctctctcgatcgcgtctgagcgggctggcaaggcgcatagnnnnnnnnn

SEQ ID NO: 259669 - DNA, 594 bp, Homo sapiens
  misc_feature: GYAE6OF01C5H2P.45.67.G01.1.454.CMB.1.raw
  modified_base (267)..(267): a, c, t, g, unknown or other
  misc_feature (267)..(267): n is a, c, g, or t
  modified_base (359)..(359): a, c, t, g, unknown or other
  misc_feature (359)..(359): n is a, c, g, or t
  modified_base (492)..(492): a, c, t, g, unknown or other
  misc_feature (492)..(492): n is a, c, g, or t
  modified_base (529)..(529): a, c, t, g, unknown or other
  misc_feature (529)..(529): n is a, c, g, or t
  modified_base (550)..(550): a, c, t, g, unknown or other
  misc_feature (550)..(550): n is a, c, g, or t
  modified_base (564)..(564): a, c, t, g, unknown or other
  misc_feature (564)..(564): n is a, c, g, or t
tcagacgcgatcgacacgaccggtgctcgatttagagtatacatattgggtttgggctctgggcaccgtgggcatgggggaggtgtgtcacaagatttgggctctgggcaccgtgggcacgggggaggcgtggtccagccgggggggtctctgagactctcctgcgctgcctctggattcaccttcagtgcttatgctctccactcgggtccgccgaggggccaggcaaggggtctgggaggtggggtgggagccgtctcgaaaggntgggagaataaaacattattcgcagactccggtgtcggcgccgattccacctactctccaagaaaacaacgtccccgggaaacaccctaacntcctccaacatagaaactccctagacgaaccggaggacacggtctgttttacttcgtgtcgccaggacggtcggaaggtagtggcggtgggacgaactcaactccctacgaactactactactacatggaccncgtacgggacaacgggccgtcggtccgcctcctctcncgtccttaccacgacggcccngtccgtcctcccgnggcccgtcctggctccgacgcgtcctaccg

SEQ ID NO: 259670 - DNA, 249 bp, Homo sapiens; identical to SEQ ID NO: 259656
  misc_feature: GYAE6OF01AU2F6.45.67.G01.1.454.CMB.1.raw
  modified_base (246)..(249): a, c, t, g, unknown or other
  misc_feature (246)..(249): n is a, c, g, or t

SEQ ID NO: 259671 - DNA, 540 bp, Homo sapiens
  misc_feature: GYAE6OF01BHRRR.45.67.G01.1.454.CMB.1.raw
  modified_base (389)..(389): a, c, t, g, unknown or other
  misc_feature (389)..(389): n is a, c, g, or t
  modified_base (513)..(540): a, c, t, g, unknown or other
  misc_feature (513)..(540): n is a, c, g, or t
tcagacgcgatcgacacgaccggtgctcgatttagagtatacatattgggtttggggtctggagtgggtgggagccgtctcaaaggatggggataaaacatatttcgcagactccgtgtggcgccgattcaccatctccagaaacaatcccgggaacaccctacatctccacatgaaatccctgagaccggaggacacggctgtttattctgtgccagaggtcgaaggatggcgtggggcgaactcaactccctacgaatactactactacatggacgccgtgggcaaagggacctcggtcgccgtctcctcacgtccttaccaccgaacgggccccagtccggttcccttccccccgtcgggcccgtcccctcgcctaccgagggacnccaccgtcgtcgggggcacgacggccgcccgtcgggctcgccgtggtacgaaggtaccttacttccgtacgacgtccgacgttctaggacggcgggcgtcgggacgaaggccgagaagtaggcnnnnnnnnnnnnnnnnnnnnnnnnnnnn

SEQ ID NO: 259672 - DNA, 638 bp, Homo sapiens
  misc_feature: GYAE6OF01BY95C.45.67.G01.1.454.CMB.1.raw
  modified_base (265)..(265): a, c, t, g, unknown or other
  misc_feature (265)..(265): n is a, c, g, or t
  modified_base (345)..(345): a, c, t, g, unknown or other
  misc_feature (345)..(345): n is a, c, g, or t
  modified_base (401)..(401): a, c, t, g, unknown or other
  misc_feature (401)..(401): n is a, c, g, or t
  modified_base (404)..(404): a, c, t, g, unknown or other
  misc_feature (404)..(404): n is a, c, g, or t
  modified_base (420)..(420): a, c, t, g, unknown or other
  misc_feature (420)..(420): n is a, c, g, or t
  modified_base (476)..(476): a, c, t, g, unknown or other
  misc_feature (476)..(476): n is a, c, g, or t
tcagacgcgatcgacacgaccggtgctcgatttagagtatacatattgggtttgggctctgggcaccgtgggcatgggggaggtgtgtcacaagatttgggctctgggcaccgtgggcacgggggaggcgtggtccagccgggggggtctctgagactctcctgcgctgcctctggattcaccttcagtgcttatgctctccactgggtccgccgaggggccaggcaagggtctgggagtggggtgggagccgtctacgaaaggntggagaataaaacattatttcgcagactccgtgtggcgccgattcaccatcctcaagaaacacgtcccggaacaccctanactcctaccacatacgaaactcccgtagacgaccggagacacggcttgtttattcngtnaccaggagtcgaaggngtggcggtgggacaccgtcgaactcccgtacgtaatactactactacagtcggacnccgtagggaccgtaaacgggccctcgggtccgccgttcctccgtaccgacgtcccttacccgaacccggaaccgggtccctaacggttcccggttcccctttccccccggcggaccccgtccccgtacggtccccgtaccggacggccgtcccgtaccccgg

SEQ ID NO: 259673 - DNA, 267 bp, Homo sapiens
  misc_feature: GYAE6OF01ACVXR.45.67.G01.1.454.CMB.1.raw
  modified_base (250)..(250): a, c, t, g, unknown or other
  misc_feature (250)..(250): n is a, c, g, or t
  modified_base (252)..(267): a, c, t, g, unknown or other
  misc_feature (252)..(267): n is a, c, g, or t
tcagacgcgatcgacacgaccggtgctcgatttagagtatacatattgggtttgggggtgtggtggtctccactcccgccttgacgaggccgactagttactgcggaacgtgggatgtccgtctatttgcggtgttcggcggagggaccagacttgaccgtcctgggtcagcccaaggctgccccctggtccactctgttcccgccctcctctccgatcgcgtctgagcgggctggccaaggcgcatagntnnnnnnnnnnnnnnnn

SEQ ID NO: 259674 - DNA, 227 bp, Homo sapiens
  misc_feature: GYAE6OF01BM3TD.45.67.G01.1.454.CMB.1.raw
  modified_base (219)..(227): a, c, t, g, unknown or other
  misc_feature (219)..(227): n is a, c, g, or t
tcagacgcgatcgacacgaccggtgctcgatttagagtatacatattgggtttgggggaagaggaagactgacggtcctcccaggagttcaggtgctgggcaccttgggcgacgggggaggtgtgtcacaagatttgggctctgggcacagcggccctgggctgcctggtcaaggctacttcctcgatcgcgtctgagcgggctggcaaggcgcatagnnnnnnnnn

SEQ ID NO: 259675 - DNA, 188 bp, Homo sapiens
  misc_feature: GYAE6OF01B31MC.45.67.G01.1.454.CMB.1.raw
  modified_base (181)..(188): a, c, t, g, unknown or other
  misc_feature (181)..(188): n is a, c, g, or t
tcagacgcgatcgacacgaccggtgctcgatttagagtatacatattgggtttggctctgggcaccgtgggcatgggggaggtgtgtcacaagatttgggctctgggcacagcggccctgggctgcctggtcaaggactacttcctcgatcgcgtctgagcgggctggcaaggcgcatagnnnnnnnn

SEQ ID NO: 259676 - DNA, 517 bp, Homo sapiens
  misc_feature: GYAE6OF01AL0RQ.45.67.G01.1.454.CMB.1.raw
  modified_base (499)..(499): a, c, t, g, unknown or other
  misc_feature (499)..(499): n is a, c, g, or t
  modified_base (501)..(517): a, c, t, g, unknown or other
  misc_feature (501)..(517): n is a, c, g, or t
tcagacgcgatcgacacgaccggtgctcgatttagagtatacatattgggtttggggtctggagtgggtgggagccgtctcaaaggatggagataaaacatatttcgcagactccgtgtggcgccgattcaccatctccagaaacaatcccgggaacaccctacatctccacatgaaatccctgagaccggaggacacggctgtttatttctgtgccagaggtcgaaggatggcgtggggcgaactcaatccctcgaatacctactactacatggacgcctgggcaaagggacctcggtcgccggtctcctcagtcctccaccgaacggcccagtccggttccttcccccgtggccgtccccgtgccctccgacggcgccaccctcgtcgggggcacgacggccggtcccgtgggcctcggcccgttggtaccgaacggtaccttaccttccctactcgcttacgtcgtaggcgcgggctgggacgacggccgcatagntnnnnnnnnnnnnnnnnn

SEQ ID NO: 259677 - DNA, 624 bp, Homo sapiens
  misc_feature: GYAE6OF01ANTXE.45.67.G01.1.454.CMB.1.raw
  modified_base (93)..(93): a, c, t, g, unknown or other
  misc_feature (93)..(93): n is a, c, g, or t
  modified_base (222)..(222): a, c, t, g, unknown or other
  misc_feature (222)..(222): n is a, c, g, or t
  modified_base (537)..(537): a, c, t, g, unknown or other
  misc_feature (537)..(537): n is a, c, g, or t
  modified_base (554)..(554): a, c, t, g, unknown or other
  misc_feature (554)..(554): n is a, c, g, or t
  modified_base (609)..(609): a, c, t, g, unknown or other
  misc_feature (609)..(609): n is a, c, g, or t
  modified_base (614)..(614): a, c, t, g, unknown or other
  misc_feature (614)..(614): n is a, c, g, or t
  modified_base (617)..(617): a, c, t, g, unknown or other
  misc_feature (617)..(617): n is a, c, g, or t
tcagacgcgatcgacacgaccggtgctcgatttagagtatacatattgggtctggagtgggtgggagccgtctcaaaggatggagataaaacntatttcgcagactccgtgtggcgccgattcaccatctccagaaacatcccgggaacaccctacatctccacatgaaactccctgagaccggagacacggctgtttattctgtgccagaggtcgaaggtntggcgtggggactaacgtcaactccctacgaatacctactactacatcggacgccgtgggacaaacgggcctcggtcgccgtctcctcagtcctccaccgaacggccctacgtccggtccttccccgcggccgcccgtcgtcctccgaggacgccgtaccgtcggtcggggccacgacggtccggcccgtcgggcgtcggtccgtgggtacgtaacggtccttaccgttcccgtacggtacgttccggtccggttccgtacgggtccggaccgggtcgtaccgggaccgtacgggccgtacgacgtacggcgtcncgtcgcgtcgctacggngtcgtagctacgactcgacgcgtacgcgtacgtcgcttacggcctgacgtcgacngaccncgngtcgtcg

SEQ ID NO: 259678 - DNA, 248 bp, Homo sapiens
  misc_feature: GYAE6OF01B5391.45.67.G01.1.454.CMB.1.raw
  modified_base (247)..(248): a, c, t, g, unknown or other
  misc_feature (247)..(248): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctattttgcggtgttcggcggagggaccagattgaccgtcctgggtcagcccaaggctgccccctcggtcactctgttcccgccctcctctcgatcgcgtctgagcgggctggcaaggcgcatagnn

SEQ ID NO: 259679 - DNA, 968 bp, Homo sapiens
  misc_feature: GYAE6OF01DTH0L.45.67.G01.1.454.CMB.1.raw
  modified_base (919)..(919): a, c, t, g, unknown or other
  misc_feature (919)..(919): n is a, c, g, or t
  modified_base (925)..(926): a, c, t, g, unknown or other
  misc_feature (925)..(926): n is a, c, g, or t
  modified_base (931)..(931): a, c, t, g, unknown or other
  misc_feature (931)..(931): n is a, c, g, or t
  modified_base (934)..(934): a, c, t, g, unknown or other
  misc_feature (934)..(934): n is a, c, g, or t
  modified_base (936)..(936): a, c, t, g, unknown or other
  misc_feature (936)..(936): n is a, c, g, or t
  modified_base (938)..(938): a, c, t, g, unknown or other
  misc_feature (938)..(938): n is a, c, g, or t
  modified_base (940)..(940): a, c, t, g, unknown or other
  misc_feature (940)..(940): n is a, c, g, or t
  modified_base (943)..(943): a, c, t, g, unknown or other
  misc_feature (943)..(943): n is a, c, g, or t
  modified_base (947)..(947): a, c, t, g, unknown or other
  misc_feature (947)..(947): n is a, c, g, or t
  modified_base (949)..(949): a, c, t, g, unknown or other
  misc_feature (949)..(949): n is a, c, g, or t
  modified_base (953)..(954): a, c, t, g, unknown or other
  misc_feature (953)..(954): n is a, c, g, or t
  modified_base (959)..(960): a, c, t, g, unknown or other
  misc_feature (959)..(960): n is a, c, g, or t
  modified_base (962)..(965): a, c, t, g, unknown or other
  misc_feature (962)..(965): n is a, c, g, or t
  modified_base (967)..(967): a, c, t, g, unknown or other
  misc_feature (967)..(967): n is a, c, g, or t
tcagacgcgatcgacacgaccggtgctcgatttagagtatacatattgggtttggggtctggagtgggtgggagccgtctcaaaggatggagaataaaacattatttcgcagactccgtgtggcgccgattcaccatctaccagaaacaacgtcccggaacaccctacatcctccacatagaaactccctggaacgaccggaggaccacggtcttgttttatttcgtgtcgccgtaaggacggtacggaaagggtagtcggggtcgggtacggggggtaccgtaaaccttaccgaaacccgtttcccccgtaaccggtaaaactttaaccttaaaccttaaaccgttaaccgtaggttaccggggtaacccggtccggggttaacggggggaaaaccggtaaaaaccggggggttaccccggttccgggggttccccggttcccccggtttcccgttaccccgttaccggtaaccccgggtttcccctttaaaccccccggaaaacccgggtaaaccccggggtacccccttaaacccgggtttttcccccccgggttttacccccccgtttttacccccccccgggtcggggtccccccgttaacccccggttccggggttacccccttaaccggggaaacccgggtccgtaccccggttaaccccgggtttcggggggaccggggggaacccctaacccgggccggggtcccccggggcccccggtttggggtcccgttacgggtccccgggttaacgggaaccggttaaaccggtttaacccttacccggtttcccggttaccgggtaccgtttccccgggacgtttcccggggtaacggggtaccgggggtcccggggtaccgggttcccgggaaacgggtaaccggggaccggtaacgtaacggcggagtccgngcgcgnngcgcncgngngngncgntcgngngcgnngcgcnntnnnngnc

SEQ ID NO: 259680 - DNA, 572 bp, Homo sapiens
  misc_feature: GYAE6OF01CRG9O.45.67.G01.1.454.CMB.1.raw
  modified_base (550)..(572): a, c, t, g, unknown or other
  misc_feature (550)..(572): n is a, c, g, or t
tcagacgcgatcgacacgaccggtgctcgatttagagtatacatattgggtttgggggtctggagtgggtgggagccgtctcaaaggatggagataaaaacatatttcgcagactccgtgtggcgccgattcaccatctccagaaacaatcccgggaacaccctacatctccacatgaaatccctgagaccggaggacacggctgtttatttctgtgccagaggtcgaaggatggcgtggggcgaactcaactccctccgaatactactactacatggacgccgtggggacaaacggggacctcggtccgcccgtcctccctcagtccttcccaccgacgggcccacgtccggtcctttcccccgtggcccgcccctcgcctccgaggacgccacccgtcgtcgggggccaacgacggccggccccgtggggtcctcggcccgtcggtaccgaaacggtacccttacctttcccgtaccggtactcccggtccggttccgtgggaccgggccggggtccgtcgggaccgaacggggccgacaagtacggnnnnnnnnnnnnnnnnnnnnnnn

SEQ ID NO: 259681 - DNA, 493 bp, Homo sapiens
  misc_feature: GYAE6OF01ELDFJ.45.67.G01.1.454.CMB.1.raw
  modified_base (458)..(458): a, c, t, g, unknown or other
  misc_feature (458)..(458): n is a, c, g, or t
  modified_base (465)..(493): a, c, t, g, unknown or other
  misc_feature (465)..(493): n is a, c, g, or t
tcagacgcgatcgacacgaccggtgctcgatttagagtatacatattgggtttgtgggagccgtctcaaaggatggagataaaacatatttcgcagactccgtgtggcgccgattcaccatctccagaaacaatcccgggaacaccctacatctccacatgaaatccctgagaccggaggacacggctgtttatttctgtgccagaggtcgaaggatggcgtggggcaactcaatccctacgaatactactactacatggacgccgtgggcaaagggacctcggtcgccgtctcctcagcctccaccaagggccccatccggtcccttcccccgtgggcccgcccctcgcctcccgaggacgccaccgtcgtcggggcacgacgccggcccgtgggctcgccgtggtcaacggacttaccttcctcgacgtcgcgtcgtgacgcgggctggcgaggcncgatagnnnnnnnnnnnnnnnnnnnnnnnnnnnnn

SEQ ID NO: 259682 - DNA, 251 bp, Homo sapiens
  misc_feature: GYAE6OF01BCS35.45.67.G01.1.454.CMB.1.raw
  modified_base (247)..(251): a, c, t, g, unknown or other
  misc_feature (247)..(251): n is a, c, g, or t
tcagacgcgatcgacacgaccggtgctcgatttagagtatacatattgggtttgggggtgtggtggtctccactcccgccttgacgaggccgactattactgcggaacgtgggatggtccgtctatttgcggtgttcggcggagggaccagattgaccgtcctgggtcagcccaaggctgccccctcggtcactctgttcccgccctcctctcgatcgcgtctgagcgggctggcaaggcgcatagnnnnn

SEQ ID NO: 259683 - DNA, 231 bp, Homo sapiens
  misc_feature: GYAE6OF01CRTUS.45.67.G01.1.454.CMB.1.raw
  modified_base (184)..(184): a, c, t, g, unknown or other
  misc_feature (184)..(184): n is a, c, g, or t
  modified_base (214)..(214): a, c, t, g, unknown or other
  misc_feature (214)..(214): n is a, c, g, or t
  modified_base (220)..(231): a, c, t, g, unknown or other
  misc_feature (220)..(231): n is a, c, g, or t
tcagacgcgatcgacacgaccggtgctcgatttagagtatacatattgggtttggggggaagaggaagactgacggtcctcccaggagttcaggtgctgggcatcttgggcacgggggagtgtgtcacaagatttgggctctgggcacagcggccctgggctgcctggtcaaggactacttccncgatcgcgtctggagcgggctggcaaggcncatagnnnnnnnnnnnn

SEQ ID NO: 259684 - DNA, 534 bp, Homo sapiens
  misc_feature: GYAE6OF01EN09J.45.67.G01.1.454.CMB.1.raw
  modified_base (501)..(501): a, c, t, g, unknown or other
  misc_feature (501)..(501): n is a, c, g, or t
  modified_base (505)..(508): a, c, t, g, unknown or other
  misc_feature (505)..(508): n is a, c, g, or t
  modified_base (510)..(534): a, c, t, g, unknown or other
  misc_feature (510)..(534): n is a, c, g, or t
tcagacgcgatcgacacgaccggtgctcgatttagagtatacatattgggtttggggtctggagtgggtgggagccgtctcaaaggatggagataaaaacatatttcgcagactccgtgtggcgccgattcaccatctccagaaacaatcccgggaacaccctacatctccacatgaaatccctgagaccggaggacacggctgtttatttctgtgccagaggtcgaaggatggcgtggggcgaactcaactccctcgaatactactactacatggacgccgtggggacaaagggacctcggtcgccgtcctcctcacgtcttccaccaacggggcccagtcggtccttcccccgtggccgccctgcctccgacggacgccacccgtcgtacgggggcaccgagccggcccgtgggactcgccgtggtacaacgggtaccttaccttcccgtcgtactccggacgtcgtggacggcgggctaggcgaacggcgacatagcntcannnngnnnnnnnnnnnnnnnnnnnnnnnnn

SEQ ID NO: 259685 - DNA, 882 bp, Homo sapiens
  misc_feature: GYAE6OF01BH4N9.45.67.G01.1.454.CMB.1.raw
tcagacgcgatcgacacgaccggtgctcgatttagagtatacatattgggtttggggagctctgggagacgagcccagcactggaagtcgccggtgcttccatccggtgatcagcactgagcacagaggactcaccatggtagttggctgagttggtattttcctcgtcgcttacgttttaagaggtcgtacctaattcgtcgaggtgacgaaagtgggtggagggtcggggggaggtcggtcgggtccgacggggccgggggggtctcgtggacgtaccgtccgttccgtcggccgcgttcgtccgttcgtcggtacttccaccttcgagttcgtcttatcgccttctaccgtcgtcgggtccgaccggacgggccacggggacgtaacgggtcggttcgggtaggggttcgggtcggggtaccgtccggttacgtaaacggaaacgggtaggtaacggaaaggtaaacttaaaagtacgtttaacggttccggaacgtaacgtaccggttccgggtacgggtacggtccccggaccgtttacgttacccaaccgttaccgtaaccctaaccggaaaacgaaacccgtaacccgggtaacccccggtaaaacctaccccgtaaccgtaaccttacccggtaacccctaagtaacgttaaccgaacccgtttcccggtaacggaacccggggtacccgggtaaaccgtaaccggttaccggtttacgtttttaaccgttttacgtttaccgggtccgttaaaccggggccgggggttaaacgtaaccgtttacgttaaccgtagggttaaccgttacgggttttaacccgggtttggggtttaaactttaaacgggttaaccgtttaaccgttaaaaccccg

SEQ ID NO: 259686 - DNA, 193 bp, Homo sapiens
  misc_feature: GYAE6OF01CGJE8.45.67.G01.1.454.CMB.1.raw
  modified_base (183)..(193): a, c, t, g, unknown or other
  misc_feature (183)..(193): n is a, c, g, or t
tcagacgcgatcgacacgaccggtgctcgatttagagtatacatattgggtttgggctctgggcaccgtgggcatgggggaggtgtgtcaacaagatttgggctctgggcacagcggccctgggctgcctggtcaaggactacttcctcgatcgcgtctgagcgggctggcaaggcgcatagnnnnnnnnnnn

SEQ ID NO: 259687 - DNA, 664 bp, Homo sapiens
  misc_feature: GYAE6OF01A227M.45.67.G01.1.454.CMB.1.raw
  modified_base (140)..(140): a, c, t, g, unknown or other
  misc_feature (140)..(140): n is a, c, g, or t
  modified_base (605)..(605): a, c, t, g, unknown or other
  misc_feature (605)..(605): n is a, c, g, or t
  modified_base (621)..(621): a, c, t, g, unknown or other
  misc_feature (621)..(621): n is a, c, g, or t
  modified_base (626)..(626): a, c, t, g, unknown or other
  misc_feature (626)..(626): n is a, c, g, or t
  modified_base (632)..(632): a, c, t, g, unknown or other
  misc_feature (632)..(632): n is a, c, g, or t
  modified_base (645)..(645): a, c, t, g, unknown or other
  misc_feature (645)..(645): n is a, c, g, or t
  modified_base (649)..(649): a, c, t, g, unknown or other
  misc_feature (649)..(649): n is a, c, g, or t
  modified_base (654)..(654): a, c, t, g, unknown or other
  misc_feature (654)..(654): n is a, c, g, or t
tcagacgcgatcgacacgaccggtgctcgatttagagtatacatattggtttgggtctggagtgggtgggagcgtctcaaggagtggagataaaacatatttacgtcagactccgtgtggcgccgattcaccatctccanaaacaatacccggaacaccctacatctccacatgaaactccctgacgaccgaggaccacggcttgtttatttctgtgcagaggtcgaggatggcgtggggacactcgtaactcccgtcgaataacgtacttaacgcaagtacggaccgccgttcggggacgtaaacggaccgtcggtaccgccggtctccctacgacgtcctaccgtaccgaacggcccacgtcggtacccgttccccgtacggccgtcccgtcggtcccctaccgtcggtaaccgccgtaacccgtcggtccggggtacgaccgtacggtcccggtcccggtccggggttcgccggtcccggtttcggaacgtaacccggtaccgttacccgtttccgtaccggacggttcgacccgttcggtacgcgggttacgccgggtcgtacccggaacggtacgggcctaggtacgacgctagccgtcncgacgagtgcgcgcgngcgcncgcgcncgcgtgcgcgcgngtancgcgngcgcgtcgcg

SEQ ID NO: 259688 - DNA, 254 bp, Homo sapiens
  misc_feature: GYAE6OF01AX90R.45.67.G01.1.454.CMB.1.raw
  modified_base (224)..(254): a, c, t, g, unknown or other
  misc_feature (224)..(254): n is a, c, g, or t
tcagacgcgatcgacacgaccggtgctcgatttagagtatacatattgggtttggggggaagaggaagactgacggtcctcccaggagttcaggtgctgggcaccttgggcacgggggaggtgtgtcacaagatttgggctctgggcacagcggccctgggctgcctggtcaaggctacttcctcgatcgcgtctggagcgggctggacgaacggcgcagtagnnnnnnnnnnnnnnnnnnnnnnnnnnnnnnn

SEQ ID NO: 259689 - DNA, 902 bp, Homo sapiens
  misc_feature: GYAE6OF01AU6I0.45.67.G01.1.454.CMB.1.raw
tcagacgcgatcgacacgaccggtgctcgatttagagtatacatattgggtttgggctctgggcaccgtgggcagtgggggaggtgtgtcacaagtatttgggctctgggcaccggtgggcgacgggggaggcggtggtccgaggccggggggggtctcgtgaggacctctccgtgcgctcgcctctggtacttcctaccttcagtcgtcttagtgtcctctcccgtacggtcgggtccgaccgggacggggccgacgggacggtaacgggttcggtgggtagggtggggtcgggtccgtccgtacgtaggaaacgggtaggtaggaacgtaaacgtaaaacgttacgtttaacgtttcggaaccgtaacggttcccgttcggggttcggtacggcccggtaccggtactttacccgaacgtaccgtcccttaaccggaaacgtaaaccggtaacccggtacccgggaaaccctaccgtaacgtaccctactaccgaaacgtaactaaccgtaacctcccggtaacgggaccggtaacgggacgtaaccggtccgtttaacggtttactttacggtcgtacgtacggtaccgaagggtacggtacggtaacgggtaggtcgggtacggggtacggtacgtaacccttaacggtaccgtacccgtaaacgtacttaaccgtacgtaaaccgtcgtaaccggtacggtaaccggtacgggtaccggtaacggtaaccggttaccgggtccgtaccggtaccgtaccgttacgtaccgtacccgacccgttaaccgaacccggtaccggtacccgttaccggttacccgggtaccccttcccgggacccgtacccggtacccttcgggtaacccggtaccggaccggtacccgtcggtacccggg

SEQ ID NO: 259690 - DNA, 600 bp, Homo sapiens
  misc_feature: GYAE6OF01E2ESO.45.67.G01.1.454.CMB.1.raw
  modified_base (224)..(224): a, c, t, g, unknown or other
  misc_feature (224)..(224): n is a, c, g, or t
  modified_base (280)..(280): a, c, t, g, unknown or other
  misc_feature (280)..(280): n is a, c, g, or t
  modified_base (574)..(600): a, c, t, g, unknown or other
  misc_feature (574)..(600): n is a, c, g, or t
tcagacgcgatcgacacgaccggtgctcgattttagagtatacatattggggtttgggggagccgtctcaaaggatggagataaaacatatttcgcagactccgtgtggcgccgattcaccatctccagaaacaatcccgggaacaccctacatcctccacatgaaactcctgagaccggaggacacggcttagttttatttctgtgccaggaggtacgaaggngtgggcggtggggcgaactcaactccctaccgaatactactactacagtcggaccncggtagggacgaaacggaccgtcggtccggcccgtcctccctcgacgtccttacccaacccggtaaaccgggaccccgtacgttccgggttacccctttcccccggtacgggccccgtcccgtcgcccgtaccgtacggacgccaccgtcgggcggggaccaaccgacggcccggtcccggtcgggccgtgtcccgtacggtaaccgaacggtaacccgttaccttcccgacgtacgtcggtaccgttcgacggacggtccgggtacggacggacgaaacgcgacgtaagtagnnnnnnnnnnnnnnnnnnnnnnnnnnn

SEQ ID NO: 259691 - DNA, 1149 bp, Homo sapiens
  misc_feature: GYAE6OF01CF74H.45.67.G01.1.454.CMB.1.raw
  modified_base (157)..(157): a, c, t, g, unknown or other
  misc_feature (157)..(157): n is a, c, g, or t
tcagacgcgatcgacacgaccggtgctcgatttagagtatacatattgggtttgggggggaagaggaagactgacggtcctcccaggagttcaggtgctgggcaccttggcacggggaggcgtggtccagccggggggtctctgagactctcctgcnctgcctctggacttcaccttcagtgtacttatcgtctctccgacgtcgggtacccgccgacgggaccaggacgtaaggggttctagggcgggttggggacgggtacgtccggtacgtaacggaaaaggtagtagggtaaagtaacttaaaaaccgtgtttaacttttccggacgtaaacggtccgtttccgggtaaggttccgggcccgtaacccgttaacgtttaccccgaaccggtaaccttccgtaaccccgaaaaggttaaaaaccccaaccgggttacccccgggaaaacctacccgtaactacccggttaccctacccgtaaacgtacgttaaaccggtaaaccccttcccgtaacgggaaacccgggtaaaccggggaaccgggttaacccggtaacccggtttaccgtttttaacgggtttttacccgttttacggtttaccgggtttaccccgaaacggttacgggggtaaaaccgggttaacggtaaaaccggggtttgggttaccgggggtacccggggtttaacgggggtaacccggttaaacccgttaccggtaaaaccccggttaccccggttaaaaccggtaaaccgtttaaacccgttaaccgtttaaaccgtaacccggttagggtaacccggggacccggttaacccgggtaaccgggggttaaaccggtaccccggggtttaaacccgggttccccgggttaacccggcccggttttaacccccgacccggtttaacccgggtaacccgtttaccccgttaaaccccggtaccgggtaaaccccgggtccccgtttaaacccgggttcccggttttaccccccgtaaccccggttcccgggtaaccccccgggttccttacccggttaaaccccgggttaccccgttaaccggggacccccgttaaaccggggttacccccgggttaccgggggtaacccggggtccccggtaacgggggttaccccccgggg

SEQ ID NO: 259692 - DNA, 638 bp, Homo sapiens
  misc_feature: GYAE6OF01BYB39.45.67.G01.1.454.CMB.1.raw
  modified_base (381)..(381): a, c, t, g, unknown or other
  misc_feature (381)..(381): n is a, c, g, or t
tcagacgcgatcgacacgaccggtgctcgatttagagtatacatattgggtttgggctctgggcaccgtgggcatgggggaggtgtgtcacaagatttgggctctgggcaccgtgggcacgggggaggcgtggtccagccggggggggtctctgagactctcctgcgctgcctctggattcaccttcagtgcttatgctctccactgggtccgccaggggccaggcaagggtctggagtgggtgggagccgtctcaaaggatggagataaaacattattcgcagactcgtgtgcgcgattcacatctcagaacatccggaacacctacatctcacatagaaactccctgacgaccggtaggacacggctgtttattctgtnccagaggtacgaaggagtggcgtgggacgtaactcaactcccgtacgaattacgtactactactagtcggacgcccgtggggaacctaaaggggtacccgttacgggtccggacccggttcttaccgtcctaaggtccctttaccgaacccgtaaacggggccccctacggttcccgggttccctttccccccggtcgggtccccggcccccgttcggaccccttccggtaacgggaacgcccggttaaacccccgg

SEQ ID NO: 259693 - DNA, 425 bp, Homo sapiens
  misc_feature: GYAE6OF01BCIMM.45.67.G01.1.454.CMB.1.raw
  modified_base (334)..(334): a, c, t, g, unknown or other
  misc_feature (334)..(334): n is a, c, g, or t
  modified_base (366)..(367): a, c, t, g, unknown or other
  misc_feature (366)..(367): n is a, c, g, or t
  modified_base (370)..(373): a, c, t, g, unknown or other
  misc_feature (370)..(373): n is a, c, g, or t
  modified_base (375)..(425): a, c, t, g, unknown or other
  misc_feature (375)..(425): n is a, c, g, or t
tcagacgcgatcgacacgaccggtgctcgatttagagtatacatattgggtttggggctgtcctttggttttggagatggtttttctcgatggggggctggggagggtctttgttggagacccttgcacttgtactccttgccgttcagcccagtcctggtgcgagggacggtgaggaccgctacgaccacgaacggtacgtgtcttggttgtacctgtctcccgccctgcctccgaggacgcctacgtcgggtgggggaccacggccggccggtccggcgggtctcgtccgtcgggtactaacggtactttccgttcctcgattccgtcggtnagggcgcggggtcaggacgaggcgtcaagtgnncgnnnnannnnnnnnnnnnnnnnnnnnnnnnnnnnnnnnnnnnnnnnnnnnnnnnnnn

SEQ ID NO: 259694 - DNA, 211 bp, Homo sapiens
  misc_feature: GYAE6OF02IG16X.45.67.G01.1.454.CMB.1.raw
  modified_base (211)..(211): a, c, t, g, unknown or other
  misc_feature (211)..(211): n is a, c, g, or t
tcagacgcgatcgacacgaccggtgctcgatttagagtatacatattgggttgggaagaggagactgacggtcctccaggagttcaggtgctgggcaccttgggcacgggaggtgtgtcacaagatttggctctgggcacagcggccctgggctgcctggtcaaggactacttcctcgatcgcgtctgagcgggctggcaaggcgcatagn

SEQ ID NO: 259695 - DNA, 247 bp, Homo sapiens
  misc_feature: GYAE6OF02GGFN6.45.67.G01.1.454.CMB.1.raw
  modified_base (245)..(247): a, c, t, g, unknown or other
  misc_feature (245)..(247): n is a, c, g, or t
tcagacgcgatcgacacgaccggtgctcgatttagagtatacatattgggtttggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccgccctcctctcgatcgcgtctgagcgggctggcaaggcgcatagnnn

SEQ ID NO: 259696 - DNA, 248 bp, Homo sapiens
  misc_feature: GYAE6OF02F7WSH.45.67.G01.1.454.CMB.1.raw
  modified_base (245)..(248): a, c, t, g, unknown or other
  misc_feature (245)..(248): n is a, c, g, or t
tcagacgcgatcgacacgaccggtgctcgatttagagtatacatattgggtttggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccaccctcctctcgatcgcgtctgagcgggctggcaaggcgcatagnnnn

SEQ ID NO: 259697 - DNA, 244 bp, Homo sapiens
  misc_feature: GYAE6OF02GLWL4.45.67.G01.1.454.CMB.1.raw
  modified_base (244)..(244): a, c, t, g, unknown or other
  misc_feature (244)..(244): n is a, c, g, or t
tcagacgcgatcgacacgaccggtgctcgatttagagtatacatattgggtttggggtgtggtggtctccactcccgccttgacgaggccgactattactgcggaacgtgggatgtccgtctatttgcggtgttcggcggagggaccagattgaccgtcctgggtcagcccaaggctgcccctcggtcactctgttcccaccctcctctcgatcgcgtctgagcgggctggcaaggcgcatagn

SEQ ID NO: 259698 - DNA, 190 bp, Homo sapiens
  misc_feature: GYAE6OF02HSTAY.45.67.G01.1.454.CMB.1.raw
  modified_base (180)..(190): a, c, t, g, unknown or other
  misc_feature (180)..(190): n is a, c, g, or t
tcagacgcgatcgacacgaccggtgctcgatttagagtatacatattgggtttggctctgggcaccgtgggcatggggaggtgtgtcacaagatttgggctctgggcacagcggccctgggctgcctggtcaaggactacttcctcgatcgcgtctgagcgggctggcaaggcgcatagnnnnnnnnnnn

SEQ ID NO: 259699 - DNA, 248 bp, Homo sapiens
  misc_feature: GYAE6OF02GKU7K.45.67.G01.1.454.CMB.1.raw
  modified_base (245)..(248): a, c, t, g, unknown or other
  misc_feature (245)..(248): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccacctcctctcgatcgcgtctgagcgggctggcaaggcgcatagnnnn

SEQ ID NO: 259700 - DNA, 309 bp, Homo sapiens
  misc_feature: GYAE6OF02HQWU7.45.67.G01.1.454.CMB.1.raw
  modified_base (306)..(309): a, c, t, g, unknown or other
  misc_feature (306)..(309): n is a, c, g, or t
tcagacgcgatcgacacgaccggtgctcgatttagagtatacatattgggtttggggctgtcctttggttttggagatggttttctcgatgggggctgggagggctttgttggagaccttgcacttgtactccttgccgttcagccagtcctggtgcaggacggtgaggacgctgaccacacggaacgtgctgttgtactgctccgccctgctccaggagcacctctgggggcacagcggccctgggctgcctggtcaaggactacttcctcgatcgcgtctgagcgggctggcaaggcgcatagnnnn

SEQ ID NO: 259701 - DNA, 247 bp, Homo sapiens; identical to SEQ ID NO: 259631
  misc_feature: GYAE6OF02HTJPD.45.67.G01.1.454.CMB.1.raw
  modified_base (246)..(247): a, c, t, g, unknown or other
  misc_feature (246)..(247): n is a, c, g, or t

SEQ ID NO: 259702 - DNA, 247 bp, Homo sapiens
  misc_feature: GYAE6OF02JIJ1A.45.67.G01.1.454.CMB.1.raw
  modified_base (244)..(247): a, c, t, g, unknown or other
  misc_feature (244)..(247): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgcccctcggtcactctgttcccacctcctctcgatcgcgtctgagcgggctggcaaggcgcatagnnnn

SEQ ID NO: 259703 - DNA, 247 bp, Homo sapiens
  misc_feature: GYAE6OF02I6Q1W.45.67.G01.1.454.CMB.1.raw
  modified_base (245)..(247): a, c, t, g, unknown or other
  misc_feature (245)..(247): n is a, c, g, or t
tcagacgcgatcgacacgaccggtgctcgatttagagtatacatattgggtttgggggtgtggtggtctccactcccgccttgacgaggctgattatttctgttgctcatatgcagggaccagcacttgggtgttcggcggagggaccaggttgaccgtcctaggtcagcccaaggctgccccctcggtcactctgttcccacctcctctcgatcgcgtctgagcgggctggcaaggcgcatagnnn

SEQ ID NO: 259704 - DNA, 248 bp, Homo sapiens; identical to SEQ ID NO: 259626
  misc_feature: GYAE6OF02FWGC1.45.67.G01.1.454.CMB.1.raw
  modified_base (246)..(248): a, c, t, g, unknown or other
  misc_feature (246)..(248): n is a, c, g, or t

SEQ ID NO: 259705 - DNA, 256 bp, Homo sapiens
  misc_feature: GYAE6OF02HQEEG.45.67.G01.1.454.CMB.1.raw
  modified_base (242)..(256): a, c, t, g, unknown or other
  misc_feature (242)..(256): n is a, c, g, or t
tcagacgcgatcgacacgaccggtgctcgatttagagtatacatattgggtttggggtgtaggtggtctccactccgccttgacgaggccgactattactgcggaacgtgggatgtccgtctatttgcggtgttcggcggaggaccagattgaccgtcctgggtcagcccaaggctgccccctcggtcacgtctgttcccacctcctctcgatccgtctgagcggctggcaaggcgcatagnnnnnnnnnnnnnnn

SEQ ID NO: 259706 - DNA, 247 bp, Homo sapiens
  misc_feature: GYAE6OF02IPFHV.45.67.G01.1.454.CMB.1.raw
  modified_base (239)..(247): a, c, t, g, unknown or other
  misc_feature (239)..(247): n is a, c, g, or t
tcagacgcgatcgacacgaccggtgctcgatttagagtatacatattggtttggggtgtggtggtctcactccgccttgacgaggccgactattactgcggaacgtgggatgtccgtctatttgcggtgttcggcggagggaccagattgaccgtcctgggtcagcccaaggctgcccctggtcactctgttcccaccctcctctcgatcgcgtctgagcggctggcaaggcgcatagnnnnnnnnn

SEQ ID NO: 259707 - DNA, 244 bp, Homo sapiens
  misc_feature: GYAE6OF02IMM0T.45.67.G01.1.454.CMB.1.raw
  modified_base (223)..(244): a, c, t, g, unknown or other
  misc_feature (223)..(244): n is a, c, g, or t
tcagacgcgatcgacacgaccggtgctcgatttagagtatacatattgggtttgggggaacgaaggaagacctgacggtcctcccacggagttcaggtgctgggccaccttgggcacggggaggtgtgtcacaagatttgggctctgggcacagcggccctgggctgccctggtcaaggactacttcctcgatcgcgtctgagcggctggcaaggcgcatagnnnnnnnnnnnnnnnnnnnnnn

SEQ ID NO: 259708 - DNA, 247 bp, Homo sapiens; identical to SEQ ID NO: 259631
  misc_feature: GYAE6OF02H7TY6.45.67.G01.1.454.CMB.1.raw
  modified_base (246)..(247): a, c, t, g, unknown or other
  misc_feature (246)..(247): n is a, c, g, or t

SEQ ID NO: 259709 - DNA, 253 bp, Homo sapiens
  misc_feature: GYAE6OF02IDDEI.45.67.G01.1.454.CMB.1.raw
  modified_base (246)..(253): a, c, t, g, unknown or other
  misc_feature (246)..(253): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccaccctcctctcgatcgcgtctgagcgggctggcaaggcgcatagnnnnnnnn

SEQ ID NO: 259710 - DNA, 245 bp, Homo sapiens
  misc_feature: GYAE6OF02JFD45.45.67.G01.1.454.CMB.1.raw
  modified_base (245)..(245): a, c, t, g, unknown or other
  misc_feature (245)..(245): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccgccctcctctcgatcgcgctgagcgggctggcaaggcgcatagn

SEQ ID NO: 259711 - DNA, 245 bp, Homo sapiens
  misc_feature: GYAE6OF02F8T5X.45.67.G01.1.454.CMB.1.raw
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccaccctcctctcgatcgcgtctgagcgggctggcaaggcgcatag

SEQ ID NO: 259712 - DNA, 219 bp, Homo sapiens
  misc_feature: GYAE6OF02I5VB6.45.67.G01.1.454.CMB.1.raw
  modified_base (218)..(219): a, c, t, g, unknown or other
  misc_feature (218)..(219): n is a, c, g, or t
tcagacgcgatcgacacgaccggtgctcgatttagagtatacatattgggtttgggggaagaggaagactgacggtcctcccaggagttcaggtgctgggcaccttgggcacggggaggtgtgtcacaagatttgggctctgggcacagcggccctgggctgcctggtcaaggactacttcctcgatcgcgtctgagcgggctggcaaggcgcatagnn

SEQ ID NO: 259713 - DNA, 247 bp, Homo sapiens
  misc_feature: GYAE6OF02H9SO2.45.67.G01.1.454.CMB.1.raw
  modified_base (245)..(247): a, c, t, g, unknown or other
  misc_feature (245)..(247): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggaggaccagattgaccgtcctgggtcagcccaaggctgccccctcggtcactctgttcccgccctcctctcgatcgcgtctgagcgggctggcaaggcgcatagnnn

SEQ ID NO: 259714 - DNA, 248 bp, Homo sapiens; identical to SEQ ID NO: 259626
  misc_feature: GYAE6OF02HNZJ7.45.67.G01.1.454.CMB.1.raw
  modified_base (246)..(248): a, c, t, g, unknown or other
  misc_feature (246)..(248): n is a, c, g, or t

SEQ ID NO: 259715 - DNA, 184 bp, Homo sapiens
  misc_feature: GYAE6OF02G996O.45.67.G01.1.454.CMB.1.raw
  modified_base (182)..(184): a, c, t, g, unknown or other
  misc_feature (182)..(184): n is a, c, g, or t
tcagacgcgatcgacacgaccggtgctcgatttagagtatacatattgggtttgggctctgggcaccgtgggcatgggggaggtgtgtcacaagatttgggctctgggcacagcggccctgggctgcctggtcaaggactacttcctactgctagtctgagcgggctggcaaggcgcatagnnn

SEQ ID NO: 259716 - DNA, 440 bp, Homo sapiens
  misc_feature: GYAE6OF02FH7K3.45.67.G01.1.454.CMB.1.raw
  modified_base (436)..(440): a, c, t, g, unknown or other
  misc_feature (436)..(440): n is a, c, g, or t
tcagacgcgatcgacacgaccggtgctcgatttagagtatacatattgggtttgggggagccgtctcaaaggatggagataaaacatatttcgcagactccgtgtggcgccgattcaccatctccagaaacaatcccgggaacaccctacatctccacatgaaatccctgagaccggaggacacggctgtttatttctgtgccagaggtcgaaggatggcgtggggcgaactcaatccctccgaatactactactacatggacgcctggggcaaagggacctcggtcgccgtctcctcagcttccaccaagggcccatcggtcttccccctggcgccctgctccaggagcacctctggggcacagcggccctgggctgcctggtcaaggactacttcctcgatcgcgtctgagcgggctgggcaagggcgcatagnnnnn

SEQ ID NO: 259717 - DNA, 185 bp, Homo sapiens
  misc_feature: GYAE6OF02F1LYG.45.67.G01.1.454.CMB.1.raw
  modified_base (182)..(185): a, c, t, g, unknown or other
  misc_feature (182)..(185): n is a, c, g, or t
tcagacgcgatcgacacgaccggtgctcgatttagagtatacatattgggtttgggctctgggcaccgtgggcatgggggaggtgtgtcacaagatttgggctctgggcacagcggccctgggctgcctggtcaaggactacttcctcgatcgcgtctgagcgggctggcaaggcgcatagnnnn

SEQ ID NO: 259718 - DNA, 251 bp, Homo sapiens
  misc_feature: GYAE6OF02FGV8M.45.67.G01.1.454.CMB.1.raw
  modified_base (246)..(251): a, c, t, g, unknown or other
  misc_feature (246)..(251): n is a, c, g, or t
tcagacgcgatcgacacgaccggtgctcgatttagagtatacatattgggtttggggggtgtggtggtctccactcccgccttgacgaggccgactattactgcggaacgtgggatgtccgtctatttgcggtgttcggcggagggaccagattgaccgtcctgggtcagcccaaggctgccccctggtcactctgttcccaccctcctctcgatcgcgtctgagcgggctggcaaggcgcatagnnnnnn

SEQ ID NO: 259719 - DNA, 454 bp, Homo sapiens
  misc_feature: GYAE6OF02F24BB.45.67.G01.1.454.CMB.1.raw
  modified_base (448)..(454): a, c, t, g, unknown or other
  misc_feature (448)..(454): n is a, c, g, or t
tcagacgcgatcgacacgaccggtgctcgatttagagtatacatattgggtttggggtctggagtgggtgggagccgtctcaaaggatggagataaaacatatttcgcagactccgtgtggcgccgattcaccatctccagaaacaatcccgggaacaccctacatctccacatgaaatccctgagaccggaggacacggctgtttatttctgtgccagaggtcgaaggatggcgtgggggcgaactcaatccctccgaatactactactacatggacgcctggggcaaagggacctcggtcgccgtctcctcagcttccaccaaggcccatcggtcttccccctggcgccctgctccaggagcacctctgggggcacagcggccctgggctgcctggtcaaggactacttcctcgatcgcgtctgagcgggctggcaggcgcatagnnnnnnn

SEQ ID NO: 259720 - DNA, 262 bp, Homo sapiens
  misc_feature: GYAE6OF02IBIWN.45.67.G01.1.454.CMB.1.raw
  modified_base (245)..(262): a, c, t, g, unknown or other
  misc_feature (245)..(262): n is a, c, g, or t
tcagacgcgatcgacacgaccggtgctcgatttagagtatacatagttgggtttgggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccacctctctcgatcgcgtctgagcgggctggcaaggcgcatagnnnnnnnnnnnnnnnnnn

SEQ ID NO: 259721 - DNA, 564 bp, Homo sapiens
  misc_feature: GYAE6OF02I2L68.45.67.G01.1.454.CMB.1.raw
  modified_base (253)..(253): a, c, t, g, unknown or other
  misc_feature (253)..(253): n is a, c, g, or t
tcagacgcgatcgacacgaccggtgctcgatttagagtatacatattgggtttggggggaagaggaagactgacggtcctcccaggagttcaggtgctgggcaccttgggcacgggggaggcgtggtccagccgggggggtctctgagactctcctgcgctgcctctggattcaccttcagtgcttatgctctccactgggtccgccaggggccaggcaagggtctggagtgggtgggagccgtctcaaaggntggagataaaacatatttcgcagactccgtgtggcgccgattcaccatctccagaaacaatcccgggaacaccctacatctccacatgaaatccctgagaccggagacacggctgtttatttctgtgccagaggtcgaaggatgggcgtggggcgaactcaatccctcgaatactactactacatggacgctgggcaaaggcctcggtcgccgtctcctcacgtcttccaccgaacggcccacgtccggtccttccccgtcggccaccctcctaccaacgacgccaccgtcgtcggggcaccgagtcccgg

SEQ ID NO: 259722 - DNA, 248 bp, Homo sapiens; identical to SEQ ID NO: 259644
  misc_feature: GYAE6OF02FZ9ED.45.67.G01.1.454.CMB.1.raw
  modified_base (246)..(248): a, c, t, g, unknown or other
  misc_feature (246)..(248): n is a, c, g, or t

SEQ ID NO: 259723 - DNA, 249 bp, Homo sapiens
  misc_feature: GYAE6OF02IF4YR.45.67.G01.1.454.CMB.1.raw
  modified_base (242)..(249): a, c, t, g, unknown or other
  misc_feature (242)..(249): n is a, c, g, or t
tcagacgcgatcgacacgaccggtgctcgatttagagtatacatattggttggggtgtggtggtcgtcactccgccttgacgaggccgactatactgcggaacgtggatgtccgtctatttgcggtgttcggcggtagggaccgaggagttgaccgtcctgggtcaggcccaaggctgccccctggtcactctcgttccgccctctctcgatcgcgtctgagcggctggcaaggctcatagnnnnnnnn

SEQ ID NO: 259724 - DNA, 185 bp, Homo sapiens; identical to SEQ ID NO: 259717
  misc_feature: GYAE6OF02F5VOZ.45.67.G01.1.454.CMB.1.raw
  modified_base (182)..(185): a, c, t, g, unknown or other
  misc_feature (182)..(185): n is a, c, g, or t

SEQ ID NO: 259725 - DNA, 248 bp, Homo sapiens; identical to SEQ ID NO: 259626
  misc_feature: GYAE6OF02IXZSW.45.67.G01.1.454.CMB.1.raw
  modified_base (246)..(248): a, c, t, g, unknown or other
  misc_feature (246)..(248): n is a, c, g, or t

SEQ ID NO: 259726 - DNA, 628 bp, Homo sapiens
  misc_feature: GYAE6OF02H0MTE.45.67.G01.1.454.CMB.1.raw
tcagacgcgatcgacacgaccggtgctcgatttagagtatacatattgggtttgggggggaagaggaagactgacggtcctcccaggagttcaggtgctgggcaccttgggcacgggggaggcgtggtccagccgggggggtctctgagactctcctgcgctgcctctggattcaccttcagtgcttatgctctccacgtgggtccgccgaggggccaggcgaagggtctgggaggtggggtgggacgccgtctacgaaaggatggagaataaaacattattcgacagactccgtgtggcgcgattcacatctcagaaacaacgtacccgggaacaccctacactcctccacatagaaactccctagacgaccggagacacggctttgtttatttctgtcgaccaggtaggtacgaaggtagtgggcggtggggacgaactcaacgtccctacgaatactactactacagtcggacgccgtaggggacgaaacgggaccgtcgggtccgccgtcctcctacgacgtcctacccaaccgaacggacccacgtccgttcccttccccgtcggcccgtcccgtcgtccctaccgacggacgcctacccgtccggtcggggaccacgaccgg

SEQ ID NO: 259727 - DNA, 247 bp, Homo sapiens; identical to SEQ ID NO: 259631
  misc_feature: GYAE6OF02FJR34.45.67.G01.1.454.CMB.1.raw
  modified_base (246)..(247): a, c, t, g, unknown or other
  misc_feature (246)..(247): n is a, c, g, or t

SEQ ID NO: 259728 - DNA, 218 bp, Homo sapiens
  misc_feature: GYAE6OF02F0OCO.45.67.G01.1.454.CMB.1.raw
  modified_base (218)..(218): a, c, t, g, unknown or other
  misc_feature (218)..(218): n is a, c, g, or t
tcagacgcgatcgacacgaccggtgctcgatttagagtatacatattgggtttgggggaagaggaagactgacggtcctcccaggagttcaggtgctgggcaccttgggcacggggaggtgtgtcacaagatttgggctctgggcacagcggccctgggctgcctggtcaaggactacttcctcgatcgcgtctgagcgggctggcaaggcgcatagn

SEQ ID NO: 259729 - DNA, 441 bp, Homo sapiens
  misc_feature: GYAE6OF02HUHBD.45.67.G01.1.454.CMB.1.raw
  modified_base (435)..(441): a, c, t, g, unknown or other
  misc_feature (435)..(441): n is a, c, g, or t
tcagacgcgatcgacacgaccggtgctcgatttagagtatacatattgggtttgggggagccgtctcaaaggatggagataaaacatatttcgcagactccgtgtggcgccgattcaccatctccagaaacaatcccgggaacaccctacatctccacatgaaatccctgagaccggaggacacggctgtttatttctgtgccagaggtcgaaggatgggcgtggggcgaactcaatccctccgaatactactactacatggacgcctggggcaaagggacctcggtcgccgtctcctcagcttccaccaagggcccatcggtcttccccctggcgccctgctccaggagcacctctgggggcacagcggccctgggctgcctggtcaaggactactcctcgatcgcgtctgagcgggctggcaaggcgcatagnnnnnnn

SEQ ID NO: 259730 - DNA, 262 bp, Homo sapiens
  misc_feature: GYAE6OF02IX0ZW.45.67.G01.1.454.CMB.1.raw
  modified_base (240)..(240): a, c, t, g, unknown or other
  misc_feature (240)..(240): n is a, c, g, or t
  modified_base (246)..(262): a, c, t, g, unknown or other
  misc_feature (246)..(262): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgccccctggtcactctgttcccaccctcctctcgatccgcgtctgagcgggctggcaaggcncatagnnnnnnnnnnnnnnnnn

SEQ ID NO: 259731 - DNA, 250 bp, Homo sapiens
  misc_feature: GYAE6OF02HKG3C.45.67.G01.1.454.CMB.1.raw
  modified_base (246)..(250): a, c, t, g, unknown or other
  misc_feature (246)..(250): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccgccctcctctcgatcgcgtctgagcgggctggcaaggcgcatagnnnnn

SEQ ID NO: 259732 - DNA, 248 bp, Homo sapiens
  misc_feature: GYAE6OF02H2XUW.45.67.G01.1.454.CMB.1.raw
  modified_base (245)..(248): a, c, t, g, unknown or other
  misc_feature (245)..(248): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgccccctggtcactctgttcccgccctcctctcgatcgcgtctgagcgggctggcaaggcgcatagnnnn

SEQ ID NO: 259733 - DNA, 281 bp, Homo sapiens
  misc_feature: GYAE6OF02F2SBY.45.67.G01.1.454.CMB.1.raw
  modified_base (253)..(281): a, c, t, g, unknown or other
  misc_feature (253)..(281): n is a, c, g, or t
tcagacgcgatcgacacgaccggtgctcgatttagagtatacatattggggtttggggggtgtggtggtctccactcccgccttggacgaggccgaacctattactgcggaacgtgggatgtccgtctattttgcggtgttcggcggagggaccagattgaccgtacctgggtcagcccaaggctgccccctcggtcactctgttcccaccctcctctcgatcgcgtctgagcgggctggcaaggcgcatagnnnnnnnnnnnnnnnnnnnnnnnnnnnnn

SEQ ID NO: 259734 - DNA, 247 bp, Homo sapiens
  misc_feature: GYAE6OF02FRG0S.45.67.G01.1.454.CMB.1.raw
  modified_base (244)..(247): a, c, t, g, unknown or other
  misc_feature (244)..(247): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccgccctcctccatcgcgtctgagcgggctggcaaggcgcatagnnnn

SEQ ID NO: 259735 - DNA, 303 bp, Homo sapiens
  misc_feature: GYAE6OF02HMD29.45.67.G01.1.454.CMB.1.raw
  modified_base (250)..(250): a, c, t, g, unknown or other
  misc_feature (250)..(250): n is a, c, g, or t
  modified_base (256)..(258): a, c, t, g, unknown or other
  misc_feature (256)..(258): n is a, c, g, or t
  modified_base (261)..(303): a, c, t, g, unknown or other
  misc_feature (261)..(303): n is a, c, g, or t
tcagacgcgatcgacacgaccggtgctcgatttagagtatacatattgggtttggggggtggtggtggtctccactcccgccttgacgaggccgactattactgcggaacgtgggatgtccgtctattttgccggtgttcggcggagggaccaggattgaccgttcctgggtcagcccaaggtctgccccctcggtcactctgttcccaccctcctcgtcgatcgcgtctgagcgggctgggcaaaggcnctatgnnntgnnnnnnnnnnnnnnnnnnnnnnnnnnnnnnnnnnnnnnnnnnn

SEQ ID NO: 259736 - DNA, 255 bp, Homo sapiens
  misc_feature: GYAE6OF02IY7A7.45.67.G01.1.454.CMB.1.raw
  modified_base (247)..(255): a, c, t, g, unknown or other
  misc_feature (247)..(255): n is a, c, g, or t
tcagacgcgatcgacacgaccggtgctcgatttagagtatacatattgggtttggggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccaccctcctctcgatcgcgtctgagcgggctggcaaggcgcatagnnnnnnnnn

SEQ ID NO: 259737 - DNA, 311 bp, Homo sapiens
  misc_feature: GYAE6OF02F2TJQ.45.67.G01.1.454.CMB.1.raw
  modified_base (242)..(311): a, c, t, g, unknown or other
  misc_feature (242)..(311): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtctgggtcagcccaaggctgccccctggtcactctgttcccgcctcctctcgatcgcgtctgagcggctggcaaggcgcatagnnnnnnnnnnnnnnnnnnnnnnnnnnnnnnnnnnnnnnnnnnnnnnnnnnnnnnnnnnnnnnnnnnnnnn

SEQ ID NO: 259738 - DNA, 460 bp, Homo sapiens
  misc_feature: GYAE6OF02GHWE1.45.67.G01.1.454.CMB.1.raw
  modified_base (445)..(445): a, c, t, g, unknown or other
  misc_feature (445)..(445): n is a, c, g, or t
  modified_base (450)..(460): a, c, t, g, unknown or other
  misc_feature (450)..(460): n is a, c, g, or t
tcagacgcgatcgacacgaccggtgctcgatttagagtatacatattgggtttggggtctggagtgggtgggagccgtctcaaaggatggagataaaacatatttcgcagactccgtgtggcgccgattcaccatctccagaaacaatcccgggaacaccctacatctccacatgaaatccctgagaccggaggacacggctgtttattctgtgccagaggtcgaaggatggcgtggggcaactcaatccctccgaatactactactacatggacgcctggggcaaagggacctcggtcgccgtctcctcagcttccaccaagggcccatcggtcttccccctggcgccctgctccaggagcacctctgggggcacgagccggcctcgggctgcagtggtcaaggactacttcctcgatccgcgtctgacgcggctggcaggcgnatagnnnnnnnnnnn

SEQ ID NO: 259739 - DNA, 249 bp, Homo sapiens; identical to SEQ ID NO: 259656
  misc_feature: GYAE6OF02FRMCO.45.67.G01.1.454.CMB.1.raw
  modified_base (246)..(249): a, c, t, g, unknown or other
  misc_feature (246)..(249): n is a, c, g, or t

SEQ ID NO: 259740 - DNA, 544 bp, Homo sapiens
  misc_feature: GYAE6OF02FHUFD.45.67.G01.1.454.CMB.1.raw
  modified_base (429)..(429): a, c, t, g, unknown or other
  misc_feature (429)..(429): n is a, c, g, or t
  modified_base (450)..(450): a, c, t, g, unknown or other
  misc_feature (450)..(450): n is a, c, g, or t
  modified_base (480)..(480): a, c, t, g, unknown or other
  misc_feature (480)..(480): n is a, c, g, or t
  modified_base (537)..(537): a, c, t, g, unknown or other
  misc_feature (537)..(537): n is a, c, g, or t
tcagacgcgatcgacacgaccggtgctcgatttagagtatacatattgggtttggggtctgcttcagctgtgagcgcagaaggcaggactcgggacaatcttcatcatgacttgctcccctctcctcctcacccttctcattctctgcacagggtcgtgggcccaacctgaattgacgcagccgccctcggtgtctgcggccccaggacagaccgttaaaatctcctgcactggggccgactccaacgttggcgctaatttcgtgtcgtggtaccagcagttcccaggggaagcccccagactcctcgtttatgacaataacaggcgaccctcaggtattcctgcccgattctctgcctccaagtctggcgcgtcagcccaccctgaccatccaccggactccagacagcggacgaggccgatattacngcggaacgtgggatgtccgtntagtttgcggtgttcggcggagggccagtnttgaccgtcgtgggtcacgcccaaggcctgcccccgtggtccacctcgtcttccccnccttccc

SEQ ID NO: 259741 - DNA, 251 bp, Homo sapiens
  misc_feature: GYAE6OF02FZK7D.45.67.G01.1.454.CMB.1.raw
  modified_base (246)..(251): a, c, t, g, unknown or other
  misc_feature (246)..(251): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccaccctcctctcgatcgcgtctgagcgggctggcaaggcgcatagnnnnnn

SEQ ID NO: 259742 - DNA, 247 bp, Homo sapiens; identical to SEQ ID NO: 259631
  misc_feature: GYAE6OF02JCWLK.45.67.G01.1.454.CMB.1.raw
  modified_base (246)..(247): a, c, t, g, unknown or other
  misc_feature (246)..(247): n is a, c, g, or t

SEQ ID NO: 259743 - DNA, 586 bp, Homo sapiens
  misc_feature: GYAE6OF02IRIIB.45.67.G01.1.454.CMB.1.raw
  modified_base (305)..(305): a, c, t, g, unknown or other
  misc_feature (305)..(305): n is a, c, g, or t
  modified_base (427)..(427): a, c, t, g, unknown or other
  misc_feature (427)..(427): n is a, c, g, or t
  modified_base (450)..(450): a, c, t, g, unknown or other
  misc_feature (450)..(450): n is a, c, g, or t
tcagacgcgatcgacacgaccggtgctcgatttagagtatacatattgggtttggggtctgcttcagctgtgagcgcagaaggcaggactcgggacaatcttcatcatgacctgctccctctcctcctcacccttctcattctctgcacagggtcgtgggcccaacctgaattgacgcagccgccctcggtgtctgcggcccaggacagacgttaaaatctcctgcactggggccgactccaacgttgcgctaatttcgtgtctggtaccagcagttcccagggaagccccagactctcgtttangacaataacaggcaccctcaggtattcctgcccgattctctcgcctccaacgtctggcgcgtcacgcccaccctgacccatcacccggactccagacacgcggacgaggccgactacttacnggacggacgtgggatcggccgtntattggcggttgttcgggcggacgggaccgagagttcgaccgttccgtgggtccgaacggcccgaaggcccgtacggtcccccccgtggttacccgtaaccgttccgttacccggtttccccgaaccccttccccg

SEQ ID NO: 259744 - DNA, 251 bp, Homo sapiens
  misc_feature: GYAE6OF02GQ2PI.45.67.G01.1.454.CMB.1.raw
  modified_base (247)..(251): a, c, t, g, unknown or other
  misc_feature (247)..(251): n is a, c, g, or t
tcagacgcgatcgacacgaccggtgctcgatttagagtatacatattgggtttggggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccaccctcctctcgatcgcgtctgagcgggctggcaaggcgcatagnnnnn

SEQ ID NO: 259745 - DNA, 571 bp, Homo sapiens
  misc_feature: GYAE6OF02I8X3C.45.67.G01.1.454.CMB.1.raw
  modified_base (293)..(293): a, c, t, g, unknown or other
  misc_feature (293)..(293): n is a, c, g, or t
tcagacgcgatcgacacgaccggtgctcgatttagagtatacatattgggtttggggtctgcttcagctgtgagcgcagaaggcaggactcgggacaatcttcatcatgacctgctcccctctcctcctcacccttctcattctctgcacagggtcgtgggcccaacctgaattgacgcagccgccctcggtgtctgcggccccaggacagaccgttaaaatctcctgcactggggccgactccaacgttggcgctaatttcgtgtcgtggtaccagcagttcccaggggaancccccagactcctcgttatgacaataacaggcgaccctcaggtattcctgcccgattctctgcctccaagtctggcgcgtcagccaccctgaccatccaccggactccagacacggcggacgacggcccgaactacttactgcggaacggtgggatggtccgtcttagtttcgcgggttgttcgggcgggaacgggaccaggtagttcgaccgttccgtgggtcacggcccaaggcctcgcccccgtcggtccacgtcgtcgttccccacccttcccg

SEQ ID NO: 259746 - DNA, 225 bp, Homo sapiens
  misc_feature: GYAE6OF02GZ9EK.45.67.G01.1.454.CMB.1.raw
  modified_base (220)..(225): a, c, t, g, unknown or other
  misc_feature (220)..(225): n is a, c, g, or t
tcagacgcgatcgacacgaccggtgctcgatttagagtatacatattgggtttggggggaagaggaagactgacggtcctcccaggagttcaggtgctgggcaccttgggcacgggggaggtgtgtcacaagatttgggctctgggcacagcggccctgggctgcctggtcaaggactacttcctcgatcgcgtctgagcgggctggcaaggcgcatagnnnnnn

SEQ ID NO: 259747 - DNA, 250 bp, Homo sapiens
  misc_feature: GYAE6OF02GMKAD.45.67.G01.1.454.CMB.1.raw
  modified_base (246)..(250): a, c, t, g, unknown or other
  misc_feature (246)..(250): n is a, c, g, or t
tcagacgcgatcgacacgaccggtgctcgatttagagtatacatattgggtttggggggtgtggtggtctccactcccgccttgacgaggccgactattactgcggaacgtgggatgtccgtctatttgcggtgttcggcggagggaccagattgaccgtcctgggtcagcccaaggctgccccctggtcactctgttcccaccctcctctcgatcgcgtctgagcgggctggcaaggcgcatagnnnnn

SEQ ID NO: 259748 - DNA, 669 bp, Homo sapiens
  misc_feature: GYAE6OF02I483B.45.67.G01.1.454.CMB.1.raw
  modified_base (260)..(260): a, c, t, g, unknown or other
  misc_feature (260)..(260): n is a, c, g, or t
  modified_base (273)..(273): a, c, t, g, unknown or other
  misc_feature (273)..(273): n is a, c, g, or t
  modified_base (339)..(339): a, c, t, g, unknown or other
  misc_feature (339)..(339): n is a, c, g, or t
tcagacgcgatcgacacgaccggtgctcgatttagagtatacatattgggtttgggctctgggcaccgtgggcatgggggaggtgtgtcacaagatttgggctctgggcaccgtgggcacggggaggcgtggtccagccgggggggtctctgagactctcctgcgctgcctctggattcaccttcagtgcttatgctctccactgggtccgccaggggccaggcaagggtctggagtgggtgggagccgtctacaaaggntggagataaaacntattcgcagactccgtgtggcgccgattccaccatctccaagaaacacgtacccggaacaccctanactcctaccacatacgaaactccgtagacgaccggacggacacggtctagtttacttcgtgtcgaccgagaggtcgaaggtatcgggcgtgggacgaactcaacgtcccgtaccgaaattccgtaactacctaagtacgtacggaacgccggtacgggaccgtaaaacggggtccctaccgggtccggtacccgttccgtccgtaccgtacgtacccttcccgaacccggaccggtcccctaacgtcccggtttaccccgttcccccggtgggtccccgtaccccgttacggtccctaacccggacgggacccgttacccgtaccccggg

SEQ ID NO: 259749 - DNA, 766 bp, Homo sapiens
  misc_feature: GYAE6OF02JWBND.45.67.G01.1.454.CMB.1.raw
tcagacgcgatcgacacgaccggtgctcgatttagagtatacatattgggtttgggggggtaggacgagcccagcactggaagtcgccggtgcttccatccggtgatcagcactgagcacagaggactcaccatggagtttgggctgagttggattttcctcgtcgctcttttaagaggtgtccaatgtcaggtgcaaatggtggaggtcggggggaggcgtgggtccgagggccggggggggtctcgtggagacgtctccgtgccgctgccctctggtacttccaccttcagtgtcttatgctctccactcggtcccgccgacgggccacggcgaacgggtctcgggaggtggggtgggcgtccggtcgtacgaaagggtgttacgggaagtaagtaaaacgtacgtttaagttttacccgacgtaacggtaaccgttcccggttcgggttacgggcccggtacccgggtaacgtttacccgaaccgtacgttacccgttaccccgaaacggtaaacctaaaccggttaaccccggggaaaccctaccccgtaacccgtactacccgttacctaacctaacgtacgtaaacctcccgtaggtaaccggaccggtacggaccgtaccgggtcttacggttttacttccgtacgtcgtaccgaggtacggtaccggaaggtacggtcgggtacgggtaccggggtaccgtaaccggtaccggtaaccgttaccccgtaccggtaaacttacccgtaaccgttaaccg

SEQ ID NO: 259750 - DNA, 481 bp, Homo sapiens
  misc_feature: GYAE6OF02FVECE.45.67.G01.1.454.CMB.1.raw
  modified_base (445)..(446): a, c, t, g, unknown or other
  misc_feature (445)..(446): n is a, c, g, or t
  modified_base (448)..(448): a, c, t, g, unknown or other
  misc_feature (448)..(448): n is a, c, g, or t
  modified_base (450)..(450): a, c, t, g, unknown or other
  misc_feature (450)..(450): n is a, c, g, or t
  modified_base (452)..(453): a, c, t, g, unknown or other
  misc_feature (452)..(453): n is a, c, g, or t
  modified_base (455)..(455): a, c, t, g, unknown or other
  misc_feature (455)..(455): n is a, c, g, or t
  modified_base (458)..(481): a, c, t, g, unknown or other
  misc_feature (458)..(481): n is a, c, g, or t
tcagacgcgatcgacacgaccggtgctcgatttagagtatacatattgggtttgggggagccgtctcaaaggatggagataaaacatatttcgcagactccgtgtggcgccgattcaccatctccagaaacaatcccgggaacaccctacatctccacatgaaatccctgagaccggaggacacggctgtttatttctgtgccagaggtcgaaggatggcgtggggcgaactcaatccctcgaatactactactacatggacgcctggggcaaagggacctcggtcgccgtctcctcagcttccaccaagggcccatcggtcttccccctggccgccctgctccaggagccacctcgtgggggcacgacgcggcccgtgggctgcctggtcaaggacctacttcctcgactcgcgtctgacgcgggcgtggcaagggcgcatagnngngngnngnagnnnnnnnnnnnnnnnnnnnnnnnn

SEQ ID NO: 259751 - DNA, 251 bp, Homo sapiens
  misc_feature: GYAE6OF02I4EX6.45.67.G01.1.454.CMB.1.raw
  modified_base (240)..(240): a, c, t, g, unknown or other
  misc_feature (240)..(240): n is a, c, g, or t
  modified_base (246)..(251): a, c, t, g, unknown or other
  misc_feature (246)..(251): n is a, c, g, or t
tcagacgcgatcgacacgaccggtgctcgatttagagtatacatattgggtttggggggtgtggtggtctccactcccgccttgacgaggccgactattactgcggaacgtgggatgtccgtctatttgcggtgttcggcggagggaccagattgaccgtcctgggtcagcccaaggctgccccctggtcacttctgttcccaccctcctctcgtcgcgtctgagcgggctggcaaggcncatagnnnnnn

SEQ ID NO: 259752 - DNA, 660 bp, Homo sapiens
  misc_feature: GYAE6OF02IQC0J.45.67.G01.1.454.CMB.1.raw
  modified_base (613)..(613): a, c, t, g, unknown or other
  misc_feature (613)..(613): n is a, c, g, or t
  modified_base (617)..(617): a, c, t, g, unknown or other
  misc_feature (617)..(617): n is a, c, g, or t
  modified_base (628)..(628): a, c, t, g, unknown or other
  misc_feature (628)..(628): n is a, c, g, or t
  modified_base (630)..(630): a, c, t, g, unknown or other
  misc_feature (630)..(630): n is a, c, g, or t
  modified_base (635)..(637): a, c, t, g, unknown or other
  misc_feature (635)..(637): n is a, c, g, or t
  modified_base (639)..(639): a, c, t, g, unknown or other
  misc_feature (639)..(639): n is a, c, g, or t
  modified_base (641)..(643): a, c, t, g, unknown or other
  misc_feature (641)..(643): n is a, c, g, or t
  modified_base (645)..(646): a, c, t, g, unknown or other
  misc_feature (645)..(646): n is a, c, g, or t
  modified_base (648)..(648): a, c, t, g, unknown or other
  misc_feature (648)..(648): n is a, c, g, or t
  modified_base (651)..(653): a, c, t, g, unknown or other
  misc_feature (651)..(653): n is a, c, g, or t
  modified_base (655)..(656): a, c, t, g, unknown or other
  misc_feature (655)..(656): n is a, c, g, or t
  modified_base (658)..(660): a, c, t, g, unknown or other
  misc_feature (658)..(660): n is a, c, g, or t
tcagacgcgatcgacacgaccggtgctcgatttagagtatacatattgggtttggggtctggagtgggtgggagccgtctcaaaggatggagataaaaacatatttcgcagactccgtgtggcgccgattcaccatctccagaaacaatcccgggaacaccctacatctccacatgaaatccctgagaccggaggacacggctgtttatttctgtgccagaggtcgaaggatggcgtgggacgaactcaactccctccgaatactactactacatggacgccgtggggacaaagggacctccggtcgccgtcctccgtcagtaccttccgaccgaacgggccccaacgttccggtcccgtttcccccccgtggggacccgtccccgttacgcccgttacccggacggaacgcctaccccgttacgtcggggggaccaaccggtaacgggcccgggaccccggttggggtccgttcggtcccgttacgggtaccggtaaaacggggtaccttaccgttttacccgtaccgtaacggtccggtcggttaccgtcgggttaagggcccggggtacgttagggaaccgtaaacggggacccgaccgaagttaacggnacgnacgtgatcgancncgcgnnncncnnngnncngannncnnannn

SEQ ID NO: 259753 - DNA, 710 bp, Homo sapiens
  misc_feature: GYAE6OF02GV6L2.45.67.G01.1.454.CMB.1.raw
tcagacgcgatcgacacgaccggtgctcgatttagagtatacatattgggtttggggtctgcttcagctgtgagcgcagaaggcaggactcgggacaatcttcatcatgacctgctccctctcctcctcacccttctcattctctgcacagggtcgtgggcccaacctgaattgacgcagccgccctcggtgtctgccggcccaggacagaccgttaaaatctcctgcacgtgggccactccaacgtggcgctaatttcgtgtcgtggtaccagcagttccccgaggggaacgcccccagactcctcgttatcgacaatacaggcgaccctcgagtattccgtgcccgtattctctcgccctacacgtctcggcgtcgtcacgccctaccctacgacctactccgacccggtacctacccgacgaaccgaggcccgggaacggaccgggacccgtaacgttaccttaacgtcgggacgggttaacgggtgggtaacgttcggtacccgttacgtttacgtttcgggtaccgggttcgtttaccggggaccgggtacgggaacccgtggttaacgtttccggacccgggttccggttcggggtaccgtaccgggaccccggtaacgggtacccgttacccggtccccccgttaccggggtccctaacccgttcccggtttacccggtttccccccggtccctttcccccgg

SEQ ID NO: 259754 - DNA, 258 bp, Homo sapiens
  misc_feature: GYAE6OF02GBGNM.45.67.G01.1.454.CMB.1.raw
  modified_base (246)..(258): a, c, t, g, unknown or other
  misc_feature (246)..(258): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgccccctcggtcactctgttcccaccctcctctcgatcgcgtctgagcgggctggcaaggcgcatagnnnnnnnnnnnnn

SEQ ID NO: 259755 - DNA, 433 bp, Homo sapiens
  misc_feature: GYAE6OF02HN07M.45.67.G01.1.454.CMB.1.raw
  modified_base (210)..(210): a, c, t, g, unknown or other
  misc_feature (210)..(210): n is a, c, g, or t
  modified_base (280)..(280): a, c, t, g, unknown or other
  misc_feature (280)..(280): n is a, c, g, or t
  modified_base (284)..(284): a, c, t, g, unknown or other
  misc_feature (284)..(284): n is a, c, g, or t
  modified_base (308)..(308): a, c, t, g, unknown or other
  misc_feature (308)..(308): n is a, c, g, or t
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
  modified_base (326)..(326): a, c, t, g, unknown or other
  misc_feature (326)..(326): n is a, c, g, or t
  modified_base (328)..(328): a, c, t, g, unknown or other
  misc_feature (328)..(328): n is a, c, g, or t
  modified_base (340)..(340): a, c, t, g, unknown or other
  misc_feature (340)..(340): n is a, c, g, or t
  modified_base (353)..(353): a, c, t, g, unknown or other
  misc_feature (353)..(353): n is a, c, g, or t
  modified_base (358)..(358): a, c, t, g, unknown or other
  misc_feature (358)..(358): n is a, c, g, or t
  modified_base (368)..(368): a, c, t, g, unknown or other
  misc_feature (368)..(368): n is a, c, g, or t
  modified_base (370)..(371): a, c, t, g, unknown or other
  misc_feature (370)..(371): n is a, c, g, or t
  modified_base (373)..(373): a, c, t, g, unknown or other
  misc_feature (373)..(373): n is a, c, g, or t
  modified_base (375)..(375): a, c, t, g, unknown or other
  misc_feature (375)..(375): n is a, c, g, or t
  modified_base (377)..(377): a, c, t, g, unknown or other
  misc_feature (377)..(377): n is a, c, g, or t
  modified_base (383)..(383): a, c, t, g, unknown or other
  misc_feature (383)..(383): n is a, c, g, or t
  modified_base (387)..(387): a, c, t, g, unknown or other
  misc_feature (387)..(387): n is a, c, g, or t
  modified_base (390)..(395): a, c, t, g, unknown or other
  misc_feature (390)..(395): n is a, c, g, or t
  modified_base (397)..(399): a, c, t, g, unknown or other
  misc_feature (397)..(399): n is a, c, g, or t
  modified_base (401)..(433): a, c, t, g, unknown or other
  misc_feature (401)..(433): n is a, c, g, or t
tcagacgcgatcgacacgaccggtgctcgatttagagtatacatattgggtttgggggaagaggaagactgacggtcctcccaggagttcaggtgctgggcaccgttgggcacgggggaggtggtgtcgacgaaggagttttgggctcgtggggcacgtagcggccctggggctacggccgttggtccgaaagggtacctacgtttcccncggtaatccgggtcgtcgtaggaacgtcgggggacttgggccgtaaagggcccgtagaacgttacggacncggntagcgagcgtagacgcgaggttcngagccgtgngacgngacngngacgtgagtcgngtcgagtgcgcgncgacngacgcagccngnngngngngcgagngtgngannnnnngnnngnnnnnnnnnnnnnnnnnnnnnnnnnnnnnnnnn

SEQ ID NO: 259756 - DNA, 753 bp, Homo sapiens
  misc_feature: GYAE6OF02HBMYT.45.67.G01.1.454.CMB.1.raw
  modified_base (286)..(286): a, c, t, g, unknown or other
  misc_feature (286)..(286): n is a, c, g, or t
tcagacgcgatcgacacgaccggtgctcgatttagagtatacatattgggtttggggagctctgggagacgagcccagcactggaagtcgccggtgcttccatccggtgatcagcactgagcacagaggactcaccatggagtttgggctgagttggattttcctcgtcgctcttttaagaggtgtccaatgtcaggtgcaatggtggagtcgggggagcgtggtccaggccggggggtctcgtgagtactctcctgcgctcgcctctggattccaccttcgagtncttatgctctccacgtcgggtccgcgacgggccaggcgaagggtcgtagggtagtgggggtggacgtccgtacgtacgaaaggtcgtacgggaagtaaacgtaaaaactagtttaacgtttcggactaacgggtaccgttccgggttagggtcgggtacccggtacccgtaagtttaccccgaacccgtaacttacccgttaaccgtaaaacgaaaaccgtaacccggttaaacccccggggaaccttaaaccccgtaccgtaactacccgttacccaaccgtaacgttaacgtaaaaccgttcccgtaagggtaaaccgggaacccgggtaacggtaaccgtaacggttaccttaggtttttaaccgtttcgttacggtacgtaccggaagggtacgggtaaccggtaagggtaacgtgggtacgggtacgggtacgtaacccgtacgtaccgtcccgttaaaccg

SEQ ID NO: 259757 - DNA, 497 bp, Homo sapiens
  misc_feature: GYAE6OF02IPC4E.45.67.G01.1.454.CMB.1.raw
  modified_base (400)..(400): a, c, t, g, unknown or other
  misc_feature (400)..(400): n is a, c, g, or t
  modified_base (464)..(464): a, c, t, g, unknown or other
  misc_feature (464)..(464): n is a, c, g, or t
  modified_base (479)..(497): a, c, t, g, unknown or other
  misc_feature (479)..(497): n is a, c, g, or t
tcagacgcgatcgacacgaccggtgctcgatttagagtatacatattgggtttggggtctggagtgggtgggagccgtctcaaaggatggagataaaacatatttcgcagactccgtgtggcgccgattcaccatctccagaaacaatcccgggaacaccctacatctccacatgaaatccctgagaccggaggacacggctgtttatttctgtgccagaggtcgaaggatgggcgtggggcgaactcaatccctccgaactactactactacatggacgcctggggcgaaacgggacctcggtcgccgtcctcctcacgcttccaccgaacgggcccacgtccggtccttcccccgtcggccgccctgcctccgacggacgcacctcgtcggggcacgngccggccgtgggctcgccgtggtcgaaggctacgttccgtcgatcggcgtcgtgaggcgggtcnggcgaggcgcatagnnnnnnnnnnnnnnnnnnn

SEQ ID NO: 259758 - DNA, 598 bp, Homo sapiens
  misc_feature: GYAE6OF02IW0N6.45.67.G01.1.454.CMB.1.raw
  modified_base (321)..(321): a, c, t, g, unknown or other
  misc_feature (321)..(321): n is a, c, g, or t
  modified_base (339)..(339): a, c, t, g, unknown or other
  misc_feature (339)..(339): n is a, c, g, or t
  modified_base (349)..(349): a, c, t, g, unknown or other
  misc_feature (349)..(349): n is a, c, g, or t
  modified_base (359)..(359): a, c, t, g, unknown or other
  misc_feature (359)..(359): n is a, c, g, or t
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
  modified_base (396)..(396): a, c, t, g, unknown or other
  misc_feature (396)..(396): n is a, c, g, or t
  modified_base (400)..(400): a, c, t, g, unknown or other
  misc_feature (400)..(400): n is a, c, g, or t
  modified_base (485)..(485): a, c, t, g, unknown or other
  misc_feature (485)..(485): n is a, c, g, or t
tcagacgcgatcgacacgaccggtgctcgatttagagtatacatattgggtttggggtctgcttcagctgtgagcgcagaaggcaggactcgggacaatcttcatcatgacctgctcccctctcctcctcacccttctcattctctgcacagggtcgtgggcccaacctgaattgacgcagcccgccctcggtcgtctgccggccccagggaccagtaaccgttaaaatccttaccgtgccacgtcggggacccgaacgtccgaacgttggccgacttaatttcgtagtcgtcggtaccagctacgttcccgaggggaacnccccagactcctcgttangacaataacnggaccacctnaggtacttccngccgtattcnctcgcctaccaagtcnggcnctcgacgcccacctgacctatccgaaccggactcaagcaggcgacggacgcctatacttagaggacgaacgtggatcgtaccgtntacgtttggacggtgttcggacggacggacagtgtacgtaccgtacgtcggtctacggcccgaacggctcccggccctcggtcctaccgtcccgtcgttaccccgcctacccg

SEQ ID NO: 259759 - DNA, 141 bp, Homo sapiens
  misc_feature: GYAE6OF02FSYRX.45.67.G01.1.454.CMB.1.raw
  modified_base (137)..(141): a, c, t, g, unknown or other
  misc_feature (137)..(141): n is a, c, g, or t
tcagacgcgatcgacacgaccggtgctcgatttagagtatacatattgggtttgggctctgggcacagcggccctgggctgcctggtcaaggactacttcctcgatcgcgtctgagcgggctggcaaggcgcatagnnnnn

SEQ ID NO: 259760 - DNA, 794 bp, Homo sapiens
  misc_feature: GYAE6OF02GFBIV.45.67.G01.1.454.CMB.1.raw
tcagacgcgatcgacacgaccggtgctcgatttagagtatacatattgggtttggggagctctgggagacgagcccagcactggaagtcgccggtgcttccatccggtgatcagcactgagcacagaggactcaccatggagtttgggctgagttggtattttcctcgtcgcttcttttaagaggtgtccaatgtcaggtgacaaatggtggaggtcgggggaggcggtggtccgagggcccgggggggtctcgtaggaggtacctcgtccgtggccgtcgtcgccccttcgtgggtactttcctaaccgttcaggttcgactttagtcgccttcctaccgtacgttccggggttcccgacccgggtaacggggggcccaagggggaccggaaaggggttccgttaggggacggggttaggggggtagggggaccggtcccggttcgtaaccggaaaaacggggtggttaaggggaaaacgtaaaagttaaaaacgtagtttaagttttaccgacgacgtaaccgttccggtggtcgggccgacgtaacctttccaaccattacccgacgaaacggaaaacctaccccggtaacccggaacccttaacccgaactaccgtacctaccactagtaacgaaaccttccgacggaacggtaacccgggacgtaaaccgcggttacgtttacgtttacgtttcgtcgttaccggacgtacgggtaaggtaccgaaagggttcgtaggggccgggttaggggacccgttaaacaccggttaaccgtccccgttaaaccg

SEQ ID NO: 259761 - DNA, 260 bp, Homo sapiens
  misc_feature: GYAE6OF02G98L1.45.67.G01.1.454.CMB.1.raw
  modified_base (227)..(227): a, c, t, g, unknown or other
  misc_feature (227)..(227): n is a, c, g, or t
  modified_base (245)..(245): a, c, t, g, unknown or other
  misc_feature (245)..(245): n is a, c, g, or t
  modified_base (251)..(260): a, c, t, g, unknown or other
  misc_feature (251)..(260): n is a, c, g, or t
tcagacgcgatcgacacgaccggtgctcgatttagagtatacatattgggtttggggggtgtggtggtctccactcccgccttgacgaggccgactattactgcggaacgtgggatgtccgtctattttgcggtgttcggcggagggaccagattgaccgtcctgggtcacgcccgaaggctcgccccctcggtcacttctcgttcccgccctctctcgatcgcgtntgagcggctggcaaggcncatagnnnnnnnnnn

SEQ ID NO: 259762 - DNA, 253 bp, Homo sapiens
  misc_feature: GYAE6OF02GR4IS.45.67.G01.1.454.CMB.1.raw
  modified_base (219)..(253): a, c, t, g, unknown or other
  misc_feature (219)..(253): n is a, c, g, or t
tcagacgcgatcgacacgaccggtgctcgatttagagtatacatattgggtttggggggaagaggaagactgacggtcctcccaggagttcaggtgctgggcaccttgggcacgggggaggtgtgtcacaagatttgggctctgggcacaggcggccctggggctgcctggtcaaggctactcctgatcgcgtctgagcgggctggcaaggcgcatagnnnnnnnnnnnnnnnnnnnnnnnnnnnnnnnnnnn

SEQ ID NO: 259763 - DNA, 261 bp, Homo sapiens
  misc_feature: GYAE6OF02FJ0T9.45.67.G01.1.454.CMB.1.raw
  modified_base (247)..(261): a, c, t, g, unknown or other
  misc_feature (247)..(261): n is a, c, g, or t
tcagacgcgatcgacacgaccggtgctcgatttagagtatacatattgggtttggggggtgtggtggtctccactcccgccttgacgaggccgactattactgcggaacgtgggatgtccgtctatttgcggtgttcggcggagggaccagattgaccgtcctgggtcagcccaaggctgccccctcggtcactctcgttcccgccctcctctcgacgcgtctgagcgggctggcaaggcgcatagnnnnnnnnnnnnnnn

SEQ ID NO: 259764 - DNA, 605 bp, Homo sapiens
  misc_feature: GYAE6OF02HY6UU.45.67.G01.1.454.CMB.1.raw
  modified_base (546)..(546): a, c, t, g, unknown or other
  misc_feature (546)..(546): n is a, c, g, or t
  modified_base (575)..(605): a, c, t, g, unknown or other
  misc_feature (575)..(605): n is a, c, g, or t
tcagacgcgatcgacacgaccggtgctcgatttagagtatacatattgggtttggggtctggagtgggtgggagccgtctcaaaggatggagataaaacatatttcgcagactccgtgtggcgccgattcaccatctccagaaacaatccccgggaacaccctacatcctccacatgaaactcccctgacgaccggagacacggctgttttatttctgtcgccagaggtacgaaggagtgggacggtggggacaactacaactcccgtaccgaaattactaaccttaatacagtacggaccgccggtgggacgtaaagggacctacggtccgtcccgtctcctcacgtcccttacacccgaacgggccctacgttcccgtacccttcccccgtacggccctaccccttccaccccgaagacgtaccaccgttccggtgggggcctaacggcgccgggcccgtcgggccgtcgtacctcgggacgtaacggaccttaccgttccgttaacgcgttccgtaccgttccgagggtacggaccgggtcgnggtaccggtaaggccgacgtaacagcgannnnnnnnnnnnnnnnnnnnnnnnnnnnnnn

SEQ ID NO: 259765 - DNA, 247 bp, Homo sapiens
  misc_feature: GYAE6OF02G4DGU.45.67.G01.1.454.CMB.1.raw
  modified_base (244)..(247): a, c, t, g, unknown or other
  misc_feature (244)..(247): n is a, c, g, or t
tcagacgcgatcgacacgaccggtgctcgatttagagtatacatattgggtttgggggtgtggtggtctccactcccgccttgacgaggccgactattactgcggaacgtgggatgtccgtctatttgcggtgttcggcggagggaccagattgaccgtcctgggtcagcccaaggctgccccctggtcactctgttcccaccctcctctcgacgcgtctgagcgggctggcaaggcgcatagnnnn

SEQ ID NO: 259766 - DNA, 674 bp, Homo sapiens
  misc_feature: GYAE6OF02FQRZB.45.67.G01.1.454.CMB.1.raw
  modified_base (600)..(600): a, c, t, g, unknown or other
  misc_feature (600)..(600): n is a, c, g, or t
  modified_base (607)..(607): a, c, t, g, unknown or other
  misc_feature (607)..(607): n is a, c, g, or t
  modified_base (613)..(613): a, c, t, g, unknown or other
  misc_feature (613)..(613): n is a, c, g, or t
  modified_base (619)..(619): a, c, t, g, unknown or other
  misc_feature (619)..(619): n is a, c, g, or t
  modified_base (621)..(621): a, c, t, g, unknown or other
  misc_feature (621)..(621): n is a, c, g, or t
  modified_base (627)..(627): a, c, t, g, unknown or other
  misc_feature (627)..(627): n is a, c, g, or t
  modified_base (633)..(633): a, c, t, g, unknown or other
  misc_feature (633)..(633): n is a, c, g, or t
  modified_base (636)..(637): a, c, t, g, unknown or other
  misc_feature (636)..(637): n is a, c, g, or t
  modified_base (640)..(640): a, c, t, g, unknown or other
  misc_feature (640)..(640): n is a, c, g, or t
  modified_base (642)..(642): a, c, t, g, unknown or other
  misc_feature (642)..(642): n is a, c, g, or t
  modified_base (644)..(644): a, c, t, g, unknown or other
  misc_feature (644)..(644): n is a, c, g, or t
  modified_base (647)..(647): a, c, t, g, unknown or other
  misc_feature (647)..(647): n is a, c, g, or t
  modified_base (663)..(663): a, c, t, g, unknown or other
  misc_feature (663)..(663): n is a, c, g, or t
  modified_base (669)..(669): a, c, t, g, unknown or other
  misc_feature (669)..(669): n is a, c, g, or t
  modified_base (674)..(674): a, c, t, g, unknown or other
  misc_feature (674)..(674): n is a, c, g, or t
tcagacgcgatcgacacgaccggtgctcgatttagagtatacatattgggtttgggggagccgtctcaaaggatggagataaaacatatttcgcagactccgtgtggcgccgattcaccatctccagaaacaatccgggaacaccctacatctccacatgaaatccctgagaccggaggacacggctgtttatttctagtgccagaggtacgaaggatggacgtggggcgaactcaactccctaccgaatactactaactacatacggacgcccgtggggacgaaaaggggaccctacggtccggacccgtccgttcccgtcgagtcccgtttacccgaaccgtaacggggacccaaaagttccgggttcccttacccccccgttacggcccgtccccgtcgcccgtaccgaacgggaacgcctacccgtcggttacgggggacctaacgaggacccggcccgtggggtaccgtcggtcccgtcgggttacgaaacgggtaacttacctttacccgttaccgacgttaccggccggttaccgtggaacgggcccgggtagtacggggtaccgaaacggggaccgtaccgaacgtagtcgngtaccgngagagnagacananagacanataganacnnganananagngagagtagatagaganagtctntagan

SEQ ID NO: 259767 - DNA, 774 bp, Homo sapiens
  misc_feature: GYAE6OF02FHUG9.45.67.G01.1.454.CMB.1.raw
tcagacgcgatcgacacgaccggtgctcgatttagagtatacatattggggtttgggctctgggcaccgtgggcatgggggaggtgtgtcacaagatttgggctctgggcaccgtgggcacgggggaggcgtggtccagccgggggggtctctgagactctcctgcgctgcctctggattcaccttcagtgcttatgctctccactgggtccgccgaggggccaggcgaagggtctgggagtggggtgggacggccgtcgtacgaaaggagtggagaataaaacattacgttttcgcagtaccttccggtgtcgggccgtccggtattccgaaccctatcctaccgaacgaaaacctaacgttaccccggggaaacctaccccgtaacaacttccctacccaactacgtaacggaaacttccccgtaggaacgggacccgggtaaggaccgacggtccttaggttttactttccgtaggtcgccgaagggtacggtacggaaggtacggtcgggcgggttcgggggacccgtaaacgtacctaacccgttccccgtaaccgtaaaccgttaaccttaaccttaaccgttaaccgtaacgttacgggacccggtaccggtacggggaaccggtaaaccgggtcccgttaccgggtccgtcccgttccgtcctacgccgtcccttaccgacccgacggtccctacggtccggtaccccgttccccggtacggcccgtcccgttcgcccgtaccgtacgggaccctccgtaccccgg

SEQ ID NO: 259768 - DNA, 256 bp, Homo sapiens
  misc_feature: GYAE6OF02HWIF1.45.67.G01.1.454.CMB.1.raw
  modified_base (246)..(256): a, c, t, g, unknown or other
  misc_feature (246)..(256): n is a, c, g, or t
tcagacgcgatcgacacgaccggtgctcgatttagagtatacatattgggtttggggggtgtggtggtctccactcccgccttgacgaggccgactattactgcggaacgtgggatgtccgtctatttgcggtgttcggcggagggaccagattgaccgtcctgggtcagcccaaggctgccccctggtcactctgttcccgccctcctctcgatcgcgtctgagcgggctggcaaggcgcatagnnnnnnnnnnn

SEQ ID NO: 259769 - DNA, 694 bp, Homo sapiens
  misc_feature: GYAE6OF02GM6Q1.45.67.G01.1.454.CMB.1.raw
  modified_base (276)..(276): a, c, t, g, unknown or other
  misc_feature (276)..(276): n is a, c, g, or t
  modified_base (677)..(677): a, c, t, g, unknown or other
  misc_feature (677)..(677): n is a, c, g, or t
tcagacgcgatcgacacgaccggtgctcgatttagagtatacatattgggtttgggctctgggcaccgtgggcatgggggaggtgtgtcacaagatttgggctctgggcaccgtgggcacgggggaggcgtggtccagccgggggggtctctgagactctcctgcgctgcctcgtggattcaccttcagtgctttatgcttctccacgtcgggtccgccgaggggccagggcgaacgggtcgtcggaggtgggtgggacgccggtctacgaaaggntaggaaataaactaatatttcgacgtacgacgtaccgtcgtcgggcgtccgacttaccaccactccgtcaacgaaacgaaccgtacccgggaaccaaccctacactaccttaccacaatcgaaacgtcctacgacggtaaccggaggaccgacggtcgttagtttacgttttcgtacgtggtacctaaggtacgggtacggtaacgggacgttcgggcgggtacggggaacgtaccgtacgtaaccgtttacccgacctaacgtacttaaccgtcctaacgtacgcggtacgtccgtagggaccgacggttaaccggtcggaccgttaccgtcctctacgacgttcctacgaccggacccgctaccgtccgtcccgtccctcgccgtacctcgcgacccgngtacgcctcggtaccgg

SEQ ID NO: 259770 - DNA, 773 bp, Homo sapiens
  misc_feature: GYAE6OF02GMKG2.45.67.G01.1.454.CMB.1.raw
tcagacgcgatcgacacgaccggtgctcgatttagagtatacatattgggtttggggagctctgggagacgagcccagcactggaagtcgccggtgcttccatccggtgatcagcactgagcacagaggactcaccatggagtttgggctgagttggattttccgtcgtcgtcttcttttaaggaggttgtaccaagtgtcgaggtgacaaatgggtaggaggtcgggggaggtcgtggtccgaggtcggggggtctcgtgacgactcgtaccgttcgcgtcgtcgcccgttctagggtaccttaccgtacccgtttccgtaaggttgtccgtttaagttcggtacccttaccggttaccccgtaaccggttccggggttaccccgggacccgggtacgggggacccggacgggtaaccggtaaacggggttccgttaggggtaagggttcgggggttacggggaacggttcccgggtaccgtaaccggaaaggtaggtaggaaaggaacttaaaaacgtattagttaacacgacgtacgtccgtaggtcggcgtactcgtactacctacttcctaccgtaaacgaaaccgtacggtaccccggaaacctaacccgtacgtacctacctaccaactaacgtactaacctaccgtacgtaacggaccggaacgtaccacggtcgttacgtttgttctagtcgtacgtaacggtacggtaacggaacgtggtacggtcgggtacgggcgtaacctcgtaaccgtacccgtaaccg

SEQ ID NO: 259771 - DNA, 382 bp, Homo sapiens
  misc_feature: GYAE6OF01C1K3H.14.76.G10.1.454.CMB.1.raw
  modified_base (233)..(233): a, c, t, g, unknown or other
  misc_feature (233)..(233): n is a, c, g, or t
  modified_base (331)..(331): a, c, t, g, unknown or other
  misc_feature (331)..(331): n is a, c, g, or t
  modified_base (346)..(346): a, c, t, g, unknown or other
  misc_feature (346)..(346): n is a, c, g, or t
  modified_base (374)..(382): a, c, t, g, unknown or other
  misc_feature (374)..(382): n is a, c, g, or t
tcagcgtctagtaccacgaccggtgctcgatttagtcactcatacagggcctgagctcgcccgtcacaaagagcttcaacaggggagagtgttagagggagaagtcgcccccacctgctcctcagttccagcctgaccccctccatcaaggttcagcggcagtggatcgtgggacagaattcactctcactatcacagcctgcaacctgatgtattttgactaacttattacngaccaacagtatcatcatcatttgtaatttcggaggaggacctaaggtggagtacaaacgaactggtggctgcaccatctgtctcatcctccgcatcngtacgtactagacgntgacggcggctggacgaaggcacatagnnnnnnnnn

SEQ ID NO: 259772 - DNA, 367 bp, Homo sapiens
  misc_feature: GYAE6OF01CY0OH.14.76.G10.1.454.CMB.1.raw
  modified_base (355)..(355): a, c, t, g, unknown or other
  misc_feature (355)..(355): n is a, c, g, or t
  modified_base (362)..(367): a, c, t, g, unknown or other
  misc_feature (362)..(367): n is a, c, g, or t
tcagcgtctagtaccacgaccggtgctcgatttagtcactcatacagggcctgagctcgcccgtcacaaagagcttcaacaggggagagtgttagagggagaagtgcccccacctgctcctcagttccagcctgaccccctcccatcaaggttcagcggcagtggatctgggacagaattcactctcactatcaccagcctgcaacctgatgattttgctaacttattactgccaacagtatcatcatcattgtaattcggtgagggaccaaggtggaggtacaacgaactgtggctgcacatctgtctcatcttcccgcatctgatactagacgctgagcgggctggcaaggcncagtagnnnnnn

SEQ ID NO: 259773 - DNA, 728 bp, Homo sapiens
  misc_feature: GYAE6OF01AMDF2.14.76.G10.1.454.CMB.1.raw
  modified_base (173)..(173): a, c, t, g, unknown or other
  misc_feature (173)..(173): n is a, c, g, or t
  modified_base (345)..(345): a, c, t, g, unknown or other
  misc_feature (345)..(345): n is a, c, g, or t
  modified_base (522)..(522): a, c, t, g, unknown or other
  misc_feature (522)..(522): n is a, c, g, or t
  modified_base (561)..(561): a, c, t, g, unknown or other
  misc_feature (561)..(561): n is a, c, g, or t
tcagcgtctagtaccacgaccggtgctcgatttagtcactcatacagggtggaaggagactgggtcatctggatgtcacatctggcacctggagcgagagcagcagcgccagagacgtccgagcggacgtcggtaccgaaggccgccgtaacgtcgtcgcgtcgtcgcgtcgngtcgcgacgtcgtcgtcgcgcgtcgcgacgtcgacgcgtcgacgtacctcgtcgtacgcgtccgtactacgtctacgtacgtcgtactacgtcgaacgtcgtacttacgccgtacgaactcggcctacggtaactacggtctacgtaacgcggtaccgtaggctacgtacgngtaagtaacgcggttaactccggtagacccgaggtaacgtacttccggaaaggttactaacccggttaggaacctttaaacgggtaagtacccggttaaagcccggtttaaggtaacttacgtaccggtagttaaccgtaagttcgtaacgtacgggtaaccgttacgaaccgggtntaaggaccgtacgtacggtacgttaccgagttaaaccgngtaccgactacgtaccgtacgtaagtcgttaaccgcgtaccgttaacgcttaaccgtagtaccttaacgtcgtttaaacctacgttaccgtacgtaacgttaagtaccgttaaaccgttaagttacccgaagtttaacgtaacgttacggttaacgttaacggtaag

SEQ ID NO: 259774 - DNA, 780 bp, Homo sapiens
  misc_feature: GYAE6OF01ANIUQ.14.76.G10.1.454.CMB.1.raw
  modified_base (106)..(106): a, c, t, g, unknown or other
  misc_feature (106)..(106): n is a, c, g, or t
tcagcgtctagtaccacgaccggtgctcgatttagtcactcatacagggtggaaggagactgggtcatctggatgtcacatctggcacctggagcagagcagcagngcccaggagcgtcgacgtcggcgtcggccgaagggcctaccgagtaccggtcgcgttaccgtggtccgtccgaccggtcgccgttagtacggtcggtcgtaacgtacgtccggtaaggtaccgtacgtaccggaccgtacgtaccgttcaaccggttacgtccgtaaccgacgtccgtaccgtaccgttacggacgtacttaggtacctacggcctttaaggtccgaaaccctttgaaaccggtccgaaaggtacccaggttacatttaaaacccccgggtagtaacggttacccggtacgttaagtaccggttactaaacggtaccggtacggtaacgtaccggtaacgtttaccggaccgttaaagggttccaacgggttactaaccggtaaccggtaactaacgtttcggaacgtaacccgtacgttacgtaacggttactaacggtcgtttagaactaggtacggcgtacgtacgtacgtacgtacgtacggtagtacggtcgtaacggtctacgtacgtacgacctacgtctaccgtacctaagtaccttacgtactaacgtaaccgtgtacttacgtactcgttaacgtactaacgttacctaacgttaccgtagttacttactactaacggttcctaagtaccgtagtaagttcgtgtacggtaacg

SEQ ID NO: 259775 - DNA, 470 bp, Homo sapiens
  misc_feature: GYAE6OF01C2QOE.14.76.G10.1.454.CMB.1.raw
  modified_base (237)..(237): a, c, t, g, unknown or other
  misc_feature (237)..(237): n is a, c, g, or t
  modified_base (287)..(287): a, c, t, g, unknown or other
  misc_feature (287)..(287): n is a, c, g, or t
  modified_base (303)..(303): a, c, t, g, unknown or other
  misc_feature (303)..(303): n is a, c, g, or t
  modified_base (415)..(415): a, c, t, g, unknown or other
  misc_feature (415)..(415): n is a, c, g, or t
  modified_base (451)..(470): a, c, t, g, unknown or other
  misc_feature (451)..(470): n is a, c, g, or t
tcagcgtctagtaccacgaccggtgctcgatttagtcactcatacagggcctgagctcgcccgtcacaaagagcttcaacaggggagagtgttagagggagaagtcgcccccactgctcctcagttccagcctgacccccctccatcaaggttcagcggcagtggatcgtgggacagaattcactctcactatccaccagcctgacctaacctgtatgtattttcgactaaactttntacgtcgaccaactagtactcatacatctagtttagttaagttttcgggnggaacggactaagggnggacggtaaccaaaaggtacgttgggtacggtctcgacctacctattccgttacgtcttcacctttccccgttcccacttacggtctaggaacgtttacacgacgtgtacgnggggtaccggtcgtggacgaagggcctacaagtgcnnnnnnnnnnnnnnnnnnnn

SEQ ID NO: 259776 - DNA, 609 bp, Homo sapiens
  misc_feature: GYAE6OF01D6YSQ.14.76.G10.1.454.CMB.1.raw
  modified_base (200)..(200): a, c, t, g, unknown or other
  misc_feature (200)..(200): n is a, c, g, or t
  modified_base (559)..(559): a, c, t, g, unknown or other
  misc_feature (559)..(559): n is a, c, g, or t
  modified_base (565)..(609): a, c, t, g, unknown or other
  misc_feature (565)..(609): n is a, c, g, or t
tcagcgtctagtaccacgaccggtgctcgattttagtcactcatacagggcctgagctcgccccgtcacaaaagagcttcaacagggggagagtgttagagggagaagtgccccccacctgcctcctcagttccagcctgacccccctccatcaaggttcagcggcagtggatcgtgggacagtaattcactctcactanccaccagccctgaccaaccgtgacttgttattttgacctaaatttacttactcgacccaaagtagtactacgattaccaatttctaattttaggtttaaacgttttcgggggtaaggggaacggggtaacccgtaaagggggttcggaacgggtaaacccgaaacggtaacgtttgggtacgggtacctacggacctaccgtacgtttaccgttacgtttcccttaccttaaccgtttccccgttacccccgaccttaagttccgttaaggtaaccggttacctaacgggtaaccgtcggttacgggacggggtcccgggtacgttaccgggaacggaacggggtccgacgtaagtagntcgacnnnnnnnnnnnnnnnnnnnnnnnnnnnnnnnnnnnnnnnnnnnnn

SEQ ID NO: 259777 - DNA, 409 bp, Homo sapiens
  misc_feature: GYAE6OF02FL0CR.14.76.G10.1.454.CMB.1.raw
  modified_base (405)..(409): a, c, t, g, unknown or other
  misc_feature (405)..(409): n is a, c, g, or t
tcagcgtctagtaccacgaccggtgctcgatttagtcactcatacagggtggaaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggaggaccaaggtggaggtcaaacgaactgtggctgcaccatctgtcttcatcttcccgcatctgagtactagacgctgagcgggctggcaaggcgcatagnnnnn

SEQ ID NO: 259778 - DNA, 153 bp, Homo sapiens
  misc_feature: GYAE6OF01DF4N5.48.33.C11.1.454.CMB.1.raw
tcagagtatacatacacgaccggtgctcgatttagagtgagctcgttgggtttgggaccaaggtggaagtcaaacgaactgtggctgcaccatctgtcttcatcttcccgccatctgatatgtatactctgagcgggctggcaaggcgcatag

SEQ ID NO: 259779 - DNA, 153 bp, Homo sapiens
  misc_feature: GYAE6OF01DN4BA.48.33.C11.1.454.CMB.1.raw
  modified_base (153)..(153): a, c, t, g, unknown or other
  misc_feature (153)..(153): n is a, c, g, or t
tcagagtatacatacacgaccggtgctcgatttagagtgagctcgttgggtttgggaccaaggtggaagtcaacgaactgtggctgcaccatctgtcttcatcttcccgccatctgatatgtatactctgagcgggctggcaaggcgcatagn

SEQ ID NO: 259780 - DNA, 156 bp, Homo sapiens
  misc_feature: GYAE6OF01EZSS5.48.33.C11.1.454.CMB.1.raw
  modified_base (154)..(156): a, c, t, g, unknown or other
  misc_feature (154)..(156): n is a, c, g, or t
tcagagtatacatacacgaccggtgctcgatttagagtgagctcgttgggtttgggaccaaggtggaagtcaaacgaactgtggctgcaccatctgtcttcatcttcccgccatctgatatgtatactctgagcgggctggcaaggcgcatagnnn

SEQ ID NO: 259781 - DNA, 154 bp, Homo sapiens
  misc_feature: GYAE6OF01B497P.48.33.C11.1.454.CMB.1.raw
  modified_base (154)..(154): a, c, t, g, unknown or other
  misc_feature (154)..(154): n is a, c, g, or t
tcagagtatacatacacgaccggtgctcgatttagagtgagctcgttgggtttgggaccaaggtggaagtcaaacgaactgtggctgcaccatctgtcttcatcttcccgccatctgatatgtatactctgagcgggctggcaaggcgcatagn

SEQ ID NO: 259782 - DNA, 154 bp, Homo sapiens; identical to SEQ ID NO: 259781
  misc_feature: GYAE6OF01C2IBA.48.33.C11.1.454.CMB.1.raw
  modified_base (154)..(154): a, c, t, g, unknown or other
  misc_feature (154)..(154): n is a, c, g, or t

SEQ ID NO: 259783 - DNA, 154 bp, Homo sapiens; identical to SEQ ID NO: 259781
  misc_feature: GYAE6OF01DKS0B.48.33.C11.1.454.CMB.1.raw
  modified_base (154)..(154): a, c, t, g, unknown or other
  misc_feature (154)..(154): n is a, c, g, or t

SEQ ID NO: 259784 - DNA, 164 bp, Homo sapiens
  misc_feature: GYAE6OF01D47H7.48.33.C11.1.454.CMB.1.raw
  modified_base (155)..(164): a, c, t, g, unknown or other
  misc_feature (155)..(164): n is a, c, g, or t
tcagagtatacatacacgaccggtgctcgatttagagtgagctcgttgggtttgggaccaaggtggaagtcaaacgaactgtggctgcaccatctgtcttcatcttcccgccatctgatatgtatactctgagcgggctggctaaggcgcatagnnnnnnnnnn

SEQ ID NO: 259785 - DNA, 154 bp, Homo sapiens; identical to SEQ ID NO: 259781
  misc_feature: GYAE6OF01DUFIW.48.33.C11.1.454.CMB.1.raw
  modified_base (154)..(154): a, c, t, g, unknown or other
  misc_feature (154)..(154): n is a, c, g, or t

SEQ ID NO: 259786 - DNA, 176 bp, Homo sapiens
  misc_feature: GYAE6OF01DUNRY.48.33.C11.1.454.CMB.1.raw
  modified_base (157)..(176): a, c, t, g, unknown or other
  misc_feature (157)..(176): n is a, c, g, or t
tcagagtatacatacacgaccggtgctcgatttagagtgagctcgttgggtttgggaccgaaggtggaagtcaaacgaactgtggctgcaccatctgtcttccatcttcccgccatctgatatgtatactcgtgagcgggctggcaaggcgcatagnnnnnnnnnnnnnnnnnnnn

SEQ ID NO: 259787 - DNA, 154 bp, Homo sapiens; identical to SEQ ID NO: 259781
  misc_feature: GYAE6OF01EXJ77.48.33.C11.1.454.CMB.1.raw
  modified_base (154)..(154): a, c, t, g, unknown or other
  misc_feature (154)..(154): n is a, c, g, or t

SEQ ID NO: 259788 - DNA, 189 bp, Homo sapiens
  misc_feature: GYAE6OF01AEAHE.48.33.C11.1.454.CMB.1.raw
  modified_base (149)..(149): a, c, t, g, unknown or other
  misc_feature (149)..(149): n is a, c, g, or t
  modified_base (155)..(189): a, c, t, g, unknown or other
  misc_feature (155)..(189): n is a, c, g, or t
tcagagtatacatacacgaccggtgctcgatttagagtgagctcgttgggtttgggaccaaggtggaagtcaaacgaactgtggctgcaccatctcgtcttcatcttcccgccatctgatatgtatactctgagcgggctggcaaggcncatagnnnnnnnnnnnnnnnnnnnnnnnnnnnnnnnnnnn

SEQ ID NO: 259789 - DNA, 154 bp, Homo sapiens; identical to SEQ ID NO: 259781
  misc_feature: GYAE6OF01A8ZSB.48.33.C11.1.454.CMB.1.raw
  modified_base (154)..(154): a, c, t, g, unknown or other
  misc_feature (154)..(154): n is a, c, g, or t

SEQ ID NO: 259790 - DNA, 174 bp, Homo sapiens
  misc_feature: GYAE6OF01DS0ML.48.33.C11.1.454.CMB.1.raw
  modified_base (148)..(148): a, c, t, g, unknown or other
  misc_feature (148)..(148): n is a, c, g, or t
  modified_base (154)..(174): a, c, t, g, unknown or other
  misc_feature (154)..(174): n is a, c, g, or t
tcagagtatacatacacgaccggtgctcgatttagagtgagctcgttgggtttgggaccaaggtggaagtcaaacgaactgtggctgcaccatctgtcttcatcttcccgccatctgatatgtatactctgagcgggctggcaaggcncatagnnnnnnnnnnnnnnnnnnnnn

SEQ ID NO: 259791 - DNA, 193 bp, Homo sapiens
  misc_feature: GYAE6OF01B5Z8V.48.33.C11.1.454.CMB.1.raw
  modified_base (159)..(193): a, c, t, g, unknown or other
  misc_feature (159)..(193): n is a, c, g, or t
tcagagtatacatacacgaccggtgctcgatttagagtgagctcgttggggtttgggaccaaggtggaagtcaaacgaactgtggctgcaccatctgtcttcatcttcccgacactctgatatgtatacctctgagcgggctgggacaaggcgcatagnnnnnnnnnnnnnnnnnnnnnnnnnnnnnnnnnnn

SEQ ID NO: 259792 - DNA, 210 bp, Homo sapiens
  misc_feature: GYAE6OF01BHGE2.48.33.C11.1.454.CMB.1.raw
  modified_base (160)..(210): a, c, t, g, unknown or other
  misc_feature (160)..(210): n is a, c, g, or t
tcagagtatacatacacgaccggtgctcgatttagagtgagctcgttggggtttgggaccaaaggtggaagtcaaacgaactgtggctgcaccatctgtcttcagtccttcccgccatctgatagtgtatactctgagcgggctggccaaggcgcatagnnnnnnnnnnnnnnnnnnnnnnnnnnnnnnnnnnnnnnnnnnnnnnnnnnn

SEQ ID NO: 259793 - DNA, 217 bp, Homo sapiens
  misc_feature: GYAE6OF01D9R66.48.33.C11.1.454.CMB.1.raw
  modified_base (169)..(169): a, c, t, g, unknown or other
  misc_feature (169)..(169): n is a, c, g, or t
  modified_base (172)..(217): a, c, t, g, unknown or other
  misc_feature (172)..(217): n is a, c, g, or t
tcagagtatacatacacgaccggtgctcgattttagagtgagctcggttggggtttggggaccaaggtggaagtcaaacgaacctgtggctgcaccagtctgtcttcatcttcccgccatctgatatgtatactcgtgagcggggctagggccgaagggcgcaagtagntannnnnnnnnnnnnnnnnnnnnnnnnnnnnnnnnnnnnnnnnnnnnn

SEQ ID NO: 259794 - DNA, 155 bp, Homo sapiens
  misc_feature: GYAE6OF01AMZGU.48.33.C11.1.454.CMB.1.raw
  modified_base (154)..(155): a, c, t, g, unknown or other
  misc_feature (154)..(155): n is a, c, g, or t
tcagagtatacatacacgaccggtgctcgatttagagtgagctcgttgggtttgggaccaaggtggaagtcaaacgaactgtggctgcaccatctgtcttcatcttcccgccatctgatatgtatactctgagcgggctggcaaggcgcatagnn

SEQ ID NO: 259795 - DNA, 196 bp, Homo sapiens
  misc_feature: GYAE6OF01ATBNH.48.33.C11.1.454.CMB.1.raw
  modified_base (157)..(196): a, c, t, g, unknown or other
  misc_feature (157)..(196): n is a, c, g, or t
tcagagtatacatacacgaccggtgctcgatttagagtgagctcgttagggtttgggaccgaaggtggaagtcaaacgaactgtggctgcaccatctgtcttcatcttcccgccatcctgatatgtatactctgagcgggctggcaaggcgcatagnnnnnnnnnnnnnnnnnnnnnnnnnnnnnnnnnnnnnnnn

SEQ ID NO: 259796 - DNA, 155 bp, Homo sapiens
  misc_feature: GYAE6OF01CLAF8.48.33.C11.1.454.CMB.1.raw
  modified_base (155)..(155): a, c, t, g, unknown or other
  misc_feature (155)..(155): n is a, c, g, or t
tcagagtatacatacacgaccggtgctcgatttagagtgagctcgttgggtttgggaccaaggtggaagtcaaacgaactgtggctgcaccatctgtcttcatcttcccgccatctgatatgtatactctgaggcgggctggcaaggcgcatagn

SEQ ID NO: 259797 - DNA, 154 bp, Homo sapiens; identical to SEQ ID NO: 259781
  misc_feature: GYAE6OF01CF68S.48.33.C11.1.454.CMB.1.raw
  modified_base (154)..(154): a, c, t, g, unknown or other
  misc_feature (154)..(154): n is a, c, g, or t

SEQ ID NO: 259798 - DNA, 160 bp, Homo sapiens
  misc_feature: GYAE6OF01C26PZ.48.33.C11.1.454.CMB.1.raw
  modified_base (154)..(160): a, c, t, g, unknown or other
  misc_feature (154)..(160): n is a, c, g, or t
tcagagtatacatacacgaccggtgctcgatttagagtgagctcgttgggtttgggaccaaggtggaagtcaaacgaactgtggctgcaccatctgtcttcatcttcccgccatctgatatgtatactctgagcgggctggcaaggcgcatagnnnnnnn

SEQ ID NO: 259799 - DNA, 220 bp, Homo sapiens
  misc_feature: GYAE6OF02FXKM8.48.33.C11.1.454.CMB.1.raw
  modified_base (219)..(220): a, c, t, g, unknown or other
  misc_feature (219)..(220): n is a, c, g, or t
tcagagtatacatacacgaccggtgctcgatttagagtgagctcgttgggtttgggccaagggacaacggtcaccgtctcttcagcctccaccaagggcccatcggtcttcccctggcgccctgctccaggagcacctccgagagcacagcggccctgggctgcctggtcaaggactacttcctatgtatactctgagcgggctggcaaggcgcatagnn

SEQ ID NO: 259800 - DNA, 154 bp, Homo sapiens; identical to SEQ ID NO: 259781
  misc_feature: GYAE6OF02IBTEC.48.33.C11.1.454.CMB.1.raw
  modified_base (154)..(154): a, c, t, g, unknown or other
  misc_feature (154)..(154): n is a, c, g, or t

SEQ ID NO: 259801 - DNA, 155 bp, Homo sapiens; identical to SEQ ID NO: 259794
  misc_feature: GYAE6OF02GXSUR.48.33.C11.1.454.CMB.1.raw
  modified_base (154)..(155): a, c, t, g, unknown or other
  misc_feature (154)..(155): n is a, c, g, or t

SEQ ID NO: 259802 - DNA, 154 bp, Homo sapiens; identical to SEQ ID NO: 259781
  misc_feature: GYAE6OF02I5SE3.48.33.C11.1.454.CMB.1.raw
  modified_base (154)..(154): a, c, t, g, unknown or other
  misc_feature (154)..(154): n is a, c, g, or t

SEQ ID NO: 259803 - DNA, 154 bp, Homo sapiens
  misc_feature: GYAE6OF02IDVL5.48.33.C11.1.454.CMB.1.raw
  modified_base (154)..(154): a, c, t, g, unknown or other
  misc_feature (154)..(154): n is a, c, g, or t
tcagagtatacatacacgaccggtgctcgatttagagtgagctcgttgggtttgggaccaaggtggaattcaaacgaactgtggctgcaccatctgtcttcatcttcccgccatctgatatgtatactctgagcgggctggcaaggcgcatagn

SEQ ID NO: 259804 - DNA, 154 bp, Homo sapiens; identical to SEQ ID NO: 259781
  misc_feature: GYAE6OF02HEE9R.48.33.C11.1.454.CMB.1.raw
  modified_base (154)..(154): a, c, t, g, unknown or other
  misc_feature (154)..(154): n is a, c, g, or t

SEQ ID NO: 259805 - DNA, 154 bp, Homo sapiens; identical to SEQ ID NO: 259781
  misc_feature: GYAE6OF02FE60V.48.33.C11.1.454.CMB.1.raw
  modified_base (154)..(154): a, c, t, g, unknown or other
  misc_feature (154)..(154): n is a, c, g, or t

SEQ ID NO: 259806 - DNA, 154 bp, Homo sapiens; identical to SEQ ID NO: 259781
  misc_feature: GYAE6OF02G4I3U.48.33.C11.1.454.CMB.1.raw
  modified_base (154)..(154): a, c, t, g, unknown or other
  misc_feature (154)..(154): n is a, c, g, or t

SEQ ID NO: 259807 - DNA, 154 bp, Homo sapiens; identical to SEQ ID NO: 259781
  misc_feature: GYAE6OF02GK3NI.48.33.C11.1.454.CMB.1.raw
  modified_base (154)..(154): a, c, t, g, unknown or other
  misc_feature (154)..(154): n is a, c, g, or t

SEQ ID NO: 259808 - DNA, 153 bp, Homo sapiens; identical to SEQ ID NO: 259778
  misc_feature: GYAE6OF02I3V8T.48.33.C11.1.454.CMB.1.raw

SEQ ID NO: 259809 - DNA, 155 bp, Homo sapiens
  misc_feature: GYAE6OF02G30G1.48.33.C11.1.454.CMB.1.raw
  modified_base (154)..(155): a, c, t, g, unknown or other
  misc_feature (154)..(155): n is a, c, g, or t
tcagagtatacatacacgaccggtgctcgatttagagtgagctcgttgggttgggaccaaggtggaagtacaaacgaactgtggctgcaccatctgtcttcatcttcccgccatctgatatgtatactctgagcgggctggcaaggcgcatagnn

SEQ ID NO: 259810 - DNA, 154 bp, Homo sapiens; identical to SEQ ID NO: 259781
  misc_feature: GYAE6OF02FV4S2.48.33.C11.1.454.CMB.1.raw
  modified_base (154)..(154): a, c, t, g, unknown or other
  misc_feature (154)..(154): n is a, c, g, or t

SEQ ID NO: 259811 - DNA, 154 bp, Homo sapiens; identical to SEQ ID NO: 259781
  misc_feature: GYAE6OF02G7R0E.48.33.C11.1.454.CMB.1.raw
  modified_base (154)..(154): a, c, t, g, unknown or other
  misc_feature (154)..(154): n is a, c, g, or t

SEQ ID NO: 259812 - DNA, 290 bp, Homo sapiens
  misc_feature: GYAE6OF01CC4ZF.11.4.A04.1.454.CMB.1.raw
  modified_base (288)..(290): a, c, t, g, unknown or other
  misc_feature (288)..(290): n is a, c, g, or t
tcagcgagagataccacgaccggtgctcgatttagagtagtgatcagggatccctgagcaaatctctggctccaattctgggaacacggccaccctgaccatcagcagggtcgaggccggggatgacgccgactattactgtcaggtgtgggataacagtcgtgatcatgtggtgttcggcggagggaccaagctgaccgtcctaagtcagcccaaggctgccccctcggtcactctgttcccgccctcctcgtatctctcgctgagcgggctggcaaggcgcatagnnn

SEQ ID NO: 259813 - DNA, 293 bp, Homo sapiens
  misc_feature: GYAE6OF01E0T2B.11.4.A04.1.454.CMB.1.raw
  modified_base (289)..(293): a, c, t, g, unknown or other
  misc_feature (289)..(293): n is a, c, g, or t
tcagcgagagataccacgaccggtgctcgatttagagtagtgatcagggatccctgagcaaatctctggctccaattctgggaacacggccaccctgaccatcagcagggtcgaggccggggatgacgccgactattactgtcaggtgtgggataacagtcgtgatcatgtggtgttcggcggaggaccaagctgaccgtcctaagtcagcccaaggctcgccccctcggtcactctcgttccccaccctcctcgtatctctcgctgagcggctggcaaggcgcatagnnnnn

SEQ ID NO: 259814 - DNA, 243 bp, Homo sapiens
  misc_feature: GYAE6OF01CXM9K.43.24.C02.1.454.CMB.1.raw
  modified_base (238)..(243): a, c, t, g, unknown or other
  misc_feature (238)..(243): n is a, c, g, or t
tcagtgtgagtagtcacgaccggtgctcgatttagtacagatcgttagggaaagggacggtatggacgtctggggccaagggaccacggtcaccgtctcctcagcctccaccaagggcccatcggtcttcccctggcgccctgctccaggagcacctccgagagcacagcggccctgggctgcctggtcaaggactacttccactactcacactgagcgggctggcaaggcgcatagnnnnnn

SEQ ID NO: 259815 - DNA, 242 bp, Homo sapiens
  misc_feature: GYAE6OF01D96KJ.43.24.C02.1.454.CMB.1.raw
  modified_base (238)..(242): a, c, t, g, unknown or other
  misc_feature (238)..(242): n is a, c, g, or t
tcagtgtgagtagtcacgaccggtgctcgatttagtacagatcgttagggaaagggacggtatggacgtctggggccaagggaccacggtcaccgtctcctcagcctccaccaagggcccatcggtcttcccctggcgccctgctccaggagcacctccgagagcacagcggccctgggctgcctggtcaaggactacttccactactcacactgagcgggctggcaaggcgcatagnnnnn

SEQ ID NO: 259816 - DNA, 240 bp, Homo sapiens
  misc_feature: GYAE6OF01D88SG.43.24.C02.1.454.CMB.1.raw
  modified_base (238)..(240): a, c, t, g, unknown or other
  misc_feature (238)..(240): n is a, c, g, or t
tcagtgtgagtagtcacgaccggtgctcgatttagtacagatcgttagggaaaggggacggtatggacgtctggggccaagggaccacggtcaccgtctcctcagcctccaccaaggcccatcggtcttcccctggcgccctgctccaggagcacctccgagagcacagcggccctgggctgcctggtcaaggactacttccactactcacactgagcgggctggcaaggcgcatagnnn

SEQ ID NO: 259817 - DNA, 242 bp, Homo sapiens
  misc_feature: GYAE6OF01BDC2H.43.24.C02.1.454.CMB.1.raw
  modified_base (239)..(242): a, c, t, g, unknown or other
  misc_feature (239)..(242): n is a, c, g, or t
tcagtgtgagtagtcacgaccggtgctcgatttagtacagatcgttagggaaaggggacggtatggacgtctggggccaagggaccacggtcaccgtctcctcagcctccaccaagggcccatcggtcttcccctggcgccctgctccaggagcacctccgagagcacagcggccctgggctgcctggtcaaggactacttccactactcacactgagcgggctggcaaggcgcatagnnnn

SEQ ID NO: 259818 - DNA, 242 bp, Homo sapiens
  misc_feature: GYAE6OF01B7MZ8.43.24.C02.1.454.CMB.1.raw
  modified_base (240)..(242): a, c, t, g, unknown or other
  misc_feature (240)..(242): n is a, c, g, or t
tcagtgtgagtagtcacgaccggtgctcgatttagtacagatcgttagggaaaggggacggtatggacgtctggggccaagggaccacggtcaccgtctcctcagcctccaccaagggcccatcggtcttccccctggcgccctgctccaggagcacctccgagagcacagcggccctgggctgcctggtcaaggactacttccactactcacactgagcgggctggcaaggcgcatagnnn

SEQ ID NO: 259819 - DNA, 241 bp, Homo sapiens
  misc_feature: GYAE6OF01CK2N4.43.24.C02.1.454.CMB.1.raw
  modified_base (239)..(241): a, c, t, g, unknown or other
  misc_feature (239)..(241): n is a, c, g, or t
tcagtgtgagtagtcacgaccggtgctcgatttagtacagatcgttagggaaaggggacggtatggacgtctggggccaagggaccacggtcaccgtctcctcagcctccaccaagggcccatcggtcttcccctggcgccctgctccaggagcacctccgagagcacagcggccctgggctgcctggtcaaggactacttccactactcacactgagcgggctggcaaggcgcatagnnn

SEQ ID NO: 259820 - DNA, 243 bp, Homo sapiens
  misc_feature: GYAE6OF01BSM2A.43.24.C02.1.454.CMB.1.raw
  modified_base (239)..(243): a, c, t, g, unknown or other
  misc_feature (239)..(243): n is a, c, g, or t
tcagtgtgagtagtcacgaccggtgctcgatttagtacagatcgttagggaaaggggacggtatggacgtctggggccaagggaccacggtcaccgtctcctcagcctccaccaagggcccatcggtcttcccctggcgccctgctccaggagcacctccgagagcacagcggccctgggctgcctggtcaaggactacttccactactcacactgagcgggctggcaaggcgcatagnnnnn

SEQ ID NO: 259821 - DNA, 241 bp, Homo sapiens
  misc_feature: GYAE6OF01B2OBI.43.24.C02.1.454.CMB.1.raw
  modified_base (238)..(241): a, c, t, g, unknown or other
  misc_feature (238)..(241): n is a, c, g, or t
tcagtgtgagtagtcacgaccggtgctcgatttagtacagatcgttagggaaagggacggtatggacgtctggggccaagggaccacggtcaccgtctcctcagcctccaccaagggcccatcggtcttcccctggcgccctgctccaggagcacctccgagagcacagcggccctgggctgcctggtcaaggactacttccactactcacactgagcgggctggcaaggcgcatagnnnn

SEQ ID NO: 259822 - DNA, 242 bp, Homo sapiens
  misc_feature: GYAE6OF01CXGBC.43.24.C02.1.454.CMB.1.raw
  modified_base (233)..(233): a, c, t, g, unknown or other
  misc_feature (233)..(233): n is a, c, g, or t
  modified_base (239)..(242): a, c, t, g, unknown or other
  misc_feature (239)..(242): n is a, c, g, or t
tcagtgtgagtagtcacgaccggtgctcgatttagtacagatcgttagggaaaggggacggtatggacgtctggggccaagggaccacggtcaccgtctcctcagcctccaccaagggcccatcggtcttcccctggcgccctgctccaggagcacctccgagagcacagcggccctgggctgcctggtcaaggactacttccactactcacactgagcgggctggcaaggcncatagnnnn

SEQ ID NO: 259823 - DNA, 243 bp, Homo sapiens; identical to SEQ ID NO: 259820
  misc_feature: GYAE6OF01ATTZ5.43.24.C02.1.454.CMB.1.raw
  modified_base (239)..(243): a, c, t, g, unknown or other
  misc_feature (239)..(243): n is a, c, g, or t

SEQ ID NO: 259824 - DNA, 282 bp, Homo sapiens
  misc_feature: GYAE6OF01BSIS1.43.24.C02.1.454.CMB.1.raw
  modified_base (246)..(282): a, c, t, g, unknown or other
  misc_feature (246)..(282): n is a, c, g, or t
tcagtgtgagtagtcacgaccggtgctcgatttagtacagatcgttagggaaagggacggtatgggacgtctggggccaagggacccacggtcaccgtctcctcagcctccaccaagggcccgatcggtcttccccctggccgcccctggctccaggagcacctccgagagcacagcggccctgggctgcctggtcaaggactacttccactactcacactgacgcgggctggcaaggcgcatagnnnnnnnnnnnnnnnnnnnnnnnnnnnnnnnnnnnnn

SEQ ID NO: 259825 - DNA, 240 bp, Homo sapiens; identical to SEQ ID NO: 259816
  misc_feature: GYAE6OF01EZZX4.43.24.C02.1.454.CMB.1.raw
  modified_base (238)..(240): a, c, t, g, unknown or other
  misc_feature (238)..(240): n is a, c, g, or t

SEQ ID NO: 259826 - DNA, 242 bp, Homo sapiens
  misc_feature: GYAE6OF01BR5PK.43.24.C02.1.454.CMB.1.raw
  modified_base (238)..(242): a, c, t, g, unknown or other
  misc_feature (238)..(242): n is a, c, g, or t
tcagtgtgagtagtcacgaccggtgctcgatttagtacagatcgttagggaaaggggacggtatggacgtctggggccaagggaccacggtcaccgtctcctcagcctccaccaagggcccatcggtcttcccctggcgccctgctccaggagcacctccgagagcacagcggccctgggctgcctggtcaaggctacttccactactcacactgagcgggctggcaaggcgcatagnnnnn

SEQ ID NO: 259827 - DNA, 244 bp, Homo sapiens
  misc_feature: GYAE6OF01EGEGO.43.24.C02.1.454.CMB.1.raw
  modified_base (238)..(244): a, c, t, g, unknown or other
  misc_feature (238)..(244): n is a, c, g, or t
tcagtgtgagtagtcacgaccggtgctcgatttagtacagatcgttagggaaaggggacggtatggacgtctggggccaagggaccacggtcaccgtctcctcagcctccaccaagggcccatcggtcttccccctggcgccctgctccaggagcacctccgagagcacagcggccctgggctgcctggtcaaggactacttccactactcacactgagcgggctggcaggcgcatgnnnnnnn

SEQ ID NO: 259828 - DNA, 240 bp, Homo sapiens
  misc_feature: GYAE6OF02H4OY7.43.24.C02.1.454.CMB.1.raw
  modified_base (238)..(240): a, c, t, g, unknown or other
  misc_feature (238)..(240): n is a, c, g, or t
tcagtgtgagtagtcacgaccggtgctcgatttagtacagatcgttagggaaagggacggtatggacgtctggggccaagggaccacggtcaccgtctcctcagcctccaccaagggcccatcggtcttcccctggcgccctgctccaggagcacctccgagagcacagcggccctgggctgcctggtcaaggactacttccactactcacactgagcgggctggcaaggcgcatagnnn

SEQ ID NO: 259829 - DNA, 241 bp, Homo sapiens
  misc_feature: GYAE6OF02GF0PZ.43.24.C02.1.454.CMB.1.raw
  modified_base (239)..(241): a, c, t, g, unknown or other
  misc_feature (239)..(241): n is a, c, g, or t
tcagtgtgagtagtcacgaccggtgctcgatttagtacagatcgttagggaaagggacggtatggacgtctggggccaagggaccacggtcaccgtctcctcagcctccaccaagggcccatcggtcttccccctggcgccctgctccaggagcacctccgagagcacagcggccctgggctgcctggtcaaggactacttccactactcacactgagcgggctggcaaggcgcatagnnn

SEQ ID NO: 259830 - DNA, 244 bp, Homo sapiens
  misc_feature: GYAE6OF02FJEJM.43.24.C02.1.454.CMB.1.raw
  modified_base (239)..(244): a, c, t, g, unknown or other
  misc_feature (239)..(244): n is a, c, g, or t
tcagtgtgagtagtcacgaccggtgctcgatttagtacagatcgttagggaaaggggacggtatggacgtctggggccaagggaccacggtcaccgtctcctcagcctccaccaagggcccatcggtcttcccctggcgccctgctccaggagcacctccgagagcacagcggccctgggctgcctggtcaaggactacttccactactcacactgagcgggctggcaaggcgcatagnnnnnn

SEQ ID NO: 259831 - DNA, 256 bp, Homo sapiens
  misc_feature: GYAE6OF02GLY2N.43.24.C02.1.454.CMB.1.raw
  modified_base (241)..(256): a, c, t, g, unknown or other
  misc_feature (241)..(256): n is a, c, g, or t
tcagtgtgagtagtcacgaccggtgctcgatttagtacagatcgttagggaaagggggacggtatggacgtctggggccaagggaccacggtcaccgtctcctcagcctccaccaagggcccatcggtcttccccctggcgccctgctccaggagcacctccgagagcacagcggccctgggctgcctggtcaaggactacttccactactcacactgagcgggctggcaaggcgcatagnnnnnnnnnnnnnnnn

SEQ ID NO: 259832 - DNA, 245 bp, Homo sapiens
  misc_feature: GYAE6OF02GHX3E.43.24.C02.1.454.CMB.1.raw
  modified_base (239)..(245): a, c, t, g, unknown or other
  misc_feature (239)..(245): n is a, c, g, or t
tcagtgtgagtagtcacgaccggtgctcgatttagtacagatcgttagggaaaggggacggtatggacgtctggggccaagggaccacggtcaccgtctcctcagcctccaccaagggcccatcggtcttcccctggcgccctgctccaggagcacctccgagagcacagcggccctgggctgcctggtcaaggactacttccactactcacactgagcgggctggcaaggcgcatagnnnnnnn

SEQ ID NO: 259833 - DNA, 179 bp, Homo sapiens
  misc_feature: GYAE6OF01EY2ZH.34.54.E10.1.454.CMB.1.raw
  modified_base (179)..(179): a, c, t, g, unknown or other
  misc_feature (179)..(179): n is a, c, g, or t
tcagtacacgtgatcacgaccggtgctcgatttagatcgtagcagaacacacaaagggcccatcggtcttccccctggcaccctcctccaagagcacctctggggcacagcggccctgggctgcctggtcaaggactacttccatcacgtgtactgagcgggctggcaaggcgcatagn

SEQ ID NO: 259834 - DNA, 208 bp, Homo sapiens
  misc_feature: GYAE6OF01CJ0CH.34.54.E10.1.454.CMB.1.raw
  modified_base (183)..(208): a, c, t, g, unknown or other
  misc_feature (183)..(208): n is a, c, g, or t
tcagtacacgtgatcacgaccggtgctcgatttagatcgtagcagaacacacaaagggcccatcggtcttcccccgtggcaccctcctccaagagcacctcgtgggggcacagcggccctgggctgcctggtcaaggactacttccatcacgtgtactggagcgggctggcaaggcgcatagnnnnnnnnnnnnnnnnnnnnnnnnnn

SEQ ID NO: 259835 - DNA, 154 bp, Homo sapiens
  misc_feature: GYAE6OF01DYBZY.41.66.F11.1.454.CMB.1.raw
  modified_base (130)..(154): a, c, t, g, unknown or other
  misc_feature (130)..(154): n is a, c, g, or t
tcagtctatactatcacgaccggtgctcgatttagtcacgcgagaaagggtaaagggggtctggccctagcgtgttcctgttcccacctcctcatagtatagactgagcgggctggcaaggcgcagtagnnnnnnnnnnnnnnnnnnnnnnnnn

SEQ ID NO: 259836 - DNA, 128 bp, Homo sapiens
  misc_feature: GYAE6OF02JD2JE.41.66.F11.1.454.CMB.1.raw
  modified_base (119)..(128): a, c, t, g, unknown or other
  misc_feature (119)..(128): n is a, c, g, or t
tcagtctatactatcacgaccggtgctcgatttagtcacgcgagaaggaagggctggcctgacgtgtctctgttccgcctcctcatagtatagactgagcggctggcaaggcgcatagnnnnnnnnnn

SEQ ID NO: 259837 - DNA, 130 bp, Homo sapiens
  misc_feature: GYAE6OF02GT8AO.41.66.F11.1.454.CMB.1.raw
  modified_base (130)..(130): a, c, t, g, unknown or other
  misc_feature (130)..(130): n is a, c, g, or t
tcagtctatactatcacgaccggtgctcgatttagtcacgcgagaagggaagggagtcactgctggtatgctccttcatcttcccgccatctgaatagtatagactgagcgggctggcaaggcgcatagn

SEQ ID NO: 259838 - DNA, 170 bp, Homo sapiens
  misc_feature: GYAE6OF01DWDK3.1.5.A05.1.454.CMB.1.raw
  modified_base (170)..(170): a, c, t, g, unknown or other
  misc_feature (170)..(170): n is a, c, g, or t
tcagacgagtgcgtcacgaccggtgctcgatttagatagatagacaggcaccaaggccatcggtcttccctggcacctcctccaagagcacctctgggcacagcggcctggctgcctggtcaaggactacttcctcgtactgcgctgagcgggctggcaaggcgcatagn

SEQ ID NO: 259839 - DNA, 176 bp, Homo sapiens
  misc_feature: GYAE6OF01C2I4X.1.5.A05.1.454.CMB.1.raw
  modified_base (176)..(176): a, c, t, g, unknown or other
  misc_feature (176)..(176): n is a, c, g, or t
tcagacgagtgcgtcacgaccggtgctcgatttagatagatagacagggcaccaagggcccatcggtcttcccctggcaccctcctccaagagcacctctgggcacagcggccctggctgcctggtcaaggactacttccagtactctatctgagcgggctggcaaggcgcatagn

SEQ ID NO: 259840 - DNA, 251 bp, Homo sapiens
  misc_feature: GYAE6OF01ELVLP.1.5.A05.1.454.CMB.1.raw
  modified_base (249)..(251): a, c, t, g, unknown or other
  misc_feature (249)..(251): n is a, c, g, or t
tcagacgagtgcgtcacgaccggtgctcgatttagatagatagacagggcagttccagatttcaactgctcatcagcagcctgcagtctgaagatttgcagtttattactgtcagcagtataataactggcctccgacgttcggccaagggaccaaggtggaaatcaaacgaactgtggctgcaccatctgtcttcatcttcccgccatctgatcgtactgcgctgagcgggctggcaaggcgcatagnnn

SEQ ID NO: 259841 - DNA, 179 bp, Homo sapiens
  misc_feature: GYAE6OF01CQC9O.1.5.A05.1.454.CMB.1.raw
  modified_base (178)..(179): a, c, t, g, unknown or other
  misc_feature (178)..(179): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttccagtactctatctgagcgggctggcaaggcgcatagnn

SEQ ID NO: 259842 - DNA, 181 bp, Homo sapiens
  misc_feature: GYAE6OF01EE6R5.1.5.A05.1.454.CMB.1.raw
  modified_base (178)..(181): a, c, t, g, unknown or other
  misc_feature (178)..(181): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttccagtactctatctgagcgggctggcaaggcgcatagnnnn

SEQ ID NO: 259843 - DNA, 178 bp, Homo sapiens
  misc_feature: GYAE6OF01DOVSB.1.5.A05.1.454.CMB.1.raw
  modified_base (178)..(178): a, c, t, g, unknown or other
  misc_feature (178)..(178): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctctctcgactctgagcgggctggcaaggcgcatagn

SEQ ID NO: 259844 - DNA, 179 bp, Homo sapiens
  misc_feature: GYAE6OF01CJZHU.1.5.A05.1.454.CMB.1.raw
  modified_base (178)..(179): a, c, t, g, unknown or other
  misc_feature (178)..(179): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctctctcgactctgagcgggctggcaaggcgcatagnn

SEQ ID NO: 259845 - DNA, 517 bp, Homo sapiens
  misc_feature: GYAE6OF01DB6ZK.1.5.A05.1.454.CMB.1.raw
  modified_base (472)..(472): a, c, t, g, unknown or other
  misc_feature (472)..(472): n is a, c, g, or t
tcagacgagtgcgtcacgaccggtgctcgatttagatagatagacaggggacccaacaaccacatccctcctcagaagccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatgggatggatcaacgctggcaatggtaacacaaaaattcacagaagttccagggcagagtcacctttaccaggggacacatccgcgaggattacttatatggagctgagcagcctgagatccgaagacacggctgtatattttgtgcgtacctctagtggaggtcattattacgntcaatttgactcctggggccagggaccctggtcaccgtctcctcg

SEQ ID NO: 259846 - DNA, 260 bp, Homo sapiens
  misc_feature: GYAE6OF01DUOGY.1.5.A05.1.454.CMB.1.raw
  modified_base (257)..(260): a, c, t, g, unknown or other
  misc_feature (257)..(260): n is a, c, g, or t
tcagacgagtgcgtcacgaccggtgctcgatttagatagatagactcgcgggaagatgaagacagacttcactctcaccatcagcagcctagaacctgaagattttgcagtttattactgtcagcagcgtagcaactggccattcactttcggccctgggaccaaagtggatatcaaacgaactgtggctgcaccatctgtcttcatcttcccgccatctgaacgcactcgtctgagcggctggcaaggcgcatagnnnn

SEQ ID NO: 259847 - DNA, 182 bp, Homo sapiens
  misc_feature: GYAE6OF01BN5M8.1.5.A05.1.454.CMB.1.raw
  modified_base (178)..(182): a, c, t, g, unknown or other
  misc_feature (178)..(182): n is a, c, g, or t
tcagacgagtgcgtcacgaccggtgctcgatttagatagatagacatggcaccaagggcccatcggtcttcccctggcaccctcctccaagagcacctctggggcacagcggccctgggctgcctggtcaaggactacttccagtactctatctgagcgggctggcaaggcgcatagnnnnn

SEQ ID NO: 259848 - DNA, 182 bp, Homo sapiens
  misc_feature: GYAE6OF01DX5PE.1.5.A05.1.454.CMB.1.raw
  modified_base (178)..(182): a, c, t, g, unknown or other
  misc_feature (178)..(182): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctcgtactgcgctgagcgggctggcaaggcgcatagnnnnn

SEQ ID NO: 259849 - DNA, 178 bp, Homo sapiens
  misc_feature: GYAE6OF01D8XUB.1.5.A05.1.454.CMB.1.raw
  modified_base (177)..(178): a, c, t, g, unknown or other
  misc_feature (177)..(178): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctcgtactgcgcgagcgggctggcaaggcgcatagnn

SEQ ID NO: 259850 - DNA, 252 bp, Homo sapiens
  misc_feature: GYAE6OF01CI7GG.1.5.A05.1.454.CMB.1.raw
  modified_base (251)..(252): a, c, t, g, unknown or other
  misc_feature (251)..(252): n is a, c, g, or t
tcagacgagtgcgtcacgaccggtgctcgatttagatagatagacaggtgcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatctgactcgtctctactgagcgggctggcaaggcgcatagnn

SEQ ID NO: 259851 - DNA, 178 bp, Homo sapiens
  misc_feature: GYAE6OF01A8BG1.1.5.A05.1.454.CMB.1.raw
  modified_base (177)..(178): a, c, t, g, unknown or other
  misc_feature (177)..(178): n is a, c, g, or t
tcagacgagtgcgtcacgaccggtgctcgatttagatagatagacagggcaccaagggcccatcggtcttcccctggcaccctcctccaagagcacctctgggcacagcggccctgggctgcctggtcaaggactacttcctcgtactgcgctgagcgggctggcaaggcgcatagnn

SEQ ID NO: 259852 - DNA, 178 bp, Homo sapiens
  misc_feature: GYAE6OF01CL9MS.1.5.A05.1.454.CMB.1.raw
  modified_base (178)..(178): a, c, t, g, unknown or other
  misc_feature (178)..(178): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttccgagtgcgtctctgagcgggctggcaaggcgcatagn

SEQ ID NO: 259853 - DNA, 179 bp, Homo sapiens
  misc_feature: GYAE6OF01B7MKS.1.5.A05.1.454.CMB.1.raw
  modified_base (178)..(179): a, c, t, g, unknown or other
  misc_feature (178)..(179): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttccatagcgtactctgagcgggctggcaaggcgcatagnn

SEQ ID NO: 259854 - DNA, 254 bp, Homo sapiens
  misc_feature: GYAE6OF01DGUYF.1.5.A05.1.454.CMB.1.raw
  modified_base (252)..(254): a, c, t, g, unknown or other
  misc_feature (252)..(254): n is a, c, g, or t
tcagacgagtgcgtcacgaccggtgctcgatttagatagatagacagggcagttccagatttcaactgctcatcagcagcctgcagtctgaagattttgctagttttattactgtcagcagtataataactggcctccgacgttcggccaagggaccaaggtggaaatcaaacgaactgtggctgcaccatctgtcttcatcttcccgccatctgatcgtactgcgctgagcgggctggcaaggcgcatagnnn

SEQ ID NO: 259855 - DNA, 179 bp, Homo sapiens; identical to SEQ ID NO: 259841
  misc_feature: GYAE6OF01EN0RV.1.5.A05.1.454.CMB.1.raw
  modified_base (178)..(179): a, c, t, g, unknown or other
  misc_feature (178)..(179): n is a, c, g, or t

SEQ ID NO: 259856 - DNA, 182 bp, Homo sapiens; identical to SEQ ID NO: 259848
  misc_feature: GYAE6OF01A87U3.1.5.A05.1.454.CMB.1.raw
  modified_base (178)..(182): a, c, t, g, unknown or other
  misc_feature (178)..(182): n is a, c, g, or t

SEQ ID NO: 259857 - DNA, 178 bp, Homo sapiens; identical to SEQ ID NO: 259843
  misc_feature: GYAE6OF01DL9JW.1.5.A05.1.454.CMB.1.raw
  modified_base (178)..(178): a, c, t, g, unknown or other
  misc_feature (178)..(178): n is a, c, g, or t

SEQ ID NO: 259858 - DNA, 178 bp, Homo sapiens
  misc_feature: GYAE6OF01E2X8Q.1.5.A05.1.454.CMB.1.raw
  modified_base (178)..(178): a, c, t, g, unknown or other
  misc_feature (178)..(178): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctcgtactgcgctgagcgggctggcaaggcgcatagn

SEQ ID NO: 259859 - DNA, 178 bp, Homo sapiens; identical to SEQ ID NO: 259843
  misc_feature: GYAE6OF01ELT5E.1.5.A05.1.454.CMB.1.raw
  modified_base (178)..(178): a, c, t, g, unknown or other
  misc_feature (178)..(178): n is a, c, g, or t

SEQ ID NO: 259860 - DNA, 198 bp, Homo sapiens
  misc_feature: GYAE6OF01BEBWW.1.5.A05.1.454.CMB.1.raw
  modified_base (179)..(198): a, c, t, g, unknown or other
  misc_feature (179)..(198): n is a, c, g, or t
tcagacgagtgcgtcacgaccggtgctcgatttagatagatagacgagggcaccaagggcccatcggtcttcccctggcaccctcctccaagagcacctctggggcacagcggccctgggctgcctggtcaaggactacttcctctctcgactctgagcgggctggcaaggcgcatagnnnnnnnnnnnnnnnnnnnn

SEQ ID NO: 259861 - DNA, 179 bp, Homo sapiens; identical to SEQ ID NO: 259841
  misc_feature: GYAE6OF01BT6M6.1.5.A05.1.454.CMB.1.raw
  modified_base (178)..(179): a, c, t, g, unknown or other
  misc_feature (178)..(179): n is a, c, g, or t

SEQ ID NO: 259862 - DNA, 252 bp, Homo sapiens
  misc_feature: GYAE6OF01CC8UF.1.5.A05.1.454.CMB.1.raw
  modified_base (250)..(252): a, c, t, g, unknown or other
  misc_feature (250)..(252): n is a, c, g, or t
tcagacgagtgcgtcacgaccggtgctcgatttagatagatagacagggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatctgatcgtactgcgctgagcgggctggcaaggcgcatagnnn

SEQ ID NO: 259863 - DNA, 182 bp, Homo sapiens
  misc_feature: GYAE6OF01BYROR.1.5.A05.1.454.CMB.1.raw
  modified_base (178)..(182): a, c, t, g, unknown or other
  misc_feature (178)..(182): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttccagtactctatctgagcgggctggcaaggcgcatagnnnnn

SEQ ID NO: 259864 - DNA, 180 bp, Homo sapiens
  misc_feature: GYAE6OF01BSA7P.1.5.A05.1.454.CMB.1.raw
  modified_base (178)..(180): a, c, t, g, unknown or other
  misc_feature (178)..(180): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctctctcgactctgagcgggctggcaaggcgcatagnnn

SEQ ID NO: 259865 - DNA, 252 bp, Homo sapiens; identical to SEQ ID NO: 259862
  misc_feature: GYAE6OF01DLP0E.1.5.A05.1.454.CMB.1.raw
  modified_base (250)..(252): a, c, t, g, unknown or other
  misc_feature (250)..(252): n is a, c, g, or t

SEQ ID NO: 259866 - DNA, 178 bp, Homo sapiens
  misc_feature: GYAE6OF01E4SIN.1.5.A05.1.454.CMB.1.raw
  modified_base (178)..(178): a, c, t, g, unknown or other
  misc_feature (178)..(178): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctcgatcgcgtctgagcgggctggcaaggcgcatagn

SEQ ID NO: 259867 - DNA, 175 bp, Homo sapiens
  misc_feature: GYAE6OF01A9AUW.1.5.A05.1.454.CMB.1.raw
  modified_base (175)..(175): a, c, t, g, unknown or other
  misc_feature (175)..(175): n is a, c, g, or t
tcagacgagtgcgtcacgaccggtgctcgatttagatagatagacagggcaccaaggcccatcggtcttccctggcaccctcctccaagagcacctctgggcacagcggccctgggctgcctggtcaaggactacttcctctctcgactctgagcgggctggcaaggcgcatagn

SEQ ID NO: 259868 - DNA, 180 bp, Homo sapiens
  misc_feature: GYAE6OF01BAJ55.1.5.A05.1.454.CMB.1.raw
  modified_base (178)..(180): a, c, t, g, unknown or other
  misc_feature (178)..(180): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctcgtactgcgctgagcgggctggcaaggcgcatagnnn

SEQ ID NO: 259869 - DNA, 178 bp, Homo sapiens; identical to SEQ ID NO: 259858
  misc_feature: GYAE6OF01DAXGJ.1.5.A05.1.454.CMB.1.raw
  modified_base (178)..(178): a, c, t, g, unknown or other
  misc_feature (178)..(178): n is a, c, g, or t

SEQ ID NO: 259870 - DNA, 179 bp, Homo sapiens
  misc_feature: GYAE6OF01BQW52.1.5.A05.1.454.CMB.1.raw
  modified_base (178)..(179): a, c, t, g, unknown or other
  misc_feature (178)..(179): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttccacgcactcgtctgagcgggctggcaaggcgcatagnn

SEQ ID NO: 259871 - DNA, 255 bp, Homo sapiens
  misc_feature: GYAE6OF01D2YLW.1.5.A05.1.454.CMB.1.raw
  modified_base (251)..(255): a, c, t, g, unknown or other
  misc_feature (251)..(255): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatctgatcgtactgcgctgagcgggctggcaaggcgcatagnnnnn

SEQ ID NO: 259872 - DNA, 180 bp, Homo sapiens
  misc_feature: GYAE6OF01DUKIE.1.5.A05.1.454.CMB.1.raw
  modified_base (178)..(180): a, c, t, g, unknown or other
  misc_feature (178)..(180): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctcgatcgcgtctgagcgggctggcaaggcgcatagnnn

SEQ ID NO: 259873 - DNA, 182 bp, Homo sapiens
  misc_feature: GYAE6OF01DD2BY.1.5.A05.1.454.CMB.1.raw
  modified_base (178)..(182): a, c, t, g, unknown or other
  misc_feature (178)..(182): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctctctcgactctgagcgggctggcaaggcgcatagnnnnn

SEQ ID NO: 259874 - DNA, 179 bp, Homo sapiens; identical to SEQ ID NO: 259844
  misc_feature: GYAE6OF01AGD75.1.5.A05.1.454.CMB.1.raw
  modified_base (178)..(179): a, c, t, g, unknown or other
  misc_feature (178)..(179): n is a, c, g, or t

SEQ ID NO: 259875 - DNA, 197 bp, Homo sapiens
  misc_feature: GYAE6OF01BEE4F.1.5.A05.1.454.CMB.1.raw
  modified_base (178)..(197): a, c, t, g, unknown or other
  misc_feature (178)..(197): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctcgatcgcgtctgagcgggctggcaaggcgcatagnnnnnnnnnnnnnnnnnnnn

SEQ ID NO: 259876 - DNA, 254 bp, Homo sapiens
  misc_feature: GYAE6OF01CX3QC.1.5.A05.1.454.CMB.1.raw
  modified_base (198)..(254): a, c, t, g, unknown or other
  misc_feature (198)..(254): n is a, c, g, or t
tcagacgagtgcgtcacgaccggtgctcgatttagatagatagacagggcaccaaaggggcccaatcggtccttcccctgggcaccctcctccaagagcacctctcggggcaccagcggcccgtgggcctggccctggtcctaaggtcgtacgttcctacgtactgcgactgagccgggctcggcaaggcgcgatagnnnnnnnnnnnnnnnnnnnnnnnnnnnnnnnnnnnnnnnnnnnnnnnnnnnnnnnnn

SEQ ID NO: 259877 - DNA, 322 bp, Homo sapiens
  misc_feature: GYAE6OF01DAJ4E.1.5.A05.1.454.CMB.1.raw
  modified_base (260)..(261): a, c, t, g, unknown or other
  misc_feature (260)..(261): n is a, c, g, or t
  modified_base (264)..(322): a, c, t, g, unknown or other
  misc_feature (264)..(322): n is a, c, g, or t
tcagacgagtgcgtcacgaccggtgctcgatttagatagatagacagggggcagttccagatttcaactgctcatcagcagcctgcagtctgaagattttgcagtttattactgtcagctagtataataactggccttccgacgtttcggccaagggtaccaaggtggaaatcaaacgactgtggctagcaccgatctggtcttcatcttcccgcatcgtgactcgtactgcgctgagcgggctggcaagggctcatagnnctnnnnnnnnnnnnnnnnnnnnnnnnnnnnnnnnnnnnnnnnnnnnnnnnnnnnnnnnnnn

SEQ ID NO: 259878 - DNA, 252 bp, Homo sapiens; identical to SEQ ID NO: 259862
  misc_feature: GYAE6OF01EZR9U.1.5.A05.1.454.CMB.1.raw
  modified_base (250)..(252): a, c, t, g, unknown or other
  misc_feature (250)..(252): n is a, c, g, or t

SEQ ID NO: 259879 - DNA, 179 bp, Homo sapiens
  misc_feature: GYAE6OF01CA6LJ.1.5.A05.1.454.CMB.1.raw
  modified_base (178)..(179): a, c, t, g, unknown or other
  misc_feature (178)..(179): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctcgtactgcgctgagcgggctggcaaggcgcatagnn

SEQ ID NO: 259880 - DNA, 179 bp, Homo sapiens; identical to SEQ ID NO: 259879
  misc_feature: GYAE6OF01C4EHI.1.5.A05.1.454.CMB.1.raw
  modified_base (178)..(179): a, c, t, g, unknown or other
  misc_feature (178)..(179): n is a, c, g, or t

SEQ ID NO: 259881 - DNA, 178 bp, Homo sapiens
  misc_feature: GYAE6OF01DNHUV.1.5.A05.1.454.CMB.1.raw
  modified_base (178)..(178): a, c, t, g, unknown or other
  misc_feature (178)..(178): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctatgtatactctgagcgggctggcaaggcgcatagn

SEQ ID NO: 259882 - DNA, 181 bp, Homo sapiens
  misc_feature: GYAE6OF01C65OP.1.5.A05.1.454.CMB.1.raw
  modified_base (178)..(181): a, c, t, g, unknown or other
  misc_feature (178)..(181): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctcgtactgcgctgagcgggctggcaaggcgcatagnnnn

SEQ ID NO: 259883 - DNA, 252 bp, Homo sapiens; identical to SEQ ID NO: 259862
  misc_feature: GYAE6OF01BDVD5.1.5.A05.1.454.CMB.1.raw
  modified_base (250)..(252): a, c, t, g, unknown or other
  misc_feature (250)..(252): n is a, c, g, or t

SEQ ID NO: 259884 - DNA, 179 bp, Homo sapiens
  misc_feature: GYAE6OF01EBI6P.1.5.A05.1.454.CMB.1.raw
  modified_base (179)..(179): a, c, t, g, unknown or other
  misc_feature (179)..(179): n is a, c, g, or t
tcagacgagtgcgtcacgaccggtgctcgatttagatagatagacagggcaccaagggcccatcggtcttcccctggcaccctcctccaagagcacctctgggtgcacagcggccctgggctgcctggtcaaggactacttcctcgtactgcgctgagcgggctggcaaggcgcatagn

SEQ ID NO: 259885 - DNA, 256 bp, Homo sapiens
  misc_feature: GYAE6OF01DX4A4.1.5.A05.1.454.CMB.1.raw
  modified_base (252)..(256): a, c, t, g, unknown or other
  misc_feature (252)..(256): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatccttcccgccatctgatcgtactgcgctgagcgggctggcaaggcgcatagnnnnn

SEQ ID NO: 259886 - DNA, 180 bp, Homo sapiens; identical to SEQ ID NO: 259868
  misc_feature: GYAE6OF01BM32K.1.5.A05.1.454.CMB.1.raw
  modified_base (178)..(180): a, c, t, g, unknown or other
  misc_feature (178)..(180): n is a, c, g, or t

SEQ ID NO: 259887 - DNA, 178 bp, Homo sapiens; identical to SEQ ID NO: 259858
  misc_feature: GYAE6OF01DIHJT.1.5.A05.1.454.CMB.1.raw
  modified_base (178)..(178): a, c, t, g, unknown or other
  misc_feature (178)..(178): n is a, c, g, or t

SEQ ID NO: 259888 - DNA, 179 bp, Homo sapiens; identical to SEQ ID NO: 259841
  misc_feature: GYAE6OF01EFO54.1.5.A05.1.454.CMB.1.raw
  modified_base (178)..(179): a, c, t, g, unknown or other
  misc_feature (178)..(179): n is a, c, g, or t

SEQ ID NO: 259889 - DNA, 253 bp, Homo sapiens
  misc_feature: GYAE6OF01COAXD.1.5.A05.1.454.CMB.1.raw
  modified_base (251)..(253): a, c, t, g, unknown or other
  misc_feature (251)..(253): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatctgatcgtactgcgctgagcgggctggcaaggcgcatagnnn

SEQ ID NO: 259890 - DNA, 251 bp, Homo sapiens
  misc_feature: GYAE6OF01A4M1C.1.5.A05.1.454.CMB.1.raw
  modified_base (250)..(251): a, c, t, g, unknown or other
  misc_feature (250)..(251): n is a, c, g, or t
tcagacgagtgcgtcacgaccggtgctcgatttagatagatagacagggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatctgagagtgcgtctctgagcgggctggcaaggcgcatagnn

SEQ ID NO: 259891 - DNA, 178 bp, Homo sapiens
  misc_feature: GYAE6OF01DRMB5.1.5.A05.1.454.CMB.1.raw
  modified_base (178)..(178): a, c, t, g, unknown or other
  misc_feature (178)..(178): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttccagtactctatctgagcgggctggcaaggcgcatagn

SEQ ID NO: 259892 - DNA, 180 bp, Homo sapiens
  misc_feature: GYAE6OF01DC02U.1.5.A05.1.454.CMB.1.raw
  modified_base (178)..(180): a, c, t, g, unknown or other
  misc_feature (178)..(180): n is a, c, g, or t
tcagacgagtgcgtcacgaccggtgctcgatttagatagatagacagggcaccaagggcccatcgatcttcccctggcaccctcctccaagagcacctctggggcacagcggccctgggctgcctggtcaaggactacttcctgtcgagcgtctgagcgggctggcaaggcgcatagnnn

SEQ ID NO: 259893 - DNA, 179 bp, Homo sapiens; identical to SEQ ID NO: 259844
  misc_feature: GYAE6OF01AMKGY.1.5.A05.1.454.CMB.1.raw
  modified_base (178)..(179): a, c, t, g, unknown or other
  misc_feature (178)..(179): n is a, c, g, or t

SEQ ID NO: 259894 - DNA, 251 bp, Homo sapiens
  misc_feature: GYAE6OF01B6SFX.1.5.A05.1.454.CMB.1.raw
  modified_base (247)..(251): a, c, t, g, unknown or other
  misc_feature (247)..(251): n is a, c, g, or t
tcagacgagtgcgtcacgaccggtgctcgatttagatagatagacagggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttccgcatctgatcgtactgcgctgagcggctggcaaggcgcatagnnnnn

SEQ ID NO: 259895 - DNA, 257 bp, Homo sapiens
  misc_feature: GYAE6OF01AORVB.1.5.A05.1.454.CMB.1.raw
  modified_base (251)..(257): a, c, t, g, unknown or other
  misc_feature (251)..(257): n is a, c, g, or t
tcagacgagtgcgtcacgaccggtgctcgatttagatagatagacagggcgagttccagattcaactgctcatcagcagcctgcagtctgaagattttgcagtttattactgtcagcagtataataactggcctccgacgttcggccaagggaccaaggtggaaatcaaacgaactgtggctgcaccatctgtcttcatccttcccgccatctgagagtgcgtctctgagcgggctggcaaggcgcatagnnnnnnn

SEQ ID NO: 259896 - DNA, 177 bp, Homo sapiens
  misc_feature: GYAE6OF01B04SA.1.5.A05.1.454.CMB.1.raw
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctctctcgactctgagcgggctggcaaggcgcatag

SEQ ID NO: 259897 - DNA, 514 bp, Homo sapiens
  misc_feature: GYAE6OF01DJUN1.1.5.A05.1.454.CMB.1.raw
  modified_base (341)..(341): a, c, t, g, unknown or other
  misc_feature (341)..(341): n is a, c, g, or t
  modified_base (437)..(437): a, c, t, g, unknown or other
  misc_feature (437)..(437): n is a, c, g, or t
  modified_base (443)..(443): a, c, t, g, unknown or other
  misc_feature (443)..(443): n is a, c, g, or t
  modified_base (470)..(470): a, c, t, g, unknown or other
  misc_feature (470)..(470): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggccccggacaaaggcttgagtggatgggatggatcaacgctggcaatggtaacacaaaaaattcaanagaaagttccagggcagagtcacctttacagggacacatccgcgaggattactatatggagctgagcagcctgagatccgaagacacggctgtatnttttgngcgtactctagtggagtcattatacgntctattgactcgtgggccagggaaccctggacaccgtctctacg

SEQ ID NO: 259898 - DNA, 179 bp, Homo sapiens
  misc_feature: GYAE6OF01EU99G.1.5.A05.1.454.CMB.1.raw
  modified_base (178)..(179): a, c, t, g, unknown or other
  misc_feature (178)..(179): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctacgtgagctctgagcgggctggcaaggcgcatagnn

SEQ ID NO: 259899 - DNA, 177 bp, Homo sapiens
  misc_feature: GYAE6OF01DUX59.1.5.A05.1.454.CMB.1.raw
  modified_base (177)..(177): a, c, t, g, unknown or other
  misc_feature (177)..(177): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctacgtagctctgagcgggctggcaaggcgcatagn

SEQ ID NO: 259900 - DNA, 178 bp, Homo sapiens
  misc_feature: GYAE6OF01BVHY0.1.5.A05.1.454.CMB.1.raw
  modified_base (178)..(178): a, c, t, g, unknown or other
  misc_feature (178)..(178): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctactgctagtctgagcgggctggcaaggcgcatagn

SEQ ID NO: 259901 - DNA, 252 bp, Homo sapiens
  misc_feature: GYAE6OF01B4YJJ.1.5.A05.1.454.CMB.1.raw
  modified_base (250)..(252): a, c, t, g, unknown or other
  misc_feature (250)..(252): n is a, c, g, or t
tcagacgagtgcgtcacgaccggtgctcgatttagatagatagacagggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccctcctctatacgatcgctgagcgggctggcaaggcgcatagnnn

SEQ ID NO: 259902 - DNA, 255 bp, Homo sapiens
  misc_feature: GYAE6OF01CRCGN.1.5.A05.1.454.CMB.1.raw
  modified_base (252)..(255): a, c, t, g, unknown or other
  misc_feature (252)..(255): n is a, c, g, or t
tcagacgagtgcgtcacgaccggtgctcgatttagatagatagacaggggcagttccagatttcaactgctcatcagcagcctgcagtctgaagattttgcagttttattactgtcagcagtataataactggcctacgacgttcggccaagggaccaaggtggaaatcaaacgaactgtggctgcaccatctgtcttcatcttcccgccatctgatcgtactgcgctgagcgggctggcaaggcgcatagnnnn

SEQ ID NO: 259903 - DNA, 178 bp, Homo sapiens; identical to SEQ ID NO: 259858
  misc_feature: GYAE6OF01CLN9Q.1.5.A05.1.454.CMB.1.raw
  modified_base (178)..(178): a, c, t, g, unknown or other
  misc_feature (178)..(178): n is a, c, g, or t

SEQ ID NO: 259904 - DNA, 260 bp, Homo sapiens
  misc_feature: GYAE6OF01EAG5T.1.5.A05.1.454.CMB.1.raw
  modified_base (253)..(260): a, c, t, g, unknown or other
  misc_feature (253)..(260): n is a, c, g, or t
tcagacgagtgcgtcacgaccggtgctcgatttagatagatagacaggtgccaagttccagatttcaactgctcatcagcagcctgcagtctgaagattttgcagtttattactgtcagcagtataataactggcctccgacgttcggccaagggaccaaaggtggaaatcaaaacgaactgtggctgcaccatctgtcttcatcttccgcatctgactcgtctctactgagcgggctggcaaggcgcatagnnnnnnnn

SEQ ID NO: 259905 - DNA, 181 bp, Homo sapiens; identical to SEQ ID NO: 259842
  misc_feature: GYAE6OF01BTSCY.1.5.A05.1.454.CMB.1.raw
  modified_base (178)..(181): a, c, t, g, unknown or other
  misc_feature (178)..(181): n is a, c, g, or t

SEQ ID NO: 259906 - DNA, 179 bp, Homo sapiens; identical to SEQ ID NO: 259879
  misc_feature: GYAE6OF01CLUOM.1.5.A05.1.454.CMB.1.raw
  modified_base (178)..(179): a, c, t, g, unknown or other
  misc_feature (178)..(179): n is a, c, g, or t

SEQ ID NO: 259907 - DNA, 178 bp, Homo sapiens
  misc_feature: GYAE6OF01EG84H.1.5.A05.1.454.CMB.1.raw
  modified_base (177)..(178): a, c, t, g, unknown or other
  misc_feature (177)..(178): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaagactacttccgagtgcgtctctgagcgggctggcaaggcgcatagnn

SEQ ID NO: 259908 - DNA, 179 bp, Homo sapiens; identical to SEQ ID NO: 259844
  misc_feature: GYAE6OF01EKEVU.1.5.A05.1.454.CMB.1.raw
  modified_base (178)..(179): a, c, t, g, unknown or other
  misc_feature (178)..(179): n is a, c, g, or t

SEQ ID NO: 259909 - DNA, 178 bp, Homo sapiens; identical to SEQ ID NO: 259858
  misc_feature: GYAE6OF01EIRJN.1.5.A05.1.454.CMB.1.raw
  modified_base (178)..(178): a, c, t, g, unknown or other
  misc_feature (178)..(178): n is a, c, g, or t

SEQ ID NO: 259910 - DNA, 179 bp, Homo sapiens; identical to SEQ ID NO: 259879
  misc_feature: GYAE6OF01B9DXV.1.5.A05.1.454.CMB.1.raw
  modified_base (178)..(179): a, c, t, g, unknown or other
  misc_feature (178)..(179): n is a, c, g, or t

SEQ ID NO: 259911 - DNA, 178 bp, Homo sapiens; identical to SEQ ID NO: 259891
  misc_feature: GYAE6OF01EFIKR.1.5.A05.1.454.CMB.1.raw
  modified_base (178)..(178): a, c, t, g, unknown or other
  misc_feature (178)..(178): n is a, c, g, or t

SEQ ID NO: 259912 - DNA, 253 bp, Homo sapiens
  misc_feature: GYAE6OF01DDERK.1.5.A05.1.454.CMB.1.raw
  modified_base (250)..(253): a, c, t, g, unknown or other
  misc_feature (250)..(253): n is a, c, g, or t
tcagacgagtgcgtcacgaccggtgctcgatttagatagatagacagggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatctgatcgtactgcgctgagcgggctggcaaggcgcatagnnnn

SEQ ID NO: 259913 - DNA, 180 bp, Homo sapiens
  misc_feature: GYAE6OF01B37ZP.1.5.A05.1.454.CMB.1.raw
  modified_base (177)..(180): a, c, t, g, unknown or other
  misc_feature (177)..(180): n is a, c, g, or t
tcagacgagtgcgtcacgaccggtgctcgatttagatagatagacagggcaccaagggcccatcggtcttcccctggcaccctcctccaagagcacctctggggcacagcggcctgggctgcctggtcaaggactacttccagtactctatctgagcgggctggcaaggcgcatagnnnn

SEQ ID NO: 259914 - DNA, 178 bp, Homo sapiens; identical to SEQ ID NO: 259843
  misc_feature: GYAE6OF01BPYVB.1.5.A05.1.454.CMB.1.raw
  modified_base (178)..(178): a, c, t, g, unknown or other
  misc_feature (178)..(178): n is a, c, g, or t

SEQ ID NO: 259915 - DNA, 269 bp, Homo sapiens
  misc_feature: GYAE6OF01AZE36.1.5.A05.1.454.CMB.1.raw
  modified_base (248)..(269): a, c, t, g, unknown or other
  misc_feature (248)..(269): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctcgacttcggccaagggaccaaggtgaaatcaaagaactgtggctgcaccatctgtcttcatcttcccgcatctgatcggtactgcgctgagcgggctaggcaaggcgcatagnnnnnnnnnnnnnnnnnnnnnn

SEQ ID NO: 259916 - DNA, 187 bp, Homo sapiens
  misc_feature: GYAE6OF01ESG4H.1.5.A05.1.454.CMB.1.raw
  modified_base (178)..(187): a, c, t, g, unknown or other
  misc_feature (178)..(187): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttccagtactctatctgagcgggctggcaaggcgcatagnnnnnnnnnn

SEQ ID NO: 259917 - DNA, 178 bp, Homo sapiens; identical to SEQ ID NO: 259843
  misc_feature: GYAE6OF01BTD3P.1.5.A05.1.454.CMB.1.raw
  modified_base (178)..(178): a, c, t, g, unknown or other
  misc_feature (178)..(178): n is a, c, g, or t

SEQ ID NO: 259918 - DNA, 178 bp, Homo sapiens; identical to SEQ ID NO: 259858
  misc_feature: GYAE6OF01B9T5G.1.5.A05.1.454.CMB.1.raw
  modified_base (178)..(178): a, c, t, g, unknown or other
  misc_feature (178)..(178): n is a, c, g, or t

SEQ ID NO: 259919 - DNA, 179 bp, Homo sapiens; identical to SEQ ID NO: 259841
  misc_feature: GYAE6OF01BMZDC.1.5.A05.1.454.CMB.1.raw
  modified_base (178)..(179): a, c, t, g, unknown or other
  misc_feature (178)..(179): n is a, c, g, or t

SEQ ID NO: 259920 - DNA, 178 bp, Homo sapiens; identical to SEQ ID NO: 259891
  misc_feature: GYAE6OF01ESBWU.1.5.A05.1.454.CMB.1.raw
  modified_base (178)..(178): a, c, t, g, unknown or other
  misc_feature (178)..(178): n is a, c, g, or t

SEQ ID NO: 259921 - DNA, 180 bp, Homo sapiens
  misc_feature: GYAE6OF01BQ637.1.5.A05.1.454.CMB.1.raw
  modified_base (178)..(180): a, c, t, g, unknown or other
  misc_feature (178)..(180): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctacgtgagctctgagcgggctggcaaggcgcatagnnn

SEQ ID NO: 259922 - DNA, 253 bp, Homo sapiens; identical to SEQ ID NO: 259912
  misc_feature: GYAE6OF01AQQW8.1.5.A05.1.454.CMB.1.raw
  modified_base (250)..(253): a, c, t, g, unknown or other
  misc_feature (250)..(253): n is a, c, g, or t

SEQ ID NO: 259923 - DNA, 207 bp, Homo sapiens
  misc_feature: GYAE6OF01B27E1.1.5.A05.1.454.CMB.1.raw
  modified_base (178)..(207): a, c, t, g, unknown or other
  misc_feature (178)..(207): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctcgatcgcgtctgagcgggctggcaaggcgcatagnnnnnnnnnnnnnnnnnnnnnnnnnnnnnn

SEQ ID NO: 259924 - DNA, 178 bp, Homo sapiens; identical to SEQ ID NO: 259858
  misc_feature: GYAE6OF01CX9MS.1.5.A05.1.454.CMB.1.raw
  modified_base (178)..(178): a, c, t, g, unknown or other
  misc_feature (178)..(178): n is a, c, g, or t

SEQ ID NO: 259925 - DNA, 179 bp, Homo sapiens; identical to SEQ ID NO: 259879
  misc_feature: GYAE6OF01BKL5X.1.5.A05.1.454.CMB.1.raw
  modified_base (178)..(179): a, c, t, g, unknown or other
  misc_feature (178)..(179): n is a, c, g, or t

SEQ ID NO: 259926 - DNA, 179 bp, Homo sapiens; identical to SEQ ID NO: 259844
  misc_feature: GYAE6OF01BBTV1.1.5.A05.1.454.CMB.1.raw
  modified_base (178)..(179): a, c, t, g, unknown or other
  misc_feature (178)..(179): n is a, c, g, or t

SEQ ID NO: 259927 - DNA, 179 bp, Homo sapiens; identical to SEQ ID NO: 259879
  misc_feature: GYAE6OF01D71QP.1.5.A05.1.454.CMB.1.raw
  modified_base (178)..(179): a, c, t, g, unknown or other
  misc_feature (178)..(179): n is a, c, g, or t

SEQ ID NO: 259928 - DNA, 175 bp, Homo sapiens
  misc_feature: GYAE6OF01E2TB2.1.5.A05.1.454.CMB.1.raw
  modified_base (174)..(175): a, c, t, g, unknown or other
  misc_feature (174)..(175): n is a, c, g, or t
tcagacgagtgcgtcacgaccggtgctcgatttagatagatagacagggcaccaaggcccatcggtcttcccctggcaccctcctccaagagcacctctgggcacagcggcctgggctgcctggtcaaggactacttccgagtgcgtcctgagcgggctggcaaggcgcatagnn

SEQ ID NO: 259929 - DNA, 180 bp, Homo sapiens
  misc_feature: GYAE6OF01BUOGW.1.5.A05.1.454.CMB.1.raw
  modified_base (178)..(180): a, c, t, g, unknown or other
  misc_feature (178)..(180): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctactgctagtctgagcgggctggcaaggcgcatagnnn

SEQ ID NO: 259930 - DNA, 252 bp, Homo sapiens
  misc_feature: GYAE6OF01B2DAA.1.5.A05.1.454.CMB.1.raw
  modified_base (251)..(252): a, c, t, g, unknown or other
  misc_feature (251)..(252): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatctgagagtgcgtctctgagcgggctggcaaggcgcatagnn

SEQ ID NO: 259931 - DNA, 250 bp, Homo sapiens
  misc_feature: GYAE6OF01CD1OV.1.5.A05.1.454.CMB.1.raw
  modified_base (249)..(250): a, c, t, g, unknown or other
  misc_feature (249)..(250): n is a, c, g, or t
tcagacgagtgcgtcacgaccggtgctcgatttagatagatagacagggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttccgccatctgaacgcactcgtctgagcgggctggcaaggcgcatagnn

SEQ ID NO: 259932 - DNA, 203 bp, Homo sapiens
  misc_feature: GYAE6OF01C9PNH.1.5.A05.1.454.CMB.1.raw
  modified_base (182)..(203): a, c, t, g, unknown or other
  misc_feature (182)..(203): n is a, c, g, or t
tcagacgagtgcgtcacgaccggtgctcgatttagatagatagacaggggtcgacctaagggcccagtcggtcttcccctggcaccctcctccaagagcacctctggggcacagcggccctgggctgcctggtcaaggctacttcctcgtactgcgctgagcgggctggcaaggcgcatagnnnnnnnnnnnnnnnnnnnnnn

SEQ ID NO: 259933 - DNA, 253 bp, Homo sapiens
  misc_feature: GYAE6OF01DC94S.1.5.A05.1.454.CMB.1.raw
  modified_base (250)..(253): a, c, t, g, unknown or other
  misc_feature (250)..(253): n is a, c, g, or t
tcagacgagtgcgtcacgaccggtgctcgatttagatagatagacagggcagttccagatttcaactgctcatcagcagcctgcagtctgaagattttgctagtttattactgtcagcagtataataactggcctccgacgttcggccaagggaccaaggtggaaatcaaacgaactgtggctgcaccatctgtcttcatcttcccgcatctgatcgtactgcgctgagcgggctggcaaggcgcatagnnnn

SEQ ID NO: 259934 - DNA, 252 bp, Homo sapiens
  misc_feature: GYAE6OF01CZPAL.1.5.A05.1.454.CMB.1.raw
  modified_base (248)..(252): a, c, t, g, unknown or other
  misc_feature (248)..(252): n is a, c, g, or t
tcagacgagtgcgtcacgaccggtgctcgatttagatagatagacaggggcagttccagatttcaactgctcatcagcagcctgcagtctgaagattttgcagttttattactgtcagcagtataataactggcctccgacgttcggccaagggaccaaggtgaaatcaaacgactgtggctgcaccatctgtcttcatcttccgcatctgatcgtactgcgctgagcgggctggcaaggcgcatagnnnnn

SEQ ID NO: 259935 - DNA, 178 bp, Homo sapiens; identical to SEQ ID NO: 259843
  misc_feature: GYAE6OF01CV9Q6.1.5.A05.1.454.CMB.1.raw
  modified_base (178)..(178): a, c, t, g, unknown or other
  misc_feature (178)..(178): n is a, c, g, or t

SEQ ID NO: 259936 - DNA, 179 bp, Homo sapiens; identical to SEQ ID NO: 259879
  misc_feature: GYAE6OF01BT6EA.1.5.A05.1.454.CMB.1.raw
  modified_base (178)..(179): a, c, t, g, unknown or other
  misc_feature (178)..(179): n is a, c, g, or t

SEQ ID NO: 259937 - DNA, 253 bp, Homo sapiens
  misc_feature: GYAE6OF01DTMZ0.1.5.A05.1.454.CMB.1.raw
  modified_base (251)..(253): a, c, t, g, unknown or other
  misc_feature (251)..(253): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatctgaacgcactcgtctgagcgggctggcaaggcgcatagnnn

SEQ ID NO: 259938 - DNA, 333 bp, Homo sapiens
  misc_feature: GYAE6OF01AEBCS.1.5.A05.1.454.CMB.1.raw
  modified_base (327)..(333): a, c, t, g, unknown or other
  misc_feature (327)..(333): n is a, c, g, or t
tcagacgagtgcgtcacgaccggtgctcgatttagatagatagacgagggcagttccagtatttcaactgctcatcagcagcctgctagtctagtaagtattttgactagttttattactgtcagataagttaataacgtacgtcggtcccgtaccggtacggttaccggaaccgaacgggaaccgtaaagggtagaaactacgaaacgtacgtggtcggctacgacctaacctcgttcttcttccttacgtcttcccgttacccgctagtcgtggtagtcggtcgtcgtcgttcggaggcgggtcggcgaggacgaacggcagagnnnnnnn

SEQ ID NO: 259939 - DNA, 179 bp, Homo sapiens; identical to SEQ ID NO: 259879
  misc_feature: GYAE6OF01AHDNU.1.5.A05.1.454.CMB.1.raw
  modified_base (178)..(179): a, c, t, g, unknown or other
  misc_feature (178)..(179): n is a, c, g, or t

SEQ ID NO: 259940 - DNA, 182 bp, Homo sapiens; identical to SEQ ID NO: 259863
  misc_feature: GYAE6OF01BF83B.1.5.A05.1.454.CMB.1.raw
  modified_base (178)..(182): a, c, t, g, unknown or other
  misc_feature (178)..(182): n is a, c, g, or t

SEQ ID NO: 259941 - DNA, 177 bp, Homo sapiens
  misc_feature: GYAE6OF01D22EP.1.5.A05.1.454.CMB.1.raw
  modified_base (177)..(177): a, c, t, g, unknown or other
  misc_feature (177)..(177): n is a, c, g, or t
tcagacgagtgcgtcacgaccggtgctcgatttagatagatagacagggcaccaagggcccatcggtcttcccctggcaccctcctccaagagcacctctggggcacagcggcctgggctgcctggtcaaggactacttccagtactctatctgagcgggctggcaaggcgcatagn

SEQ ID NO: 259942 - DNA, 251 bp, Homo sapiens
  misc_feature: GYAE6OF01BRKDU.1.5.A05.1.454.CMB.1.raw
  modified_base (251)..(251): a, c, t, g, unknown or other
  misc_feature (251)..(251): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatctgatcgtactgcgctgagcgggctggcaaggcgcatagn

SEQ ID NO: 259943 - DNA, 182 bp, Homo sapiens
  misc_feature: GYAE6OF01DAUV8.1.5.A05.1.454.CMB.1.raw
  modified_base (178)..(182): a, c, t, g, unknown or other
  misc_feature (178)..(182): n is a, c, g, or t
tcagacgagtgcgtcacgaccggtgctcgatttagatagatagacagggcaccaagggcccatcggtcttcccctggcgccctgctccaggagcacctctggggcacagcggccctgggctgcctggtcaaggactacttcctatgtatactctgagcgggctggcaaggcgcatagnnnnn

SEQ ID NO: 259944 - DNA, 251 bp, Homo sapiens
  misc_feature: GYAE6OF01E4NKO.1.5.A05.1.454.CMB.1.raw
  modified_base (250)..(251): a, c, t, g, unknown or other
  misc_feature (250)..(251): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgcatctgatcgtactgcgctgagcgggctggcaaggcgcatagnn

SEQ ID NO: 259945 - DNA, 250 bp, Homo sapiens
  misc_feature: GYAE6OF01BK3UO.1.5.A05.1.454.CMB.1.raw
  modified_base (185)..(191): a, c, t, g, unknown or other
  misc_feature (185)..(191): n is a, c, g, or t
  modified_base (193)..(250): a, c, t, g, unknown or other
  misc_feature (193)..(250): n is a, c, g, or t
tcagacgagtgcgtcacgaccggtgctcgatttagatagatagacaggggtcgaccaagggcccatcggtcttcccctggcaccctcctccaagagccacctctggggcacagcggccctgggctgcctggtcaaggactacttccagtactctatactgagcgggctgggcaaggcgcatagcnnnnnnngnnnnnnnnnnnnnnnnnnnnnnnnnnnnnnnnnnnnnnnnnnnnnnnnnnnnnnnnnn

SEQ ID NO: 259946 - DNA, 179 bp, Homo sapiens; identical to SEQ ID NO: 259841
  misc_feature: GYAE6OF01D1PKD.1.5.A05.1.454.CMB.1.raw
  modified_base (178)..(179): a, c, t, g, unknown or other
  misc_feature (178)..(179): n is a, c, g, or t

SEQ ID NO: 259947 - DNA, 181 bp, Homo sapiens
  misc_feature: GYAE6OF01DYROE.1.5.A05.1.454.CMB.1.raw
  modified_base (178)..(181): a, c, t, g, unknown or other
  misc_feature (178)..(181): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttccgagtgcgtctctgagcgggctggcaaggcgcatagnnnn

SEQ ID NO: 259948 - DNA, 251 bp, Homo sapiens
  misc_feature: GYAE6OF01DBJUW.1.5.A05.1.454.CMB.1.raw
  modified_base (250)..(251): a, c, t, g, unknown or other
  misc_feature (250)..(251): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgactgtggctgcaccatctgtcttcatcttcccgcatctgatcgtactgcgctggagcgggctggcaaggcgcatagnn

SEQ ID NO: 259949 - DNA, 179 bp, Homo sapiens; identical to SEQ ID NO: 259841
  misc_feature: GYAE6OF01ATT1S.1.5.A05.1.454.CMB.1.raw
  modified_base (178)..(179): a, c, t, g, unknown or other
  misc_feature (178)..(179): n is a, c, g, or t

SEQ ID NO: 259950 - DNA, 182 bp, Homo sapiens
  misc_feature: GYAE6OF01B2ELI.1.5.A05.1.454.CMB.1.raw
  modified_base (178)..(182): a, c, t, g, unknown or other
  misc_feature (178)..(182): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctactgctagtctgagcgggctggcaaggcgcatagnnnnn

SEQ ID NO: 259951 - DNA, 255 bp, Homo sapiens
  misc_feature: GYAE6OF01DNHU2.1.5.A05.1.454.CMB.1.raw
  modified_base (250)..(255): a, c, t, g, unknown or other
  misc_feature (250)..(255): n is a, c, g, or t
tcagacgagtgcgtcacgaccggtgctcgatttagatagatagacaggggcagttccagatttcaactgctcatcagcagcctgcagtctgaagattttgcagttttattactgtcagcagtataatactggcctccgacgttcggccaagggaccaaggtggaaatcaaacgaactgtggctgcaccatctgtcttcatcttcccgcatctgatcgtactgcgctgagcggctcggcaaggcgcatagnnnnnn

SEQ ID NO: 259952 - DNA, 191 bp, Homo sapiens
  misc_feature: GYAE6OF01A77WO.1.5.A05.1.454.CMB.1.raw
  modified_base (179)..(191): a, c, t, g, unknown or other
  misc_feature (179)..(191): n is a, c, g, or t
tcagacgagtgcgtcacgaccggtgctcgatttagatagatagacagggcaccaagggcccatcggtcttccccctggcaccctcctccaagagcacctctggggcacagcggccctgggctgcctggtcaaggactacttcctcgtactgcgctgagcgggctggcaaggcgcatagnnnnnnnnnnnnn

SEQ ID NO: 259953 - DNA, 177 bp, Homo sapiens
  misc_feature: GYAE6OF01DCX9S.1.5.A05.1.454.CMB.1.raw
tcagacgagtgcgtcacgaccggtgctcgatttagatagatagacagggcaccaaggccatcggtcttcccctcggcaccctcctccaagagcacctctggggcgacagcggccctgggctgcctggtcaaggactacttccagtactctatctgagcgggctggcaaggcgcatag

SEQ ID NO: 259954 - DNA, 192 bp, Homo sapiens
  misc_feature: GYAE6OF01BBSDR.1.5.A05.1.454.CMB.1.raw
  modified_base (179)..(192): a, c, t, g, unknown or other
  misc_feature (179)..(192): n is a, c, g, or t
tcagacgagtgcgtcacgaccggtgctcgatttagatagatagacagggcaccaagggcccatcggtcttccccctggcaccctcctccaagagcacctctggggcacagcggccctgggctgcctggtcaaggactacttcctctctcgactctgagcgggctggcaaggcgcatagnnnnnnnnnnnnnn

SEQ ID NO: 259955 - DNA, 255 bp, Homo sapiens
  misc_feature: GYAE6OF01CIPUT.1.5.A05.1.454.CMB.1.raw
  modified_base (253)..(255): a, c, t, g, unknown or other
  misc_feature (253)..(255): n is a, c, g, or t
tcagacgagtgcgtcacgaccggtgctcgatttagatagatagacaggggcagttccagatttcaactgctcatcagcagcctgcagtctgaagatttttgctagttttattactgtcagcagtataataactggcctccgacgttcggccaagggaccaaggtggaaatcaaacgaactgtggctgcaccatctgtcttcatcttcccgcatctgatcgtactgcgctgagcgggctggcaaggcgcatagnnn

SEQ ID NO: 259956 - DNA, 255 bp, Homo sapiens
  misc_feature: GYAE6OF01AXR7J.1.5.A05.1.454.CMB.1.raw
  modified_base (250)..(255): a, c, t, g, unknown or other
  misc_feature (250)..(255): n is a, c, g, or t
tcagacgagtgcgtcacgaccggtgctcgatttagatagatagacagggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatctgatcgtactgcgctgagcgggctggcaaggcgcatagnnnnnn

SEQ ID NO: 259957 - DNA, 179 bp, Homo sapiens; identical to SEQ ID NO: 259879
  misc_feature: GYAE6OF01EZUV6.1.5.A05.1.454.CMB.1.raw
  modified_base (178)..(179): a, c, t, g, unknown or other
  misc_feature (178)..(179): n is a, c, g, or t

SEQ ID NO: 259958 - DNA, 250 bp, Homo sapiens
  misc_feature: GYAE6OF01BWK22.1.5.A05.1.454.CMB.1.raw
  modified_base (248)..(250): a, c, t, g, unknown or other
  misc_feature (248)..(250): n is a, c, g, or t
tcagacgagtgcgtcacgaccggtgctcgatttagatagatagacagggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtctcatcttccggcatctgatcgtactgcgctgagcgggctggcaaggcgcatagnnn

SEQ ID NO: 259959 - DNA, 253 bp, Homo sapiens; identical to SEQ ID NO: 259889
  misc_feature: GYAE6OF01ARHHQ.1.5.A05.1.454.CMB.1.raw
  modified_base (251)..(253): a, c, t, g, unknown or other
  misc_feature (251)..(253): n is a, c, g, or t

SEQ ID NO: 259960 - DNA, 137 bp, Homo sapiens
  misc_feature: GYAE6OF01CFYRS.1.5.A05.1.454.CMB.1.raw
  modified_base (124)..(137): a, c, t, g, unknown or other
  misc_feature (124)..(137): n is a, c, g, or t
tcagacgagtgcgtcacgaccggtgctcgatttagatagatagacagggcaccaagggcccatcggtcttccccctggcaccctcctcacgtagcgtgctgagcgggctggcaaggcgcatagnnnnnnnnnnnnnn

SEQ ID NO: 259961 - DNA, 252 bp, Homo sapiens
  misc_feature: GYAE6OF01DS96C.1.5.A05.1.454.CMB.1.raw
  modified_base (251)..(252): a, c, t, g, unknown or other
  misc_feature (251)..(252): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatctgatcgtactgcgctgagcgggctggcaaggcgcatagnn

SEQ ID NO: 259962 - DNA, 263 bp, Homo sapiens
  misc_feature: GYAE6OF01CVIGE.1.5.A05.1.454.CMB.1.raw
  modified_base (258)..(263): a, c, t, g, unknown or other
  misc_feature (258)..(263): n is a, c, g, or t
tcagacgagtgcgtcacgaccggtgctcgatttagatagatagactcgcgggaagatgaagacagacttcactctcaccatcagcagcctagaacctgaagattttgcagtttattactgtcagcagcgtagcaactggccattcactttcggccctgggaccaaagtggatatcaaacgaactgtggctgcaccatctgtcttcatcttcccgccatctgaacgcactcgtctgagcgggctggcaaggcgcatagnnnnnn

SEQ ID NO: 259963 - DNA, 189 bp, Homo sapiens
  misc_feature: GYAE6OF01CAN6K.1.5.A05.1.454.CMB.1.raw
  modified_base (179)..(189): a, c, t, g, unknown or other
  misc_feature (179)..(189): n is a, c, g, or t
tcagacgagtgcgtcacgaccggtgctcgatttagatagatagacagggcaccgaagggacccatccggtcttcccctggcaccctcctccaagagcacctctgggcacagcggcctgggctgcctggtcaaggactacttcctatgtataatctgagcgggctggcaaggcgcatagnnnnnnnnnnn

SEQ ID NO: 259964 - DNA, 191 bp, Homo sapiens
  misc_feature: GYAE6OF01EDUJU.1.5.A05.1.454.CMB.1.raw
  modified_base (180)..(191): a, c, t, g, unknown or other
  misc_feature (180)..(191): n is a, c, g, or t
tcagacgagtgcgtcacgaccggtgctcgatttagatagatagacagggcgaccaagggcccatcggtcttcccctggcaccctcctccaagagccacctctggggcacagcggccctgggctgcctggtcaaggactacttcctcgtactgcgctgagcgggctggcaaggcgcatagnnnnnnnnnnnn

SEQ ID NO: 259965 - DNA, 528 bp, Homo sapiens
  misc_feature: GYAE6OF01CZBM4.1.5.A05.1.454.CMB.1.raw
  modified_base (221)..(221): a, c, t, g, unknown or other
  misc_feature (221)..(221): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttccngcaaggcttcaggatacaccttcactaggtatgctatacattgggtgcgccaggccccggacaaaggcttgagtggatgggatggatcaacgctggcaatggtaacacaaaaaattcacagaagttccagggcagagtcacctttaccagggacacatcgcgaggattacttatatggagctgagcagcctgagatccgaagacacggctgtatattttgtgtcgtacctctagtggaggtcatttatacgtctctaatttgacttcctggggccagggtaaccctggtaccaccgtctccgtaccg

SEQ ID NO: 259966 - DNA, 184 bp, Homo sapiens
  misc_feature: GYAE6OF01D6187.1.5.A05.1.454.CMB.1.raw
  modified_base (178)..(184): a, c, t, g, unknown or other
  misc_feature (178)..(184): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttccagtactctatctgagcgggctggcaaggcgcatagnnnnnnn

SEQ ID NO: 259967 - DNA, 181 bp, Homo sapiens; identical to SEQ ID NO: 259882
  misc_feature: GYAE6OF01DTP2G.1.5.A05.1.454.CMB.1.raw
  modified_base (178)..(181): a, c, t, g, unknown or other
  misc_feature (178)..(181): n is a, c, g, or t

SEQ ID NO: 259968 - DNA, 250 bp, Homo sapiens
  misc_feature: GYAE6OF01CQVQ8.1.5.A05.1.454.CMB.1.raw
  modified_base (246)..(250): a, c, t, g, unknown or other
  misc_feature (246)..(250): n is a, c, g, or t
tcagacgagtgcgtcacgaccggtgctcgatttagatagatagacaggggcagttccagatttcaactgctcatcagcagcctgcagtctgaagatttttgcagttttattactgtcagcagtataataactggcctccgacgttcggccaagggaccaaggtgaaatcaaacgactgtggctgcacatctgtctcatcttccgcatctgatcgtactgcgctgagcggctggcaaggcgcatagnnnnn

SEQ ID NO: 259969 - DNA, 534 bp, Homo sapiens
  misc_feature: GYAE6OF01B0OPN.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatgggatggatcaacgctggcaatggtaacacaaaaattcacagaagttccagggcagagtcacctttaccagggacacatccgcgaggattacttatatggagctgagcagcctgagatccgaagacacggctgtatatttttgtgtcgtacctcttagtggaggtctattagttacgcttctaactttgacttccgtgggtccacgggtaaccctggtccaccgtctcccgtccg

SEQ ID NO: 259970 - DNA, 180 bp, Homo sapiens
  misc_feature: GYAE6OF01CNK4T.1.5.A05.1.454.CMB.1.raw
  modified_base (178)..(180): a, c, t, g, unknown or other
  misc_feature (178)..(180): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttccagtactctatctgagcgggctggcaaggcgcatagnnn

SEQ ID NO: 259971 - DNA, 281 bp, Homo sapiens
  misc_feature: GYAE6OF01DEL3L.1.5.A05.1.454.CMB.1.raw
  modified_base (96)..(96): a, c, t, g, unknown or other
  misc_feature (96)..(96): n is a, c, g, or t
  modified_base (258)..(281): a, c, t, g, unknown or other
  misc_feature (258)..(281): n is a, c, g, or t
tcagacgagtgcgtcacgaccggtgctcgatttagatagatagacaggggcagttccaggatttcaactgctcatcagcagcctgcagtctgaagnttttgcagtttattactgtcagcagtataataactggcctccgacgttcggccaagggaccaaggtggaaatcaaaacgactgtggctgcaccatctgtcttcatcttcccgcatctgactcgtactgcgctaggagcgggctggacaaaggcgactatagnnnnnnnnnnnnnnnnnnnnnnnn

SEQ ID NO: 259972 - DNA, 192 bp, Homo sapiens
  misc_feature: GYAE6OF01AY0KM.1.5.A05.1.454.CMB.1.raw
  modified_base (178)..(192): a, c, t, g, unknown or other
  misc_feature (178)..(192): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttccgagtgcgtctctgagcgggctggcaaggcgcatagnnnnnnnnnnnnnnn

SEQ ID NO: 259973 - DNA, 254 bp, Homo sapiens
  misc_feature: GYAE6OF01A9WII.1.5.A05.1.454.CMB.1.raw
  modified_base (251)..(254): a, c, t, g, unknown or other
  misc_feature (251)..(254): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatctgatcgtactgcgctgagcgggctggcaaggcgcatagnnnn

SEQ ID NO: 259974 - DNA, 179 bp, Homo sapiens
  misc_feature: GYAE6OF01B2O4Y.1.5.A05.1.454.CMB.1.raw
  modified_base (178)..(179): a, c, t, g, unknown or other
  misc_feature (178)..(179): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctcgatcgcgtctgagcgggctggcaaggcgcatagnn

SEQ ID NO: 259975 - DNA, 178 bp, Homo sapiens; identical to SEQ ID NO: 259858
  misc_feature: GYAE6OF01ERVZO.1.5.A05.1.454.CMB.1.raw
  modified_base (178)..(178): a, c, t, g, unknown or other
  misc_feature (178)..(178): n is a, c, g, or t

SEQ ID NO: 259976 - DNA, 182 bp, Homo sapiens; identical to SEQ ID NO: 259863
  misc_feature: GYAE6OF01CUZML.1.5.A05.1.454.CMB.1.raw
  modified_base (178)..(182): a, c, t, g, unknown or other
  misc_feature (178)..(182): n is a, c, g, or t

SEQ ID NO: 259977 - DNA, 179 bp, Homo sapiens; identical to SEQ ID NO: 259844
  misc_feature: GYAE6OF01DCVCU.1.5.A05.1.454.CMB.1.raw
  modified_base (178)..(179): a, c, t, g, unknown or other
  misc_feature (178)..(179): n is a, c, g, or t

SEQ ID NO: 259978 - DNA, 178 bp, Homo sapiens; identical to SEQ ID NO: 259891
  misc_feature: GYAE6OF01C57OO.1.5.A05.1.454.CMB.1.raw
  modified_base (178)..(178): a, c, t, g, unknown or other
  misc_feature (178)..(178): n is a, c, g, or t

SEQ ID NO: 259979 - DNA, 271 bp, Homo sapiens
  misc_feature: GYAE6OF01E4IMC.1.5.A05.1.454.CMB.1.raw
  modified_base (186)..(186): a, c, t, g, unknown or other
  misc_feature (186)..(186): n is a, c, g, or t
  modified_base (193)..(197): a, c, t, g, unknown or other
  misc_feature (193)..(197): n is a, c, g, or t
  modified_base (199)..(201): a, c, t, g, unknown or other
  misc_feature (199)..(201): n is a, c, g, or t
  modified_base (203)..(271): a, c, t, g, unknown or other
  misc_feature (203)..(271): n is a, c, g, or t
tcagacgagtgcgtcacgaccggtgctcgatttagatagatagacgagggcaccaagggcccatcggtccttccccctggcaccctcctccaacgagcacctctggggcacacgccggccctgggcctcgccctggtccaaggactaccttcctcgatcgcgtctgagcgggctggccaagggccnccatagnnnnngnnncnnnnnnnnnnnnnnnnnnnnnnnnnnnnnnnnnnnnnnnnnnnnnnnnnnnnnnnnnnnnnnnnnnnnn

SEQ ID NO: 259980 - DNA, 268 bp, Homo sapiens
  misc_feature: GYAE6OF01ESEIG.1.5.A05.1.454.CMB.1.raw
  modified_base (250)..(268): a, c, t, g, unknown or other
  misc_feature (250)..(268): n is a, c, g, or t
tcagacgagtgcgtcacgaccggtgctcgatttagatagatagacaggggcagttccagatttcaactgctcatcagcagcctgcagtctgaagattttgctagtttattactgtcagcagtataataactggcctccgacgttcggccaagggaccaaggtggaaatcaaacgaactgtggctgcaccatctgtcttcatcttcccgcatctgatcgtactgcgctgagcggctggcaaggcgcatagnnnnnnnnnnnnnnnnnnn

SEQ ID NO: 259981 - DNA, 178 bp, Homo sapiens; identical to SEQ ID NO: 259858
  misc_feature: GYAE6OF01CUA3N.1.5.A05.1.454.CMB.1.raw
  modified_base (178)..(178): a, c, t, g, unknown or other
  misc_feature (178)..(178): n is a, c, g, or t

SEQ ID NO: 259982 - DNA, 520 bp, Homo sapiens
  misc_feature: GYAE6OF01BJ2NH.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatggggatggatcgaacgctggcaatggtaacacaaaaattcaacagaagtcagggcagagtcacttacagggacacatcgcgaggattacttatatggagctgagcagcctgagatccgaagacacggctgtattattttgtgtcgtacctgttagtggagtctattacttacgctctaatttgactcgtgggccagggtaccctggtcaccgtctcctcg

SEQ ID NO: 259983 - DNA, 191 bp, Homo sapiens
  misc_feature: GYAE6OF01CAC3Y.1.5.A05.1.454.CMB.1.raw
  modified_base (180)..(191): a, c, t, g, unknown or other
  misc_feature (180)..(191): n is a, c, g, or t
tcagacgagtgcgtcacgaccggtgctcgatttagatagatagacgagggcaccaagggccatcggtcttcccctggcaccctcctccaagagcacctctggggcacagcggccctgggctgcctggtcaaggactacttcctcgtactggcgctgagcgggctgggcaaggcgcatagnnnnnnnnnnnn

SEQ ID NO: 259984 - DNA, 236 bp, Homo sapiens
  misc_feature: GYAE6OF01AIN41.1.5.A05.1.454.CMB.1.raw
  modified_base (187)..(236): a, c, t, g, unknown or other
  misc_feature (187)..(236): n is a, c, g, or t
tcagacgagtgcgtcacgaccggtgctcgatttagatagatagacagggcaccaagggaccccatcggtcttcccctggtcaccctcctccaagagtcacctctggggccacagcggccctgggacttgcctggtcaaggactacttcctcggtactgcgcttgagcgggctggcaaggcgcatagnnnnnnnnnnnnnnnnnnnnnnnnnnnnnnnnnnnnnnnnnnnnnnnnnn

SEQ ID NO: 259985 - DNA, 179 bp, Homo sapiens; identical to SEQ ID NO: 259879
  misc_feature: GYAE6OF01CCIT7.1.5.A05.1.454.CMB.1.raw
  modified_base (178)..(179): a, c, t, g, unknown or other
  misc_feature (178)..(179): n is a, c, g, or t

SEQ ID NO: 259986 - DNA, 178 bp, Homo sapiens; identical to SEQ ID NO: 259866
  misc_feature: GYAE6OF01A2VQN.1.5.A05.1.454.CMB.1.raw
  modified_base (178)..(178): a, c, t, g, unknown or other
  misc_feature (178)..(178): n is a, c, g, or t

SEQ ID NO: 259987 - DNA, 179 bp, Homo sapiens
  misc_feature: GYAE6OF01BGVX9.1.5.A05.1.454.CMB.1.raw
  modified_base (178)..(179): a, c, t, g, unknown or other
  misc_feature (178)..(179): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctatgtatactctgagcgggctggcaaggcgcatagnn

SEQ ID NO: 259988 - DNA, 179 bp, Homo sapiens; identical to SEQ ID NO: 259841
  misc_feature: GYAE6OF01EFU31.1.5.A05.1.454.CMB.1.raw
  modified_base (178)..(179): a, c, t, g, unknown or other
  misc_feature (178)..(179): n is a, c, g, or t

SEQ ID NO: 259989 - DNA, 178 bp, Homo sapiens; identical to SEQ ID NO: 259858
  misc_feature: GYAE6OF01ANKNV.1.5.A05.1.454.CMB.1.raw
  modified_base (178)..(178): a, c, t, g, unknown or other
  misc_feature (178)..(178): n is a, c, g, or t

SEQ ID NO: 259990 - DNA, 253 bp, Homo sapiens
  misc_feature: GYAE6OF01BT0LE.1.5.A05.1.454.CMB.1.raw
  modified_base (250)..(253): a, c, t, g, unknown or other
  misc_feature (250)..(253): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgcatctgatcgtactgcgctgagcgggctggcaaggcgcatagnnnn

SEQ ID NO: 259991 - DNA, 178 bp, Homo sapiens; identical to SEQ ID NO: 259891
  misc_feature: GYAE6OF01D4EML.1.5.A05.1.454.CMB.1.raw
  modified_base (178)..(178): a, c, t, g, unknown or other
  misc_feature (178)..(178): n is a, c, g, or t

SEQ ID NO: 259992 - DNA, 180 bp, Homo sapiens; identical to SEQ ID NO: 259970
  misc_feature: GYAE6OF01BB5LK.1.5.A05.1.454.CMB.1.raw
  modified_base (178)..(180): a, c, t, g, unknown or other
  misc_feature (178)..(180): n is a, c, g, or t

SEQ ID NO: 259993 - DNA, 526 bp, Homo sapiens
  misc_feature: GYAE6OF01BQ8JB.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatgggatggatcaacgctggcaatggtaaacacaaaaaattcaacagaagttccagggcagagtcacctttacagggacacatccgcgaggattactatatggagctgagcagcctgagatccgaagacacggctagtatattttgtgcgtacctctagtggaggtcagttattacgtctcgaatttgactccgtgggcccagggtaccctggtcaccgtcgtcctacg

SEQ ID NO: 259994 - DNA, 294 bp, Homo sapiens
  misc_feature: GYAE6OF01EBML9.1.5.A05.1.454.CMB.1.raw
  modified_base (260)..(263): a, c, t, g, unknown or other
  misc_feature (260)..(263): n is a, c, g, or t
  modified_base (265)..(294): a, c, t, g, unknown or other
  misc_feature (265)..(294): n is a, c, g, or t
tcagacgagtgcgtcacgaccggtgctcgatttagatagatagacgagggcagttccacgatttcaactgctctatcagcagcctgcagtctgaagacttttgctagttttattacctgtcagtcagtataataactggcctcgacgttcggccaaagggaccaaggtgaaactcaaacgactgttgctgcaccatctgtctcatcttcccgcatctgacgtgtctgatctgacgcgggctcgggcaaagggcgcatagnnnntnnnnnnnnnnnnnnnnnnnnnnnnnnnnnn

SEQ ID NO: 259995 - DNA, 180 bp, Homo sapiens; identical to SEQ ID NO: 259868
  misc_feature: GYAE6OF01AZ0WE.1.5.A05.1.454.CMB.1.raw
  modified_base (178)..(180): a, c, t, g, unknown or other
  misc_feature (178)..(180): n is a, c, g, or t

SEQ ID NO: 259996 - DNA, 178 bp, Homo sapiens; identical to SEQ ID NO: 259891
  misc_feature: GYAE6OF01CJFKX.1.5.A05.1.454.CMB.1.raw
  modified_base (178)..(178): a, c, t, g, unknown or other
  misc_feature (178)..(178): n is a, c, g, or t

SEQ ID NO: 259997 - DNA, 178 bp, Homo sapiens; identical to SEQ ID NO: 259891
  misc_feature: GYAE6OF01BE5VP.1.5.A05.1.454.CMB.1.raw
  modified_base (178)..(178): a, c, t, g, unknown or other
  misc_feature (178)..(178): n is a, c, g, or t

SEQ ID NO: 259998 - DNA, 254 bp, Homo sapiens
  misc_feature: GYAE6OF01EQKA5.1.5.A05.1.454.CMB.1.raw
  modified_base (250)..(254): a, c, t, g, unknown or other
  misc_feature (250)..(254): n is a, c, g, or t
tcagacgagtgcgtcacgaccggtgctcgatttagatagatagacagggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatctgatcgtactgcgctgagcgggctggcaaggcgcatagnnnnn

SEQ ID NO: 259999 - DNA, 179 bp, Homo sapiens
  misc_feature: GYAE6OF01EGC0I.1.5.A05.1.454.CMB.1.raw
  modified_base (178)..(179): a, c, t, g, unknown or other
  misc_feature (178)..(179): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttccgagtgcgtctctgagcgggctggcaaggcgcatagnn

SEQ ID NO: 260000 - DNA, 180 bp, Homo sapiens; identical to SEQ ID NO: 259970
  misc_feature: GYAE6OF01CU80E.1.5.A05.1.454.CMB.1.raw
  modified_base (178)..(180): a, c, t, g, unknown or other
  misc_feature (178)..(180): n is a, c, g, or t

SEQ ID NO: 260001 - DNA, 521 bp, Homo sapiens
  misc_feature: GYAE6OF01CS670.1.5.A05.1.454.CMB.1.raw
  modified_base (422)..(422): a, c, t, g, unknown or other
  misc_feature (422)..(422): n is a, c, g, or t
  modified_base (442)..(442): a, c, t, g, unknown or other
  misc_feature (442)..(442): n is a, c, g, or t
  modified_base (451)..(451): a, c, t, g, unknown or other
  misc_feature (451)..(451): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatgggatggatcaacgctggcaatggtaacacaaaaattcacagaagttccaggcagagtcacttaccagggacacatccgacgaggattacttatatggagctgagcaagcctgagatccgaanacacggctgtattattttgngtcgtactntagtggtgtcagttatacgtctactaattgactccgtggggccagggtaccctggtcaccgtctccgtcg

SEQ ID NO: 260002 - DNA, 191 bp, Homo sapiens
  misc_feature: GYAE6OF01AK5NP.1.5.A05.1.454.CMB.1.raw
  modified_base (178)..(191): a, c, t, g, unknown or other
  misc_feature (178)..(191): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttccagtactctatctgagcgggctggcaaggcgcatagnnnnnnnnnnnnnn

SEQ ID NO: 260003 - DNA, 180 bp, Homo sapiens
  misc_feature: GYAE6OF01CMKN4.1.5.A05.1.454.CMB.1.raw
  modified_base (177)..(180): a, c, t, g, unknown or other
  misc_feature (177)..(180): n is a, c, g, or t
tcagacgagtgcgtcacgaccggtgctcgatttagatagatagacagggcaccaagggcccatcggtcttcccctggcaccctcctccaagagcacctctggggcacagcggcctgggctgcctggtcaaggactacttccgagtgcgtctctgagcgggctggcaaggcgcatagnnnn

SEQ ID NO: 260004 - DNA, 254 bp, Homo sapiens
  misc_feature: GYAE6OF01ELKK9.1.5.A05.1.454.CMB.1.raw
  modified_base (251)..(254): a, c, t, g, unknown or other
  misc_feature (251)..(254): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgttgctgcaccatctgtcttcatcttcccgccatctgacgtgtctgatctgagcgggctggcaaggcgcatagnnnn

SEQ ID NO: 260005 - DNA, 178 bp, Homo sapiens
  misc_feature: GYAE6OF01DDZLJ.1.5.A05.1.454.CMB.1.raw
  modified_base (177)..(178): a, c, t, g, unknown or other
  misc_feature (177)..(178): n is a, c, g, or t
tcagacgagtgcgtcacgaccggtgctcgatttagatagatagacagggcaccaagggcccatcggtcttcccctggcaccctcctccaagagcacctctggggcacagcggccctggctgcctggtcaaggactacttccgagtgcgtctctgagcgggctggcaaggcgcatagnn

SEQ ID NO: 260006 - DNA, 252 bp, Homo sapiens; identical to SEQ ID NO: 259961
  misc_feature: GYAE6OF01D54G3.1.5.A05.1.454.CMB.1.raw
  modified_base (251)..(252): a, c, t, g, unknown or other
  misc_feature (251)..(252): n is a, c, g, or t

SEQ ID NO: 260007 - DNA, 252 bp, Homo sapiens
  misc_feature: GYAE6OF01EO2PS.1.5.A05.1.454.CMB.1.raw
  modified_base (250)..(252): a, c, t, g, unknown or other
  misc_feature (250)..(252): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttccgccatctgatcgtactgcgctgagcgggctggcaaggcgcatagnnn

SEQ ID NO: 260008 - DNA, 189 bp, Homo sapiens
  misc_feature: GYAE6OF01DS0HQ.1.5.A05.1.454.CMB.1.raw
  modified_base (179)..(189): a, c, t, g, unknown or other
  misc_feature (179)..(189): n is a, c, g, or t
tcagacgagtgcgtcacgaccggtgctcgatttagatagatagacgagggcaccaagggcccatcggtcttcccctggcaccctcctccaagagcacctctggggcacagcggccctgggctgcctggtcaaggactacttcctcgtactgcgctgagcgggctggcaaggcgcatagnnnnnnnnnnn

SEQ ID NO: 260009 - DNA, 252 bp, Homo sapiens
  misc_feature: GYAE6OF01CHAGS.1.5.A05.1.454.CMB.1.raw
  modified_base (250)..(252): a, c, t, g, unknown or other
  misc_feature (250)..(252): n is a, c, g, or t
tcagacgagtgcgtcacgaccggtgctcgatttagatagatagacaggggcagttccagatttcaactgctcatcagcagcctgcagtctgaagtattttgcagtttattactgtcagcagtataataactggcctccgacgttcggccaagggaccaaggtgaaatcaaacgactgtggctgcaccatctgtcttcatccttcccgcatctgatcgtactgcgctgagcgggctggcaaggcgcatagnnn

SEQ ID NO: 260010 - DNA, 254 bp, Homo sapiens; identical to SEQ ID NO: 259973
  misc_feature: GYAE6OF01CJWET.1.5.A05.1.454.CMB.1.raw
  modified_base (251)..(254): a, c, t, g, unknown or other
  misc_feature (251)..(254): n is a, c, g, or t

SEQ ID NO: 260011 - DNA, 545 bp, Homo sapiens
  misc_feature: GYAE6OF01AJJCA.1.5.A05.1.454.CMB.1.raw
  modified_base (420)..(420): a, c, t, g, unknown or other
  misc_feature (420)..(420): n is a, c, g, or t
  modified_base (446)..(446): a, c, t, g, unknown or other
  misc_feature (446)..(446): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggccccggacaaaggcttgagtggatgggatggatcaacgctggcaagtggtaacacaaaaattcaacagaagttccagggcagagtcacctttaccagggacacgatccgacgaggattacttatatggagctgagcagcctgaganccgaagacacggctagtatattttgngtcgtacctgtagtggagtcattagttacgacttacgtatttcgacttccgtcgggcctacggggtaaccccttggtacctacccgttctcccgtaccg

SEQ ID NO: 260012 - DNA, 252 bp, Homo sapiens
  misc_feature: GYAE6OF01A9LT7.1.5.A05.1.454.CMB.1.raw
  modified_base (250)..(252): a, c, t, g, unknown or other
  misc_feature (250)..(252): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgcatctgatcgtactgcgctgagcgggctggcaaggcgcatagnnn

SEQ ID NO: 260013 - DNA, 255 bp, Homo sapiens
  misc_feature: GYAE6OF01BU773.1.5.A05.1.454.CMB.1.raw
  modified_base (251)..(255): a, c, t, g, unknown or other
  misc_feature (251)..(255): n is a, c, g, or t
tcagacgagtgcgtcacgaccggtgctcgatttagatagatagacaggggcagttccagatttcaactgctcatcagcagcctgcagtctgaagattttgcagttttattactgtcagcagtataataactggcctccgacgttcggccaagggaccaaggtggaaatcaaacgaactgtggctgcaccatctgtcttcatcttcccgcatctgagagtgcgtctctgagcgggctggcaaggcgcatagnnnnn

SEQ ID NO: 260014 - DNA, 262 bp, Homo sapiens
  misc_feature: GYAE6OF01D34I2.1.5.A05.1.454.CMB.1.raw
  modified_base (257)..(262): a, c, t, g, unknown or other
  misc_feature (257)..(262): n is a, c, g, or t
tcagacgagtgcgtcacgaccggtgctcgatttagatagatagacaggggcagttccagatttcaactgctcatcagcagcctgcagtctgaagattttgctagttttattactgtcagcagtataataactggcctccgacgttcggccaagggaccaaggtgaaatcaaacgactgtggctgcaccatctgtcttcatccttcccgcatctgattccgtactgcgctgacggcgggctggaccaaggcgcatagnnnnnn

SEQ ID NO: 260015 - DNA, 299 bp, Homo sapiens
  misc_feature: GYAE6OF01A39G8.1.5.A05.1.454.CMB.1.raw
  modified_base (256)..(257): a, c, t, g, unknown or other
  misc_feature (256)..(257): n is a, c, g, or t
  modified_base (259)..(299): a, c, t, g, unknown or other
  misc_feature (259)..(299): n is a, c, g, or t
tcagacgagtgcgtcacgaccggtgctcgatttagatagatagacagggggcgagttccagatttcaactgctcatcagcagcctgcagtctgaagacttttgcagtttattactgtcagcagtataataactggcctccgacgttcggccaagggaccaaggtggaaatcaaacgactgtgctgcaccatctgtcttcatcttcccgctatctgatcgtactgcgctgagcgggctgggcaaggccgacagtagnnannnnnnnnnnnnnnnnnnnnnnnnnnnnnnnnnnnnnnnnn

SEQ ID NO: 260016 - DNA, 206 bp, Homo sapiens
  misc_feature: GYAE6OF01CE9HK.1.5.A05.1.454.CMB.1.raw
  modified_base (178)..(206): a, c, t, g, unknown or other
  misc_feature (178)..(206): n is a, c, g, or t
tcagacgagtgcgtcacgaccggtgctcgatttagatagatagacagggcaccaagggcccatcggtcttccccctggcaccctcctccaagagcacctctggggcacagcggccctgggctgcctggtcaaggctacttcctcgtactgcgctgagcgggctggcaaggcgcatagnnnnnnnnnnnnnnnnnnnnnnnnnnnnn

SEQ ID NO: 260017 - DNA, 181 bp, Homo sapiens
  misc_feature: GYAE6OF01B5S3P.1.5.A05.1.454.CMB.1.raw
  modified_base (178)..(181): a, c, t, g, unknown or other
  misc_feature (178)..(181): n is a, c, g, or t
tcagacgagtgcgtcacgaccggtgctcgatttagatagatagacagggcaccaagggcccatcgatcttcccctggcaccctcctccaagagcacctctggggcacagcggccctgggctgcctggtcaaggactacttcctgtcgagcgtctgagcgggctggcaaggcgcatagnnnn

SEQ ID NO: 260018 - DNA, 253 bp, Homo sapiens
  misc_feature: GYAE6OF01AGUT9.1.5.A05.1.454.CMB.1.raw
  modified_base (252)..(253): a, c, t, g, unknown or other
  misc_feature (252)..(253): n is a, c, g, or t
tcagacgagtgcgtcacgaccggtgctcgatttagatagatagacaggggcagttccagatttcaactgctcatcagcagcctgcagtctgaagattttgcagttttattactgtcagcagtataataactggcctccgacgttcggccaagggaccaaggtggaaatcaaacgaactgtggctgcaccatctgtcttcatcttcccgccatctgatcgtactgcgctgagcgggctggcaaggcgcatagnn

SEQ ID NO: 260019 - DNA, 582 bp, Homo sapiens
  misc_feature: GYAE6OF01CNSWX.1.5.A05.1.454.CMB.1.raw
  modified_base (344)..(344): a, c, t, g, unknown or other
  misc_feature (344)..(344): n is a, c, g, or t
  modified_base (446)..(446): a, c, t, g, unknown or other
  misc_feature (446)..(446): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatgggatggatcaacgctggcaatggtaacaactaaaaaattcaanagaaagttccagggcaagagtcacctttaccaagggtacacgactccgacgaggtattacttatatggagctgagcagccgtagagataccgaagacacggntagttattattttgtgtcgtaccttcgtagtggaggtctaattacgttacgtcttacgtaatttgtaccttcccggtggggtacccgtaacggggtaacccgttcgggtacctacccggtccgttcccgtacccgg

SEQ ID NO: 260020 - DNA, 181 bp, Homo sapiens; identical to SEQ ID NO: 259882
  misc_feature: GYAE6OF01AP4R8.1.5.A05.1.454.CMB.1.raw
  modified_base (178)..(181): a, c, t, g, unknown or other
  misc_feature (178)..(181): n is a, c, g, or t

SEQ ID NO: 260021 - DNA, 527 bp, Homo sapiens
  misc_feature: GYAE6OF01DSDZR.1.5.A05.1.454.CMB.1.raw
  modified_base (476)..(476): a, c, t, g, unknown or other
  misc_feature (476)..(476): n is a, c, g, or t
  modified_base (517)..(517): a, c, t, g, unknown or other
  misc_feature (517)..(517): n is a, c, g, or t
tcagacgagtgcgtcacgaccggtgctcgatttagatagatagacaggggacccaacaaccacatccctcctcagaagcccccagagcacaacgccccaccatggactggacctggatgatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcacagaagttccagggcagagtcacctttacagggacacatccgcgaggattactatatggagctgagcagcctgagatccgaagacacggctgtattattttgtgtcgtaccttcgtagtggaggtcattatacgntactaatttgacttccgtgggcctacgggaaccctggtccnccgtctcccg

SEQ ID NO: 260022 - DNA, 254 bp, Homo sapiens
  misc_feature: GYAE6OF01AE6NK.1.5.A05.1.454.CMB.1.raw
  modified_base (249)..(254): a, c, t, g, unknown or other
  misc_feature (249)..(254): n is a, c, g, or t
tcagacgagtgcgtcacgaccggtgctcgatttagatagatagacagggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgcatctgatcgtactgcgctgagcgggctggcaaggcgcatagnnnnnn

SEQ ID NO: 260023 - DNA, 178 bp, Homo sapiens
  misc_feature: GYAE6OF01BSHGS.1.5.A05.1.454.CMB.1.raw
  modified_base (177)..(178): a, c, t, g, unknown or other
  misc_feature (177)..(178): n is a, c, g, or t
tcagacgagtgcgtcacgaccggtgctcgatttagatagatagacgagggcaccaaggccatcggtcttcccctggcaccctcctccaagagcacctctggggcacagcggccctgggctgcctggtcaaggactacttcctcgtactgcgctgagcgggctggcaaggcgcatagnn

SEQ ID NO: 260024 - DNA, 182 bp, Homo sapiens; identical to SEQ ID NO: 259848
  misc_feature: GYAE6OF01EDJQ0.1.5.A05.1.454.CMB.1.raw
  modified_base (178)..(182): a, c, t, g, unknown or other
  misc_feature (178)..(182): n is a, c, g, or t

SEQ ID NO: 260025 - DNA, 181 bp, Homo sapiens
  misc_feature: GYAE6OF01DEDMT.1.5.A05.1.454.CMB.1.raw
  modified_base (178)..(181): a, c, t, g, unknown or other
  misc_feature (178)..(181): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctctctcgactctgagcgggctggcaaggcgcatagnnnn

SEQ ID NO: 260026 - DNA, 526 bp, Homo sapiens
  misc_feature: GYAE6OF01AKFOQ.1.5.A05.1.454.CMB.1.raw
  modified_base (398)..(398): a, c, t, g, unknown or other
  misc_feature (398)..(398): n is a, c, g, or t
  modified_base (439)..(439): a, c, t, g, unknown or other
  misc_feature (439)..(439): n is a, c, g, or t
  modified_base (468)..(468): a, c, t, g, unknown or other
  misc_feature (468)..(468): n is a, c, g, or t
  modified_base (521)..(521): a, c, t, g, unknown or other
  misc_feature (521)..(521): n is a, c, g, or t
tcagacgagtgcgtcacgaccggtgctcgatttagatagatagacaggggacccaacaaccacatccctcctcagaagccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttaactaggtatgctatacattgggtgcgccaggccccggacaaaggcttgagtggatgggatggatcaacgctggcaatggtaacacaaaaaattcacagaagtccagggcagagtcacctttacaggacacatccgcgaggattacttatatgganctgagcagcctgagatccgaagacacggctgtatattttgngcgactctagtgagtcattattacgcttnaagtttgacttccgtggggcctagggaacccttggacacccggttctcccgtntaccg

SEQ ID NO: 260027 - DNA, 178 bp, Homo sapiens; identical to SEQ ID NO: 259843
  misc_feature: GYAE6OF01DKSD0.1.5.A05.1.454.CMB.1.raw
  modified_base (178)..(178): a, c, t, g, unknown or other
  misc_feature (178)..(178): n is a, c, g, or t

SEQ ID NO: 260028 - DNA, 254 bp, Homo sapiens
  misc_feature: GYAE6OF01EWSLZ.1.5.A05.1.454.CMB.1.raw
  modified_base (252)..(254): a, c, t, g, unknown or other
  misc_feature (252)..(254): n is a, c, g, or t
tcagacgagtgcgtcacgaccggtgctcgatttagatagatagacaggggcagttccagatttcaactgctcatcagcagcctgcagtctgaagattttgcagttttattactgtcagcagtataataactggcctccgacgttcggccaagggaccaaggtggaaatcaaacgaactgtggctgcaccatctgtcttcatcttcccgccatctgatcgtactgcgctgagcgggctggcaaggcgcatagnnn

SEQ ID NO: 260029 - DNA, 337 bp, Homo sapiens
  misc_feature: GYAE6OF01ED8N2.1.5.A05.1.454.CMB.1.raw
  modified_base (264)..(265): a, c, t, g, unknown or other
  misc_feature (264)..(265): n is a, c, g, or t
  modified_base (268)..(271): a, c, t, g, unknown or other
  misc_feature (268)..(271): n is a, c, g, or t
  modified_base (273)..(274): a, c, t, g, unknown or other
  misc_feature (273)..(274): n is a, c, g, or t
  modified_base (276)..(276): a, c, t, g, unknown or other
  misc_feature (276)..(276): n is a, c, g, or t
  modified_base (278)..(278): a, c, t, g, unknown or other
  misc_feature (278)..(278): n is a, c, g, or t
  modified_base (280)..(281): a, c, t, g, unknown or other
  misc_feature (280)..(281): n is a, c, g, or t
  modified_base (283)..(337): a, c, t, g, unknown or other
  misc_feature (283)..(337): n is a, c, g, or t
tcagacgagtgcgtcacgaccggtgctcgatttagatagatagacagggggcaggttccagattttcaactgctcatcagcagcctgcagtactagaagattttgctagttttattactgtcagcagtataatactggcctcgacgttcgccaagggaccaggtgaaatcaaacgactgtggctgcaccatctgtcttcatccttcccgcatctgatcgtactgccgctggagccgggctggccaaagggccgacaattagctnngannnncnngngngnngnnnnnnnnnnnnnnnnnnnnnnnnnnnnnnnnnnnnnnnnnnnnnnnnnnnnnnn

SEQ ID NO: 260030 - DNA, 257 bp, Homo sapiens
  misc_feature: GYAE6OF01B8R3Z.1.5.A05.1.454.CMB.1.raw
  modified_base (182)..(183): a, c, t, g, unknown or other
  misc_feature (182)..(183): n is a, c, g, or t
  modified_base (185)..(186): a, c, t, g, unknown or other
  misc_feature (185)..(186): n is a, c, g, or t
  modified_base (188)..(257): a, c, t, g, unknown or other
  misc_feature (188)..(257): n is a, c, g, or t
tcagacgagtgcgtcacgaccggtgctcgatttagatagatagacaggggtcgaccaagggcccatcggtcttcccctggcaccctcctccaagagcacctctggggcacagcggccctgggctgcctggtcaaggctacgttcctctctcgactcgtgagcgggctggcaaggcgcatagnncnncnnnnnnnnnnnnnnnnnnnnnnnnnnnnnnnnnnnnnnnnnnnnnnnnnnnnnnnnnnnnnnnnnnnnnn

SEQ ID NO: 260031 - DNA, 253 bp, Homo sapiens; identical to SEQ ID NO: 259990
  misc_feature: GYAE6OF01B3TW8.1.5.A05.1.454.CMB.1.raw
  modified_base (250)..(253): a, c, t, g, unknown or other
  misc_feature (250)..(253): n is a, c, g, or t

SEQ ID NO: 260032 - DNA, 544 bp, Homo sapiens
  misc_feature: GYAE6OF01A29TA.1.5.A05.1.454.CMB.1.raw
  modified_base (410)..(410): a, c, t, g, unknown or other
  misc_feature (410)..(410): n is a, c, g, or t
tcagacgagtgcgtcacgaccggtgctcgatttagatagatagacaggggacccaacaaccacatccctcctcagaagcccccagagcacaacgccccaccatggactggacctggatgatcctctttttggtggcagcagccacaggtgcccactcccaggtccagcttgtgcagtctggggctgaggtgaagagcctggggctcagtgaaggtttcctgcaaggcttcaggatacaccttcactaggtatgctatacatggtgcgccaggccccggacaaaggcttgagtggatgggatggatcaacgctggcaatggtaacacgaaaaattcacagaagtcagggcagagtcacctttacagggacacatccgacgaggattactatatggagctgagcagcctganatcgaagacacggctagtattaattttgtgtcgtacctctaggtggagtacgtattattaccggctaccgtaatttcgtacgtcccgttaggggccctaacggggacccttagggtcctacccggtcttacccg

SEQ ID NO: 260033 - DNA, 179 bp, Homo sapiens; identical to SEQ ID NO: 259898
  misc_feature: GYAE6OF01CBYTH.1.5.A05.1.454.CMB.1.raw
  modified_base (178)..(179): a, c, t, g, unknown or other
  misc_feature (178)..(179): n is a, c, g, or t

SEQ ID NO: 260034 - DNA, 531 bp, Homo sapiens
  misc_feature: GYAE6OF01ET14S.1.5.A05.1.454.CMB.1.raw
  modified_base (403)..(403): a, c, t, g, unknown or other
  misc_feature (403)..(403): n is a, c, g, or t
  modified_base (444)..(444): a, c, t, g, unknown or other
  misc_feature (444)..(444): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatggggatggatcaacgctggcaatggtaacacaaaaaattcaacagaagttccagggcagagtcacctttaccagggacacatccgcgaggattactatatgganctgagcagcctgagatccgaagacacggctgtatattttgngcgtactcgtagttggaggttcattattacgctctaatttgacttcgtggggccagggtacccctggtccacccgttcctcctaccg

SEQ ID NO: 260035 - DNA, 588 bp, Homo sapiens
  misc_feature: GYAE6OF01A3AM4.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggccccggacaaaggcttgagtggatgggatggatcaacgctggcaatggtaaacaacgaaaaaattacaacaagaagttcgaaggcagagtcacttacgaggacacatccgacgaggtattacttatatggagctagagcagcctagagagtacgaacgacgacggtctagtattagttttcgtgtacgtaccttgtaggtggaggtctagtttacgttacgtacttacgtaatttagtaccttcccggttcggggtacccgtaaccggggtaaccccttacgggtaccctacccggttcccgtcccgtacccgg

SEQ ID NO: 260036 - DNA, 192 bp, Homo sapiens
  misc_feature: GYAE6OF01AVWHY.1.5.A05.1.454.CMB.1.raw
  modified_base (179)..(192): a, c, t, g, unknown or other
  misc_feature (179)..(192): n is a, c, g, or t
tcagacgagtgcgtcacgaccggtgctcgatttagatagatagacagggcaccaagggcccgatcggtcttcccctggcaccctcctccaagagcacctctggggcacagcggccctgggctgcctggtcaaggactacttcctcgtactgcgctgagcgggctggcaaggcgcatagnnnnnnnnnnnnnn

SEQ ID NO: 260037 - DNA, 217 bp, Homo sapiens
  misc_feature: GYAE6OF01DUWIA.1.5.A05.1.454.CMB.1.raw
  modified_base (180)..(217): a, c, t, g, unknown or other
  misc_feature (180)..(217): n is a, c, g, or t
tcagacgagtgcgtcacgaccggtgctcgatttagatagatagacgagggcaccaagggcccatcggtcttcccctggcaccctcctccaagagcacctctggggcaccaggccggccctgggctgcctggtcaaggactacttccacgaccgtctgagcgggctggcaaggcgcatagnnnnnnnnnnnnnnnnnnnnnnnnnnnnnnnnnnnnnn

SEQ ID NO: 260038 - DNA, 513 bp, Homo sapiens
  misc_feature: GYAE6OF01E292S.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttccagggcagagtcatcatcaccgcggacacatccacgagtacagcctacatggaactgaggagcctcagatctgacgacacggccacttattactgcgcgagagattattgcacgtggtcctgggccttgtaaacccacggtcttggtgggcacgtggggacccg

SEQ ID NO: 260039 - DNA, 533 bp, Homo sapiens
  misc_feature: GYAE6OF01EECYY.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatggggatgggatcgaacgctgggcaatggtaacacaaaaaattcaacagaagttccagggcagagtcacctttaccagggacacatccgcgaggattacttatatggagctgagcagcctgagatccgaagacacggctgtataatttttgtgtcgtacctctagtggaggtcattattacgcttcaatttgacttcctggggccagggtaccctggtccaccgtctcctaccg

SEQ ID NO: 260040 - DNA, 632 bp, Homo sapiens
  misc_feature: GYAE6OF01CPG01.1.5.A05.1.454.CMB.1.raw
  modified_base (223)..(223): a, c, t, g, unknown or other
  misc_feature (223)..(223): n is a, c, g, or t
  modified_base (288)..(288): a, c, t, g, unknown or other
  misc_feature (288)..(288): n is a, c, g, or t
  modified_base (425)..(425): a, c, t, g, unknown or other
  misc_feature (425)..(425): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtctggggctgaggtgaagagccgtggggcctcagtgaaggtttccngcaaggcttacgaggatacaccttcactaggtatgctatacattgggtgcgccacggccccgganaaaggcttggagtggagtggagtggatcgaacgctggacaagtaggtaaacaacgaaaaaattcaactaagtaaagttccaagggacagacgtactaccttaacgaggacacatcgacgagtattactatataggancgtgagcagctagagataccgaagacgacggtctagttaagtttattttgtagtaccgtaccgttaccgtaggttacgggtacggttacctaagtttacgttaccgtacttaacgtaagttttacgaccgtttccggttacggggtaccccgtaacggggtaaacccccttgggttacccgtaacccgttccgttcccgttacccgg

SEQ ID NO: 260041 - DNA, 535 bp, Homo sapiens
  misc_feature: GYAE6OF01AGB08.1.5.A05.1.454.CMB.1.raw
  modified_base (446)..(446): a, c, t, g, unknown or other
  misc_feature (446)..(446): n is a, c, g, or t
  modified_base (456)..(456): a, c, t, g, unknown or other
  misc_feature (456)..(456): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatgggatggatcaacgctggcaatggtaaacacaaaaaattcaacagaagttccagggcagagtcacctttacagggacacatccgcgaggattacttatatggagctgagcagcctgagatccgaagacgacgctgtattattttgngtcgtacctntagtggagtctagttattacgactactaattgacttccgtggggacccaggggtaaccctggtaccaccgtctccgtcg

SEQ ID NO: 260042 - DNA, 179 bp, Homo sapiens; identical to SEQ ID NO: 259879
  misc_feature: GYAE6OF01CPVBK.1.5.A05.1.454.CMB.1.raw
  modified_base (178)..(179): a, c, t, g, unknown or other
  misc_feature (178)..(179): n is a, c, g, or t

SEQ ID NO: 260043 - DNA, 266 bp, Homo sapiens
  misc_feature: GYAE6OF01CEJSN.1.5.A05.1.454.CMB.1.raw
  modified_base (215)..(215): a, c, t, g, unknown or other
  misc_feature (215)..(215): n is a, c, g, or t
  modified_base (257)..(266): a, c, t, g, unknown or other
  misc_feature (257)..(266): n is a, c, g, or t
tcagacgagtgcgtcacgaccggtgctcgatttagatagatagacagggggcagttccagatttcaactgctcatcagcagcctgcagtctgaagtattttgcagtttattactgtcagcagtataataactggacctccgacgttcggccaagggaccaaggtgaaatcaaacgactgtaggctgcaccagtctgtcttcatcttccgcagtcngagagtgcgtctctgacgcgggctggcaaggcgcaagtacgnnnnnnnnnn

SEQ ID NO: 260044 - DNA, 735 bp, Homo sapiens
  misc_feature: GYAE6OF01B3GV6.1.5.A05.1.454.CMB.1.raw
  modified_base (232)..(232): a, c, t, g, unknown or other
  misc_feature (232)..(232): n is a, c, g, or t
tcagacgagtgcgtcacgaccggtgctcgatttagatagatagacaggggacccaacaaccacatccctcctcagaagcccccagagcacaacgccccaccatggactggacctggagatcctcttttggtggcagcagccacaggtgcccactcccaggtccagcttgtgcagtctgggggtctggaggtagaagacgccggtcgggcctcgaggtaggtaacggtttccngacgaacggtcttacgaggtactacctaccttcacgttaggtatgactatactagttgggtcgccgccgaccgggccccgaacgaaacggtcttaggagtggagtgggagtggactacgaacgcgtggactaagtacggtaaacaaaactaaaaacttcaacgaaggtaacgttaccgaagggtacgaaggtagtacccgtaacctttaaccggaacgggaccaacgtacgtacccggacggaaggtaactttacttaagtacgtggagtcgtaggacgtcgaacgtccgtaggaacgtacgtacccggaaagacccgtaacgggtactttagttaatttaggttttttggacggtaccgttacccttagttacggtagggtacggtacttaagtttacgttacgtaccttacgttaacgtttgtaacccttccgggtacggggtacccgtaaccggggtaccccttacgggttaccctaaccggttcccgtaccgtacccgg

SEQ ID NO: 260045 - DNA, 254 bp, Homo sapiens
  misc_feature: GYAE6OF01BGHRK.1.5.A05.1.454.CMB.1.raw
  modified_base (251)..(254): a, c, t, g, unknown or other
  misc_feature (251)..(254): n is a, c, g, or t
tcagacgagtgcgtcacgaccggtgctcgatttagatagatagacaggggcagttccagatttcaactgctcatcagcagcctgcagtctgaagattttgcagttttattactgtcagcagtataataactggcctccgacgttcggccaagggaccaaggtggaaatcaaacgaactgtggctgcaccatctgtcttcatcttcccgcatctgatcgtactgcgctgagcgggctggcaaggcgcatagnnnn

SEQ ID NO: 260046 - DNA, 544 bp, Homo sapiens
  misc_feature: GYAE6OF01EO2FL.1.5.A05.1.454.CMB.1.raw
  modified_base (376)..(376): a, c, t, g, unknown or other
  misc_feature (376)..(376): n is a, c, g, or t
  modified_base (445)..(445): a, c, t, g, unknown or other
  misc_feature (445)..(445): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggccccggacaaaggcttgagtggatggggatggatcaacgctggcaatggtaacacaaaaattcacagaagttcagggcagagtcacctttaccagggacanatccgcgaggattacttatataggagctgagcagcctgagatccgaagacacggctgtattatttttgngtcgtaccttcgtagttggagttcatttacttacgcttctaatttgacttcccgtggggcccagggtaaccctgggtaccacccggttctcccgtaccg

SEQ ID NO: 260047 - DNA, 210 bp, Homo sapiens
  misc_feature: GYAE6OF01BJP4Q.1.5.A05.1.454.CMB.1.raw
  modified_base (180)..(210): a, c, t, g, unknown or other
  misc_feature (180)..(210): n is a, c, g, or t
tcagacgagtgcgtcacgaccggtgctcgatttagatagatagacagggcgaccaagggcccatcggtcttcccctggcaccctcctccaagagcacctctggggcacagcggccctgggctgcctggtcaaggactacttcctcgtactgcgctgagcgggctgggcaaggcgcatagnnnnnnnnnnnnnnnnnnnnnnnnnnnnnnn

SEQ ID NO: 260048 - DNA, 184 bp, Homo sapiens; identical to SEQ ID NO: 259966
  misc_feature: GYAE6OF01BDEE5.1.5.A05.1.454.CMB.1.raw
  modified_base (178)..(184): a, c, t, g, unknown or other
  misc_feature (178)..(184): n is a, c, g, or t

SEQ ID NO: 260049 - DNA, 256 bp, Homo sapiens
  misc_feature: GYAE6OF01CGE3H.1.5.A05.1.454.CMB.1.raw
  modified_base (251)..(256): a, c, t, g, unknown or other
  misc_feature (251)..(256): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatctgagagtgcgtctctgagcgggctggcaaggcgcatagnnnnnn

SEQ ID NO: 260050 - DNA, 179 bp, Homo sapiens; identical to SEQ ID NO: 259879
  misc_feature: GYAE6OF01BMYY7.1.5.A05.1.454.CMB.1.raw
  modified_base (178)..(179): a, c, t, g, unknown or other
  misc_feature (178)..(179): n is a, c, g, or t

SEQ ID NO: 260051 - DNA, 252 bp, Homo sapiens
  misc_feature: GYAE6OF01AWY7D.1.5.A05.1.454.CMB.1.raw
  modified_base (249)..(252): a, c, t, g, unknown or other
  misc_feature (249)..(252): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatctcccgcatctgatcgtactgcgctgagcgggctggcaaggcgcatagnnnn

SEQ ID NO: 260052 - DNA, 568 bp, Homo sapiens
  misc_feature: GYAE6OF01CPNL9.1.5.A05.1.454.CMB.1.raw
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
  modified_base (403)..(403): a, c, t, g, unknown or other
  misc_feature (403)..(403): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtcccagcttgtgcagtctggggctgaggtgaagagcctggggcctcagtgaaggtttccngcaaggcttcaggatacacctttnactaggtatgctatacattgggtgcgccaggccccggacaaaggccttgagtggagtgggatggatcaacgctggcaatggtaacacaaaaattcaacagaagttccagggacagagtacacctttacaagggacacatcgcgagatactatatganctgagcagcctgagatccgaagacgacgctagtattacttttagtcgtacgtaccttagtagtaggaggtactagtttaatcgtactacgttaactttgtaacttcccgttacggggaccctacggggtaaccctcggggttacctaccgtccgtccctacccgg

SEQ ID NO: 260053 - DNA, 523 bp, Homo sapiens
  misc_feature: GYAE6OF01DB208.1.5.A05.1.454.CMB.1.raw
  modified_base (221)..(221): a, c, t, g, unknown or other
  misc_feature (221)..(221): n is a, c, g, or t
  modified_base (403)..(403): a, c, t, g, unknown or other
  misc_feature (403)..(403): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttccngcaaggcttcaggatacaccttcactaggtatgctatacattgggtgcgccaggccccggacaaaggcttgagtggatgggatggatcaacgctggcaatggtaaacacaaaaaattcacagaagttccagggcagagtcacctttaccagggacacatccgcgaggattacttatatgganctgagcagcctgagatccgaagacacggctgtatatttttgtgtcgactctagtggagtctattatacgctcaatttgacttcctggggccagggtaccctggtcacccgtcctctaccg

SEQ ID NO: 260054 - DNA, 178 bp, Homo sapiens; identical to SEQ ID NO: 259858
  misc_feature: GYAE6OF01DT8XD.1.5.A05.1.454.CMB.1.raw
  modified_base (178)..(178): a, c, t, g, unknown or other
  misc_feature (178)..(178): n is a, c, g, or t

SEQ ID NO: 260055 - DNA, 180 bp, Homo sapiens; identical to SEQ ID NO: 259970
  misc_feature: GYAE6OF01D6BRU.1.5.A05.1.454.CMB.1.raw
  modified_base (178)..(180): a, c, t, g, unknown or other
  misc_feature (178)..(180): n is a, c, g, or t

SEQ ID NO: 260056 - DNA, 255 bp, Homo sapiens
  misc_feature: GYAE6OF01EXEQ7.1.5.A05.1.454.CMB.1.raw
  modified_base (250)..(255): a, c, t, g, unknown or other
  misc_feature (250)..(255): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgcatctgatcgtactgcgctgagcgggctggcaaggcgcatagnnnnnn

SEQ ID NO: 260057 - DNA, 202 bp, Homo sapiens
  misc_feature: GYAE6OF01BXIPF.1.5.A05.1.454.CMB.1.raw
  modified_base (182)..(202): a, c, t, g, unknown or other
  misc_feature (182)..(202): n is a, c, g, or t
tcagacgagtgcgtcacgaccggtgctcgatttagatagatagacgtagggcaccaagggcccatcggtcttcccctggcaccctcctccaagagcacctcgtcggggcacagcggccctgggctgcctggtcaaggctacttcctactgctagtctgagcgggctggcaaggcgccatagnnnnnnnnnnnnnnnnnnnnn

SEQ ID NO: 260058 - DNA, 796 bp, Homo sapiens
  misc_feature: GYAE6OF01DXZDU.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccacggccccggacgaaaggcttgagtggatgggagtggatcgaacgctggcaagtggtaaacaactaaaaaattacaactaagaaacgttaccgaagggacaaggacgtacaacccgttttaaccgaacggggtacaaccgacgtacccgacggaacggtaacgtttaacgttaacgttaagttaggggtaacgtacgttaggaacgtaccgtaacggtcccgttagggaacgtaacgttaacccgggaaaggtaacccgaaccgggtaccgttaaggtttaagttttaacgtttttttagggtacggttaccgggtaaccccgtttacggttaacgggttacgggttaacggggtttacctaacggtttttaaccgttttaaccggtacccgtttacgttaaaactttttacgggtaaccctttcccgggttacgggggtaccccgttaaccgggggttaaacccccggttacggggttaccccgttaacccccgggttccgttacccccgtttaaccccggg

SEQ ID NO: 260059 - DNA, 533 bp, Homo sapiens
  misc_feature: GYAE6OF01CMCAC.1.5.A05.1.454.CMB.1.raw
  modified_base (444)..(444): a, c, t, g, unknown or other
  misc_feature (444)..(444): n is a, c, g, or t
  modified_base (454)..(454): a, c, t, g, unknown or other
  misc_feature (454)..(454): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatgggatggatcaacgctggcaatggtaaacacaaaaaattcaacagaagttccagggcagagtcaccttaccagggacacatccgcgaggattactatatggagctgagcagcctgagatccgaagacacggctgtattattttgngtcgtacctntagtggagtcattattacgctacgtaatttgacttccgtggggtcccacgggtaccctggtcacccgtctcccgtaccg

SEQ ID NO: 260060 - DNA, 254 bp, Homo sapiens
  misc_feature: GYAE6OF01ATQKU.1.5.A05.1.454.CMB.1.raw
  modified_base (252)..(254): a, c, t, g, unknown or other
  misc_feature (252)..(254): n is a, c, g, or t
tcagacgagtgcgtcacgaccggtgctcgatttagatagatagacaggggcagttccagatttcaactgctcatcagcagcctgcagtctgaagattttgcagttttattactgtcagcagtataataactggcctccgacgttcggccaagggaccaaggtggaaatcaaacgaactgtggctgcaccatctgtcttcatccttccgccatctgatcgtactgcgctgagcgggctggcaaggcgcatagnnn

SEQ ID NO: 260061 - DNA, 321 bp, Homo sapiens
  misc_feature: GYAE6OF01A5YJI.1.5.A05.1.454.CMB.1.raw
  modified_base (272)..(282): a, c, t, g, unknown or other
  misc_feature (272)..(282): n is a, c, g, or t
  modified_base (284)..(321): a, c, t, g, unknown or other
  misc_feature (284)..(321): n is a, c, g, or t
tcagacgagtgcgtcacgaccggtgctcgatttagatagatagacagggggacgagttccagatttcaactgctcactcagcagcctgcagtctggaaagtatttttgccagttttagttactggtcaggcgagttataataactggcctccgacgttcggccaagggaccaaggtgaaatcaaacgaactgtggctgcaccatctggtcttcatcttacccgccatcgtgagagtgcgttctctgaggcgggctggcaaggcgccatacgnnnnnnnnnnncnnnnnnnnnnnnnnnnnnnnnnnnnnnnnnnnnnnnnn

SEQ ID NO: 260062 - DNA, 524 bp, Homo sapiens
  misc_feature: GYAE6OF01ESB3Y.1.5.A05.1.454.CMB.1.raw
  modified_base (443)..(443): a, c, t, g, unknown or other
  misc_feature (443)..(443): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatggggatggatcaacgctggcaatggtaacacaaaaaattcacagaagttccagggcagagtcacctttacagggacacatccgcgaggattactatatggagctgagcagcctgagatccgaagacacggctgtatattttgngtcgacctctagtggaggtcattattacgctcaatttgacttcctggggccagggaaccctggtaccaccgtctccgtacc

SEQ ID NO: 260063 - DNA, 732 bp, Homo sapiens
  misc_feature: GYAE6OF01D5I2O.1.5.A05.1.454.CMB.1.raw
tcagacgagtgcgtcacgaccggtgctcgatttagatagatagacaggggacccaacaaccacatccctcctcagaacgcccccagagcacaaccgccccaccatggactggacctggaggatccttcttttggtggcagcagccacaggtgcccactcccaggtccagcttgtgcagtcgtggggctggaggtgaagagccgtggggcctcgagtgtaaggtttcctgcaaggcttcgaggtactacaccttcacgttaggtatgactatacagttggtgcgccgacggccccgacgaaaggctgaggtggagtgggatggatcaacgcgtggactaagtaggtaaaacaactaaaaaattcaactaaggtaaacgttaccgaagggacaaggtacgtacctaacccgtttaaccgaacggggtaaccaacgtaacgtaccggtacggaacgggtaactttaaccgttaagtaagtagggaacgtcgtaggaacggcgaacggtacccgtaggaacgtaacgtaaccggaaacggtaaccgaccggtacgttagttaagttttaacgtttttaggtaccggtaccggttaaccgttaccggttagggttaggtaacggttacgtaagtttacgttaccgtactttacgtaacgttttcgaccgttccggtcggggtaaccgtaaccgggttaacccgtcggttaacccgtacccggttcctccgtaacccg

SEQ ID NO: 260064 - DNA, 536 bp, Homo sapiens
  misc_feature: GYAE6OF01DJVYK.1.5.A05.1.454.CMB.1.raw
  modified_base (409)..(409): a, c, t, g, unknown or other
  misc_feature (409)..(409): n is a, c, g, or t
  modified_base (453)..(453): a, c, t, g, unknown or other
  misc_feature (453)..(453): n is a, c, g, or t
  modified_base (483)..(483): a, c, t, g, unknown or other
  misc_feature (483)..(483): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacacctttcactaggtatgctatacattgggtgcgccaggcccccggacaaaggcttgagtggatgggatgggatcaacgctgggcaatggtaaacacaaaaaattcaacagaagttccagggcagagtcacctttaccagggacacatccgcgaggattacttatatagganctgagcagccctgagatccgaagacacggctgtattatttttgngtcgtacctctagtggagtcattattacgntcgtaatttgacttccgtagggccacggtaccctaggtcaccgtctcctaccg

SEQ ID NO: 260065 - DNA, 531 bp, Homo sapiens
  misc_feature: GYAE6OF01CG3JL.1.5.A05.1.454.CMB.1.raw
  modified_base (443)..(443): a, c, t, g, unknown or other
  misc_feature (443)..(443): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatgggatggatcaacgctggcaatggtaacacaaaaaattcaacagaagttccagggcagagtcacctttacagggacacatccgcgaggattactatatggagctgagcagcctgagatccgaagacacggctgtatattttgngtcgtactctagtggagtctattatcgctctaatttgactccgtggggacccacgggtaacccttgggtaccaccggtctccctaccg

SEQ ID NO: 260066 - DNA, 179 bp, Homo sapiens
  misc_feature: GYAE6OF01AY0E6.1.5.A05.1.454.CMB.1.raw
  modified_base (179)..(179): a, c, t, g, unknown or other
  misc_feature (179)..(179): n is a, c, g, or t
tcagacgagtgcgtcacgaccggtgctcgatttagatagatagacagggcaccaagggcccatcggtcttccccctggcaccctcctccaagagcacctctggggcacagcggccctgggctgcctggtcaaggactacttcctacgtgagctctgagcgggctggcaaggcgcatagn

SEQ ID NO: 260067 - DNA, 180 bp, Homo sapiens; identical to SEQ ID NO: 259864
  misc_feature: GYAE6OF01B4TH6.1.5.A05.1.454.CMB.1.raw
  modified_base (178)..(180): a, c, t, g, unknown or other
  misc_feature (178)..(180): n is a, c, g, or t

SEQ ID NO: 260068 - DNA, 800 bp, Homo sapiens
  misc_feature: GYAE6OF01DWG50.1.5.A05.1.454.CMB.1.raw
  modified_base (221)..(221): a, c, t, g, unknown or other
  misc_feature (221)..(221): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttccngcaaggcttcgaggataccaccttcacgttaggtatgactatacagttgggtcgccgaccgaccgggaccccgaagaaggtcgtaggaggttgggaggtaggtagtagacgtacgtacggtacgacggtaactaagtaacgaaacaaaactaactacgaacgaagtaacgtacggacgaacgtacgtactacccgtaaccgtaacggaacgtaaccacgtaccgtacggtaacgtaacgttaactttagtaagtaggaacggcgttaacggcgaacgtacgtacggtacgaacgtaacgtaacgtaacccggaacgtacccggtagtttaacgttttacgttttaaggttttttccgtaccgggtaaccggttacccgttaacgtttaccgggttaaaggggttaccggttaaacggtttaactttaaccgtttaaccgtttaccgtaaaccgttttacgtttaaaccggtacccggtttacccgggtcccgggttaaacccgggggtaaccccttaacccggggtaaccccttacccgggttaaccccttccccggttacccgtaccccggtaacccg

SEQ ID NO: 260069 - DNA, 180 bp, Homo sapiens; identical to SEQ ID NO: 259868
  misc_feature: GYAE6OF01AW0FX.1.5.A05.1.454.CMB.1.raw
  modified_base (178)..(180): a, c, t, g, unknown or other
  misc_feature (178)..(180): n is a, c, g, or t

SEQ ID NO: 260070 - DNA, 251 bp, Homo sapiens
  misc_feature: GYAE6OF01BXQSZ.1.5.A05.1.454.CMB.1.raw
  modified_base (249)..(251): a, c, t, g, unknown or other
  misc_feature (249)..(251): n is a, c, g, or t
tcagacgagtgcgtcacgaccggtgctcgatttagatagatagacaggggcagttccagatttcaactgctcatcagcagcctgcagtctgaagattttgctagtttattactgtcagcagtataataactggcctccgacgttcggccaagggaccaaggtggaaatcaaacgaactgtggctgcaccatctgtcttcatcttccgcatctgactcgtctctactgagcggctggcaaggcgcatagnnn

SEQ ID NO: 260071 - DNA, 257 bp, Homo sapiens
  misc_feature: GYAE6OF01EDWBY.1.5.A05.1.454.CMB.1.raw
  modified_base (251)..(257): a, c, t, g, unknown or other
  misc_feature (251)..(257): n is a, c, g, or t
tcagacgagtgcgtcacgaccggtgctcgatttagatagatagacaggggcagttccagatttcaactgctcatcagcagcctgcagtctgaagattttgctagtttattactgtcagcagtataataactggcctcgacgttcggccaagggaccaaggtggaaatcaaacgaactgtggctgcaccatctgtcttcatcttcccgcatctgatcgtactgcgctgaggcgggctggcaaggcgcatagnnnnnnn

SEQ ID NO: 260072 - DNA, 179 bp, Homo sapiens; identical to SEQ ID NO: 259841
  misc_feature: GYAE6OF01BUPGZ.1.5.A05.1.454.CMB.1.raw
  modified_base (178)..(179): a, c, t, g, unknown or other
  misc_feature (178)..(179): n is a, c, g, or t

SEQ ID NO: 260073 - DNA, 533 bp, Homo sapiens
  misc_feature: GYAE6OF01EXQ28.1.5.A05.1.454.CMB.1.raw
  modified_base (344)..(344): a, c, t, g, unknown or other
  misc_feature (344)..(344): n is a, c, g, or t
  modified_base (446)..(446): a, c, t, g, unknown or other
  misc_feature (446)..(446): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggccccggacaaaaggccttgagtggatggggatggatcaacgctggcaatggtaacacaaaaaattcaanagaagttccagggcagagtcacctttacagggacacatccgcgaggattactatatggagctgagcagcctgagataccgaagacacggctgtatattttgngcgtacctctagtggaggtcagttattacgctacgtaatttgacttccgtggggccacgggtaccctggtccaccggtctcctaccg

SEQ ID NO: 260074 - DNA, 180 bp, Homo sapiens; identical to SEQ ID NO: 259872
  misc_feature: GYAE6OF01CXIGT.1.5.A05.1.454.CMB.1.raw
  modified_base (178)..(180): a, c, t, g, unknown or other
  misc_feature (178)..(180): n is a, c, g, or t

SEQ ID NO: 260075 - DNA, 204 bp, Homo sapiens
  misc_feature: GYAE6OF01AXHAN.1.5.A05.1.454.CMB.1.raw
  modified_base (184)..(204): a, c, t, g, unknown or other
  misc_feature (184)..(204): n is a, c, g, or t
tcagacgagtgcgtcacgaccggtgctcgatttagatagatagacagggcgaccaagggcccatcggtcgttcccctggcgaccctcctccaagacgcacctctggggcacagcggccctgggctgcctggtcaacggactacttcctcgtactgcgtcttgagcgggctggcaaggcgcatgnnnnnnnnnnnnnnnnnnnnn

SEQ ID NO: 260076 - DNA, 529 bp, Homo sapiens
  misc_feature: GYAE6OF01EEL02.1.5.A05.1.454.CMB.1.raw
  modified_base (269)..(269): a, c, t, g, unknown or other
  misc_feature (269)..(269): n is a, c, g, or t
  modified_base (284)..(284): a, c, t, g, unknown or other
  misc_feature (284)..(284): n is a, c, g, or t
  modified_base (384)..(384): a, c, t, g, unknown or other
  misc_feature (384)..(384): n is a, c, g, or t
  modified_base (402)..(402): a, c, t, g, unknown or other
  misc_feature (402)..(402): n is a, c, g, or t
  modified_base (444)..(444): a, c, t, g, unknown or other
  misc_feature (444)..(444): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtncgccaggccccgganaaaggcttgagtggatggggatgggatcaacgctggcaatggtaacacaaaaaattcaacagaagttccagggcagagtcaccttacaggacacatccgngaggtatactatatgganctgagcagcctgagatccgaagacacggctgtatatttttgngtcgtaccttgtagtggagtctattattacgctctaatttgacttcgtggggccagggtaccctggtaccaccgtctccgtaccg

SEQ ID NO: 260077 - DNA, 585 bp, Homo sapiens
  misc_feature: GYAE6OF01C4X1S.1.5.A05.1.454.CMB.1.raw
  modified_base (221)..(221): a, c, t, g, unknown or other
  misc_feature (221)..(221): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttccngcaaggcttcaggatacacctttcactaggtatgactatacattgggtgcgccacggccccggacaaaggcttgagtggagtgggatggatcgaacggctggacaagtaggtaacaacaaaaaattcaacaagtaacgttaccgagggacagagtacaaccgtttaccgagggacacgagtccgacgaggtaattacttaatagtaggagtacgtgagcagtcctgagagtaccgaagaccgacggctagtagtttattttgtcgtcgtacctgtagtggtagtctagttacgtacgtctacgtaatttgtacgttccgtcggggacctaacgggtaccctggtccacccgtcgtcccgtaccg

SEQ ID NO: 260078 - DNA, 527 bp, Homo sapiens
  misc_feature: GYAE6OF01B3HZF.1.5.A05.1.454.CMB.1.raw
  modified_base (445)..(445): a, c, t, g, unknown or other
  misc_feature (445)..(445): n is a, c, g, or t
  modified_base (455)..(455): a, c, t, g, unknown or other
  misc_feature (455)..(455): n is a, c, g, or t
  modified_base (478)..(478): a, c, t, g, unknown or other
  misc_feature (478)..(478): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggccccggacaaaggcttgagtggatgggatggatcaacgctggcaatggtaaacacaaaaaattcaacagaagttccagggcagagtcacctttacagggacacatccgcgaggattacttatatggagctgagcagcctgagatccgaagacacggctgtatagtttttgngtcgtacctnttagtggaggtctattattacgntcaatttgactcgtgggccacgggtaccctggtcaccgtctcccgtacg

SEQ ID NO: 260079 - DNA, 549 bp, Homo sapiens
  misc_feature: GYAE6OF01DKEY5.1.5.A05.1.454.CMB.1.raw
  modified_base (222)..(222): a, c, t, g, unknown or other
  misc_feature (222)..(222): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactccccaggtccagcttgtgcagtctggggctgaggtgaagagcctggggcctcagtgaaggtttccngcaaggcttcaggatacaccttcactaggtatgctatacattgggtgcgccaggcccccggacaaacggcttgagtggatgggatgggatcaacgctggcaatggtaaacacaaaaaattcaacagaagttccagggcagagtcaccttacagggacacatccgcgaggattacttatatggagctgagcagcctgagatccgaagacacggctgtattagtttttgtgtcgtaccttcgtagtggaggttctaagtttattacgtctacgtaatttgacttccgtggggcccaggggtacccctgggtccaccgtctcccgtaccg

SEQ ID NO: 260080 - DNA, 183 bp, Homo sapiens
  misc_feature: GYAE6OF01EJ6XH.1.5.A05.1.454.CMB.1.raw
  modified_base (178)..(183): a, c, t, g, unknown or other
  misc_feature (178)..(183): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctcgtactgcgctgagcgggctggcaaggcgcatagnnnnnn

SEQ ID NO: 260081 - DNA, 332 bp, Homo sapiens
  misc_feature: GYAE6OF01A479E.1.5.A05.1.454.CMB.1.raw
  modified_base (275)..(276): a, c, t, g, unknown or other
  misc_feature (275)..(276): n is a, c, g, or t
  modified_base (278)..(332): a, c, t, g, unknown or other
  misc_feature (278)..(332): n is a, c, g, or t
tcagacgagtgcgtcacgaccggtgctcgatttagatagatagacaggggctagtttccgagtatttccaacgtgctcatcagccagccctgcagtctggaagattttggcctaggttttacttactgtcacgcagtataataacctggccctccgacgttcggccgaagggaccaagggtgaaatcaaacgactgtggctgcaccatctagtcttcatcttcccgcatctgatcgtactgtcgctgagcggctaggcaaggccgacataagcannannnnnnnnnnnnnnnnnnnnnnnnnnnnnnnnnnnnnnnnnnnnnnnnnnnnnnn

SEQ ID NO: 260082 - DNA, 250 bp, Homo sapiens
  misc_feature: GYAE6OF01A5IUL.1.5.A05.1.454.CMB.1.raw
  modified_base (250)..(250): a, c, t, g, unknown or other
  misc_feature (250)..(250): n is a, c, g, or t
tcagacgagtgcgtcacgaccggtgctcgatttagatagatagacagggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatctgatcgtactgcgctgagcgggctggcaaggcgcatagn

SEQ ID NO: 260083 - DNA, 250 bp, Homo sapiens
  misc_feature: GYAE6OF01EEFZF.1.5.A05.1.454.CMB.1.raw
  modified_base (246)..(250): a, c, t, g, unknown or other
  misc_feature (246)..(250): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgagttcggccaagggaccaaggtgaaatcaaacgactgtggctgcaccatctgtcttcatcttcccgcatctgatcgtactgcgctgagcggctggcaaggcgcatagnnnnn

SEQ ID NO: 260084 - DNA, 527 bp, Homo sapiens
  misc_feature: GYAE6OF01DMIUB.1.5.A05.1.454.CMB.1.raw
  modified_base (222)..(222): a, c, t, g, unknown or other
  misc_feature (222)..(222): n is a, c, g, or t
  modified_base (339)..(339): a, c, t, g, unknown or other
  misc_feature (339)..(339): n is a, c, g, or t
  modified_base (459)..(459): a, c, t, g, unknown or other
  misc_feature (459)..(459): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttccngcaaggcttcaggatacaccttcactaggtatgctatacattgggtgcgccaggccccggacaaaggcttgagtggatgggatggatcaacgctggcaatggtaacacaaaaaattnaacagaagttccagggcagagtcacttaccaggacacatccgcgaggatacttatatggagctgagcagcctgagatccgaagacacggctagtatatttttgagtcgtactctagtggnggtcattatacgtctctaatttgactccgtggggcccaggggtaccctggtctaccgtctccgtaccg

SEQ ID NO: 260085 - DNA, 179 bp, Homo sapiens; identical to SEQ ID NO: 259974
  misc_feature: GYAE6OF01C01PY.1.5.A05.1.454.CMB.1.raw
  modified_base (178)..(179): a, c, t, g, unknown or other
  misc_feature (178)..(179): n is a, c, g, or t

SEQ ID NO: 260086 - DNA, 253 bp, Homo sapiens
  misc_feature: GYAE6OF01B51BV.1.5.A05.1.454.CMB.1.raw
  modified_base (249)..(253): a, c, t, g, unknown or other
  misc_feature (249)..(253): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttccgcatctgatcgtactgcgctgagcgggctggcaaggcgcatagnnnnn

SEQ ID NO: 260087 - DNA, 253 bp, Homo sapiens
  misc_feature: GYAE6OF01C2M3D.1.5.A05.1.454.CMB.1.raw
  modified_base (248)..(253): a, c, t, g, unknown or other
  misc_feature (248)..(253): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgactgtggctgcacatctgtcttcatcttcccgcatctgatcgtactgcgctgagcgggctggcaaggcgcatagnnnnnn

SEQ ID NO: 260088 - DNA, 181 bp, Homo sapiens; identical to SEQ ID NO: 259842
  misc_feature: GYAE6OF01CFNFH.1.5.A05.1.454.CMB.1.raw
  modified_base (178)..(181): a, c, t, g, unknown or other
  misc_feature (178)..(181): n is a, c, g, or t

SEQ ID NO: 260089 - DNA, 254 bp, Homo sapiens; identical to SEQ ID NO: 260045
  misc_feature: GYAE6OF01BCOR5.1.5.A05.1.454.CMB.1.raw
  modified_base (251)..(254): a, c, t, g, unknown or other
  misc_feature (251)..(254): n is a, c, g, or t

SEQ ID NO: 260090 - DNA, 538 bp, Homo sapiens
  misc_feature: GYAE6OF01CKPFW.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacgaaaaaattcacagaagttccagggcagagtcacctttaccagggacacatccgcgaggattacttatatggagctgagcagcctgagataccgaagacacggctagtattattttgtgcgtacctctagtggaggtcattattacgctacgtaatttgacttccgtcggggaccaggggaaccctggtccaccgttcgtccctaccg

SEQ ID NO: 260091 - DNA, 559 bp, Homo sapiens
  misc_feature: GYAE6OF01EAX9R.1.5.A05.1.454.CMB.1.raw
  modified_base (283)..(283): a, c, t, g, unknown or other
  misc_feature (283)..(283): n is a, c, g, or t
  modified_base (405)..(405): a, c, t, g, unknown or other
  misc_feature (405)..(405): n is a, c, g, or t
  modified_base (453)..(453): a, c, t, g, unknown or other
  misc_feature (453)..(453): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggccccgganaaaggcttgagtggatgggatggatcaacgctggcaatggtaaacaacaaaaaattcaacagaagttccagggcagagtcaccttacaggacacatccgcgaaggtattacttaatatgganactgagcagcctgagactaccgaagaccacggtctgttatatttttgngtccgtacttgtagtggaggttctaagtttagttacgtacttacgtaattttgacttccgtggggacccaacggggtaccctggtacctacccgtctcccgtaccg

SEQ ID NO: 260092 - DNA, 717 bp, Homo sapiens
  misc_feature: GYAE6OF01B5ACW.1.5.A05.1.454.CMB.1.raw
  modified_base (223)..(223): a, c, t, g, unknown or other
  misc_feature (223)..(223): n is a, c, g, or t
  modified_base (693)..(693): a, c, t, g, unknown or other
  misc_feature (693)..(693): n is a, c, g, or t
tcagacgagtgcgtcacgaccggtgctcgatttagatagatagacagggacccaacaaccacatccctcctcagaacgcccccagagcacaacgccccaccatggactggacctggaggatccttctttttggtggcagcagccacaggtgcccactcccaggtccagcttgtgcagtctggggctgaggtgaagagccgtggggcctcagtgaaggtttccngcaaggcttcaggatacaccttcactaggtatgctatacagttgggtgcgccgacgggcccccggaacgaaacggccttggaggtgggaagttggggagttggatccgaacggccgtggaccaagtaggtaaaacaaactaaaaaattcgaaacgagtaaacgttcccgaagggacaaggaacgttactaacccgtttaacgaacggggaaccaacgacgttacccggacggtaaggtaactttacgttaataacgttgggaacgtcgtagacgtacgacgtccgtaggaacgtacgtacccgaagaaccgtaacggcgttagtttaagtttagtttttcgtcgtaccgttaccgtagtttacggtgggtacgtacttaagtttaacgttaccgttactacgttaacgtttcgtaaccgttcccgggttacgggtacccgaaccggggttaccccgttgggttaaccccncccgtttccgttcccgtaacccgg

SEQ ID NO: 260093 - DNA, 184 bp, Homo sapiens; identical to SEQ ID NO: 259966
  misc_feature: GYAE6OF01CD70J.1.5.A05.1.454.CMB.1.raw
  modified_base (178)..(184): a, c, t, g, unknown or other
  misc_feature (178)..(184): n is a, c, g, or t

SEQ ID NO: 260094 - DNA, 180 bp, Homo sapiens; identical to SEQ ID NO: 259864
  misc_feature: GYAE6OF01DWCKO.1.5.A05.1.454.CMB.1.raw
  modified_base (178)..(180): a, c, t, g, unknown or other
  misc_feature (178)..(180): n is a, c, g, or t

SEQ ID NO: 260095 - DNA, 735 bp, Homo sapiens
  misc_feature: GYAE6OF01AMPFV.1.5.A05.1.454.CMB.1.raw
  modified_base (234)..(234): a, c, t, g, unknown or other
  misc_feature (234)..(234): n is a, c, g, or t
  modified_base (359)..(359): a, c, t, g, unknown or other
  misc_feature (359)..(359): n is a, c, g, or t
tcagacgagtgcgtcacgaccggtgctcgatttagatagatagacagggacccaacaaccacatccctcctcagaagcccccagagcacaacgccccaccatggactggacctggaggatcctctttttggtggcagcagccacgaggtcgcccacctcccgaggtccagtcttgtgcagtcgtgggctggaggtagaaggacgccgtcggggcctcgagtagtacggtttccngacgaaggtcttcgaggtactacctaccttcacgttaggtatcgtactatactaggttgggtcgccgccgaccggaccccggaagaacggtctaggagtggagtggagtggatacgacgcgtganagtagaacaaataaaatcaacagtacgtacgaggcagatacctaccgttacgacggacacgacgtaccgacgtaagtacttacttagtagtgagtcgtagacgtacgacgtaccgtaggaacgtaccgtaaccggaaacggccgtaacgggtacttagttaacgtttttcgttttacggacggttacccgttaacgttaccggttagggttaaccggtaggttacgtttaaacgtttacgttaccggtaccttaacggtttaacggtttccggtaacccggtttcccggggttaccggggtaacccgggttaacccggggttaacccggttcgggttaacccccgttaccccgttaccggttccccgtaacccggg

SEQ ID NO: 260096 - DNA, 179 bp, Homo sapiens; identical to SEQ ID NO: 259987
  misc_feature: GYAE6OF01EUE8A.1.5.A05.1.454.CMB.1.raw
  modified_base (178)..(179): a, c, t, g, unknown or other
  misc_feature (178)..(179): n is a, c, g, or t

SEQ ID NO: 260097 - DNA, 192 bp, Homo sapiens
  misc_feature: GYAE6OF01BJAGL.1.5.A05.1.454.CMB.1.raw
  modified_base (179)..(192): a, c, t, g, unknown or other
  misc_feature (179)..(192): n is a, c, g, or t
tcagacgagtgcgtcacgaccggtgctcgatttagatagatagacagggcaccaagggcccatcggtcttccccctggcaccctcctccaagagcacctctggggcacagcggccctgggctgcctggtcaaggactacttcctcgtactgcgctgagcgggctggcaaggcgcatagnnnnnnnnnnnnnn

SEQ ID NO: 260098 - DNA, 541 bp, Homo sapiens
  misc_feature: GYAE6OF01BXR88.1.5.A05.1.454.CMB.1.raw
  modified_base (456)..(456): a, c, t, g, unknown or other
  misc_feature (456)..(456): n is a, c, g, or t
tcagacgagtgcgtcacgaccggtgctcgatttagatagatagacaggggacccaataaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggccccggacaaaggcttgagtggatgggatggatcaacgctggcaatggtaacacaaaaattcaacagaagttccagggcagagtcacctttaccagggacacatccgcgaggattacttatatggagctgagcagcctgagatccgaagacacggctgttatatttttgtcgtcgtaccttntaggtggaggtcagtttattacgcttactaatttgacttccgtggggcccacgggtaccctggtaccacccgttctcccgtaccg

SEQ ID NO: 260099 - DNA, 541 bp, Homo sapiens
  misc_feature: GYAE6OF01DE9G3.1.5.A05.1.454.CMB.1.raw
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (381)..(381): a, c, t, g, unknown or other
  misc_feature (381)..(381): n is a, c, g, or t
  modified_base (449)..(449): a, c, t, g, unknown or other
  misc_feature (449)..(449): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccgganaaaggcttgngtggatgggatggatcaacgctggcaatggtaaacacaaaaaattcacaagaagttcgagggcagagtcacctttaccagggacacntccgcgaggattacttatatggagctgagcagcctgagatccgaagacacggctagttatatttttgngtcgtcttctagtggagttcatttatacgtctctaatttgacttccgtacggggccaacgggtacccttggtctaacccggtctccctaccg

SEQ ID NO: 260100 - DNA, 254 bp, Homo sapiens
  misc_feature: GYAE6OF01BQO9I.1.5.A05.1.454.CMB.1.raw
  modified_base (248)..(254): a, c, t, g, unknown or other
  misc_feature (248)..(254): n is a, c, g, or t
tcagacgagtgcgtcacgaccggtgctcgatttagatagatagacagggcagttccagatttcaactgctcatcagcagcctgcagtctgaagattttgcagtttattactgtcagcagtataataactggcctccgacgttcggccaagggaccaaggtggaaatcaaacgactgtggctgcaccatctgtcttcatcttcccgcatctgatcgtactgcgctgagcgggctggcaaggcgcatagnnnnnnn

SEQ ID NO: 260101 - DNA, 550 bp, Homo sapiens
  misc_feature: GYAE6OF01DJOZD.1.5.A05.1.454.CMB.1.raw
  modified_base (437)..(437): a, c, t, g, unknown or other
  misc_feature (437)..(437): n is a, c, g, or t
  modified_base (445)..(445): a, c, t, g, unknown or other
  misc_feature (445)..(445): n is a, c, g, or t
  modified_base (452)..(452): a, c, t, g, unknown or other
  misc_feature (452)..(452): n is a, c, g, or t
  modified_base (461)..(461): a, c, t, g, unknown or other
  misc_feature (461)..(461): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatgggatggatcaacgctggcaatggtaacaacaaaaaattcaacagaacgttccagggcagagtcacctttaccagggacacatccgcgaggattacttatatggagctgagcagcctagagagtccgaagacacggntgttattnttttagngcgtacctntagtggagtctattactacgtctactaagtttgaaccttccgtcggggaccacggggtaaccctagggtccaccgttccgtccgtaccg

SEQ ID NO: 260102 - DNA, 254 bp, Homo sapiens; identical to SEQ ID NO: 259973
  misc_feature: GYAE6OF01ARTYS.1.5.A05.1.454.CMB.1.raw
  modified_base (251)..(254): a, c, t, g, unknown or other
  misc_feature (251)..(254): n is a, c, g, or t

SEQ ID NO: 260103 - DNA, 232 bp, Homo sapiens
  misc_feature: GYAE6OF01BU1V5.1.5.A05.1.454.CMB.1.raw
  modified_base (186)..(232): a, c, t, g, unknown or other
  misc_feature (186)..(232): n is a, c, g, or t
tcagacgagtgcgtcacgaccggtgctcgatttagatagatagacagggcaccgaagggcccatccggtcttcccctggcacccctcctccaagagctacctcgtgggggcacagcggccctgggctgccgtggtcaaggactacttcctcgattcgcgtctgagcggctggcaaggcgcataggnnnnnnnnnnnnnnnnnnnnnnnnnnnnnnnnnnnnnnnnnnnnnnn

SEQ ID NO: 260104 - DNA, 560 bp, Homo sapiens
  misc_feature: GYAE6OF01DS4AS.1.5.A05.1.454.CMB.1.raw
  modified_base (244)..(244): a, c, t, g, unknown or other
  misc_feature (244)..(244): n is a, c, g, or t
  modified_base (282)..(282): a, c, t, g, unknown or other
  misc_feature (282)..(282): n is a, c, g, or t
  modified_base (390)..(390): a, c, t, g, unknown or other
  misc_feature (390)..(390): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttnactaggtatgctatacattgggtgcgccaggccccganaagcttgagtggatgggatggatcaacgctggacaagtggtaaacaacaaaaaaattcaacaagaagttccagggacagagtcaaccttaccgagggacacataccgngaggtattacgttatagtggagacgtgagcagcctagtagactaccgaagaccgacggctagtattaattttgagtcgtacttcgtagtggagttatagttatcgtctcgtaagttgacttcgacggggtcccacgggtaacccgtcggtactacccggtctccgtaccg

SEQ ID NO: 260105 - DNA, 622 bp, Homo sapiens
  misc_feature: GYAE6OF01ELJ7R.1.5.A05.1.454.CMB.1.raw
tcagacgagtgcgtcacgaccggtgctcgatttagatagatagacagggggacccaacaaccacaatccctcctcagaagcccccagagcacaacgccccaccatggactggacctggaggatcctcttttggtggcagcagccacgaggtgcccactcccaggtccagcttgtgcagtctggggctgaggtgaagaagcctggggcctcagtgaaggtttcctgcaaggcttcaggatacaccttcactaggtatgctatacattgggtgcgtccaggccccggacaaaggcttcgagtggatggggatggatcaacgctggcaagtcggtaacaacaaaaacttcaacagaagttccagggcagagtacacctttaccacgggacacactccgacgaggattactatactggagctgagcagcctagagtactaccgaagaccacggtacttagttattaacgtttttggtagtaccgtacccttcgttacggtcgggtacggtactaagtttaacgttaccgtaccttacgtaaacgttttacggacctttccggtacggggtacccgaaccggggtaacccttacgggtaccctacccggttccgtcccgttacccgg

SEQ ID NO: 260106 - DNA, 528 bp, Homo sapiens
  misc_feature: GYAE6OF01CM74R.1.5.A05.1.454.CMB.1.raw
  modified_base (425)..(425): a, c, t, g, unknown or other
  misc_feature (425)..(425): n is a, c, g, or t
  modified_base (439)..(439): a, c, t, g, unknown or other
  misc_feature (439)..(439): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatgggatggatcaacgctggcaatggtaacacaaaaatcacagaagttccagggcagagtcacttacagggacacatccgcgaggattactatatggagctgagcaagcctgagatccgaagcacggntgtattagttttgngtcgtaccttgtagtggagtcattattacgtctactaatttgacttccgtggggccacgggtaaccctggtcctaccgtctccgtaccg

SEQ ID NO: 260107 - DNA, 568 bp, Homo sapiens
  misc_feature: GYAE6OF01C96FQ.1.5.A05.1.454.CMB.1.raw
  modified_base (409)..(409): a, c, t, g, unknown or other
  misc_feature (409)..(409): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccacggccccggacaaaggcttgagtggatgggatggatcaacgctggcaatggtaaacaacaaaaattcacagaagttccgagggcagagtcacctttaccgaggacacatccgacgaggtattacttatatggagtntgagcagcctggagtataccgaagacgacggctagtattagttttgtcgtcgtaccttcgtagtgggagttcgtatttattacgtcttacgtaagtttcgaccgttccggacggggtccgaacgggtaccctcggtaccgtccgttcctcccgtacccg

SEQ ID NO: 260108 - DNA, 563 bp, Homo sapiens
  misc_feature: GYAE6OF01B1YQW.1.5.A05.1.454.CMB.1.raw
  modified_base (283)..(283): a, c, t, g, unknown or other
  misc_feature (283)..(283): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggccccgganaaaggcttgagtggatgggatggatcaacgctggcaatggtaacaacaaaaaattcaacaagaagttccagggcagagtcaacctttacagggacacatccgcgagattacttatatggagctagagacagcctgagataccgaagacacggcttgtaattagttttgtcgtcgtaccttgtagtgggagttacattacttacgcttactaagttttgacgttccgtcggggtacccaacggggtaccccttgggtacctacccggttctcccgtacccg

SEQ ID NO: 260109 - DNA, 181 bp, Homo sapiens; identical to SEQ ID NO: 259882
  misc_feature: GYAE6OF01EJV5I.1.5.A05.1.454.CMB.1.raw
  modified_base (178)..(181): a, c, t, g, unknown or other
  misc_feature (178)..(181): n is a, c, g, or t

SEQ ID NO: 260110 - DNA, 631 bp, Homo sapiens
  misc_feature: GYAE6OF01BPHDG.1.5.A05.1.454.CMB.1.raw
  modified_base (283)..(283): a, c, t, g, unknown or other
  misc_feature (283)..(283): n is a, c, g, or t
tcagacgagtgcgtcacgaccggtgctcgatttagatagatagacaggggacccaacaaccacatccctcctcagaagcccccagagcacaacgccccaccatggactggacctggatgatcctcttttggtggcagcagccacaggtgcccactcccaggtccagcttgtgcagtctggggctgaggtgaagagccgtgggcctcagtgaaggtttcctgcaaggcttcaggatacaccttcactaggtatgctatacattgggtgcgccacggccccgganaaaggcttgagtggagtgggatggatcgaacgcgtaggcaatagggtaaacaacaaaaaaattcaacaagaagttaccagggacagagtcacttacacgggacacatccgcgaaggacttacttaatagtaggagactgaggtacagcctagagacgtaccgaagacgaccggtactgttaattacgtttttagcgtacgtaacccttgttacggtggtacgggtactagtttaacgttaccgtacgttaccttaattttacgggtaccgttacccggtacggggtaacccgttaacggggtaacccccgttagggtacccgtaaccccggttcccgttaacccccgg

SEQ ID NO: 260111 - DNA, 256 bp, Homo sapiens
  misc_feature: GYAE6OF01BEAJD.1.5.A05.1.454.CMB.1.raw
  modified_base (251)..(256): a, c, t, g, unknown or other
  misc_feature (251)..(256): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatctgatcgtactgcgctgagcgggctggcaaggcgcatagnnnnnn

SEQ ID NO: 260112 - DNA, 180 bp, Homo sapiens; identical to SEQ ID NO: 259929
  misc_feature: GYAE6OF01BHGEO.1.5.A05.1.454.CMB.1.raw
  modified_base (178)..(180): a, c, t, g, unknown or other
  misc_feature (178)..(180): n is a, c, g, or t

SEQ ID NO: 260113 - DNA, 524 bp, Homo sapiens
  misc_feature: GYAE6OF01AJD19.1.5.A05.1.454.CMB.1.raw
  modified_base (207)..(207): a, c, t, g, unknown or other
  misc_feature (207)..(207): n is a, c, g, or t
  modified_base (387)..(387): a, c, t, g, unknown or other
  misc_feature (387)..(387): n is a, c, g, or t
  modified_base (447)..(447): a, c, t, g, unknown or other
  misc_feature (447)..(447): n is a, c, g, or t
  modified_base (455)..(455): a, c, t, g, unknown or other
  misc_feature (455)..(455): n is a, c, g, or t
  modified_base (476)..(476): a, c, t, g, unknown or other
  misc_feature (476)..(476): n is a, c, g, or t
  modified_base (512)..(512): a, c, t, g, unknown or other
  misc_feature (512)..(512): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctnagtgaaggtttcctgcaaggcttcaggatacaccttcactaggtatgctatacattgggtgcgccaggccccggacaaaggcttggagtggatgggatggatcaacgctggcaagtggtaacacaaaaattcaacagaagttccagggacagagtacacctttacagggacacgatccgngaggattacttatatggagctgagcagcctgagatccgaagacacggctgtatattttgngtcgactntagtggagtctattattacgntctattgactcgtgggcctacgggaccctggtaccnccgtctccgtcg

SEQ ID NO: 260114 - DNA, 576 bp, Homo sapiens
  misc_feature: GYAE6OF01A978V.1.5.A05.1.454.CMB.1.raw
  modified_base (282)..(282): a, c, t, g, unknown or other
  misc_feature (282)..(282): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggccccgganaaaggcttgagtggatgggatggatcgaacgctggcaagtggtaacaacaaaaattcaacagaagttccgaggcagagtcacctttacgaggacacactccgacgaggtattacttatatggagtctgagcagcctagagactaccgaagacgacggcttacgttattagtttttgcgtccgtaccttcgttaggtggtacgtctagtttagtccgtacgttacgtaatttcgacgttccgtacggggaccctacgggtaacccgtcggtaccacccggttccgtcccgtaccg

SEQ ID NO: 260115 - DNA, 535 bp, Homo sapiens
  misc_feature: GYAE6OF01AYH4K.1.5.A05.1.454.CMB.1.raw
  modified_base (528)..(528): a, c, t, g, unknown or other
  misc_feature (528)..(528): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatgggatggatcaacgctggcaatggtaacacaaaaattcaacagaagttccagggcagagtcacctttacagggtacacgactccgcgagggattacttatatggagtctgagcagccctgagatccgaaagcgacggctagttatatttttgtgtcgtaccttctagtggagtcattattacgctactatttgacttccgtgggccagggtaaccctggtaccaccgtntccctcg

SEQ ID NO: 260116 - DNA, 262 bp, Homo sapiens
  misc_feature: GYAE6OF01CIWLM.1.5.A05.1.454.CMB.1.raw
  modified_base (257)..(262): a, c, t, g, unknown or other
  misc_feature (257)..(262): n is a, c, g, or t
tcagacgagtgcgtcacgaccggtgctcgatttagatagatagacaggggcagttccagatttcaactgctcatcagcagcctgcagtctgaagtattttgctagtttattactgtcagcagtataataactggcctccgacgttcggccaagggaccaaggtgaaatcaaaacgactgtaggctgcaccatctgtcttcatccttccgccatctgatcgtactgcgctggacgcgggctggacaaggcgctatagnnnnnn

SEQ ID NO: 260117 - DNA, 573 bp, Homo sapiens
  misc_feature: GYAE6OF01D7MQX.1.5.A05.1.454.CMB.1.raw
  modified_base (266)..(266): a, c, t, g, unknown or other
  misc_feature (266)..(266): n is a, c, g, or t
  modified_base (406)..(406): a, c, t, g, unknown or other
  misc_feature (406)..(406): n is a, c, g, or t
tcagacgagtgcgtcacgaccggtgctcgatttagatagatagacaggggacccaacaaccacatccctcctcagaagcccccagagcacaacgccccaccatggactggacctggatgatcctcttttggtggcagcagccacaggtgcccactcccaggtccagcttgtgcagtctggggctgaggtgaagagcctggggcctcagtgaaggtttcctgcaaggcttcaggatacaccttcactaggtatgctatacattggtncgccacggccccggacaaaggcttgagtggatgggatggatcgaacgcgtggcaagtggtaacaacaaaaattcacaagaagttcgaggacagacgtactaaccttacgaggacacgactccgacgaggtattacgttanagtgagctagagcagctgaagactaccgaagacgacggtctagtatttaatttcgcgtacgaccttcgtaggtcggagttctagttacgtacgtcttacgtaagtttcgtaaccgttcgtagggtacccgtaacgggtaacccctggttcgtacccgtcgttacccc

SEQ ID NO: 260118 - DNA, 445 bp, Homo sapiens
  misc_feature: GYAE6OF01EUCH6.1.5.A05.1.454.CMB.1.raw
  modified_base (276)..(276): a, c, t, g, unknown or other
  misc_feature (276)..(276): n is a, c, g, or t
  modified_base (366)..(366): a, c, t, g, unknown or other
  misc_feature (366)..(366): n is a, c, g, or t
  modified_base (416)..(416): a, c, t, g, unknown or other
  misc_feature (416)..(416): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
  modified_base (435)..(445): a, c, t, g, unknown or other
  misc_feature (435)..(445): n is a, c, g, or t
tcagacgagtgcgtcacgaccggtgctcgatttagatagatagacagggtggctggagactgcgtcatcactatttctccaggggaaagagccaccctctcctgcagggccagtcagagttttagcagcaacttagcctggtaccagcagaaacctggccaggctcccaggctcctcatctatggtgcatctactagggtcactggtatcccagccaggttcagtggtagtgggtctgcgacagagttcactctcaccatcagcagcctgcagtcngaagattttgcagttttatactgtcagcagtataataactggccttccgacgttcggccaagggaccaaggtaggaaatcaaacgactgngctgcacatctgtcttacatccttcccgctatctgacgcactcgtctagngcggctggcagcgnanagnnnnnnnnnnn

SEQ ID NO: 260119 - DNA, 534 bp, Homo sapiens
  misc_feature: GYAE6OF01AQISB.1.5.A05.1.454.CMB.1.raw
  modified_base (447)..(447): a, c, t, g, unknown or other
  misc_feature (447)..(447): n is a, c, g, or t
  modified_base (457)..(457): a, c, t, g, unknown or other
  misc_feature (457)..(457): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatgggatggatcaacgctggcaatggtaaacacaaaaaattcaacagaagttccagggcagagtcacctttaccagggacacatccgcgaggattacttatatggagctgagcagcctgagatccgaagacacggctgtatatttttgngtcgtacctntagtggaggtcagttattacgctactaatttgacttccgtaggggcccagggtaccctggtcacccgtctcctaccg

SEQ ID NO: 260120 - DNA, 254 bp, Homo sapiens
  misc_feature: GYAE6OF01A30UV.1.5.A05.1.454.CMB.1.raw
  modified_base (250)..(254): a, c, t, g, unknown or other
  misc_feature (250)..(254): n is a, c, g, or t
tcagacgagtgcgtcacgaccggtgctcgatttagatagatagacaggggcagttccagatttcaactgctcatcagcagcctgcagtctgaagattttgcagttttattactgtcagcagtataataactggcctccgacgttcggccaagggaccaaggtggaaatcaaacgaactgtggctgcaccatctgtcttcatcttccgccatctgatcgtactgcgctgagcggctggcaaggcgcatagnnnnn

SEQ ID NO: 260121 - DNA, 539 bp, Homo sapiens
  misc_feature: GYAE6OF01BGK77.1.5.A05.1.454.CMB.1.raw
  modified_base (458)..(458): a, c, t, g, unknown or other
  misc_feature (458)..(458): n is a, c, g, or t
  modified_base (521)..(521): a, c, t, g, unknown or other
  misc_feature (521)..(521): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggcccccggacaaaggcttgagtggatggggatggatcgaacgctggcaagtggtaacacaaaaattcaacagaagttccagggcagagtcacctttaccagggacacatccgcgaggattactatagtgagctgagcagcctgagatccgaagacgacggctagtatagttttgtgcgtacttntagtggagtcagttattcgctagtatttgacttcggtcgggaccacgggtaaccctggtaccncccgttcgtcccgtaccg

SEQ ID NO: 260122 - DNA, 181 bp, Homo sapiens; identical to SEQ ID NO: 260025
  misc_feature: GYAE6OF01AWYLB.1.5.A05.1.454.CMB.1.raw
  modified_base (178)..(181): a, c, t, g, unknown or other
  misc_feature (178)..(181): n is a, c, g, or t

SEQ ID NO: 260123 - DNA, 179 bp, Homo sapiens; identical to SEQ ID NO: 259841
  misc_feature: GYAE6OF01CMVOW.1.5.A05.1.454.CMB.1.raw
  modified_base (178)..(179): a, c, t, g, unknown or other
  misc_feature (178)..(179): n is a, c, g, or t

SEQ ID NO: 260124 - DNA, 257 bp, Homo sapiens
  misc_feature: GYAE6OF01C41B1.1.5.A05.1.454.CMB.1.raw
  modified_base (225)..(225): a, c, t, g, unknown or other
  misc_feature (225)..(225): n is a, c, g, or t
  modified_base (253)..(257): a, c, t, g, unknown or other
  misc_feature (253)..(257): n is a, c, g, or t
tcagacgagtgcgtcacgaccggtgctcgatttagatagatagacaggggcagttccagatttcaactgctcatcagcagcctgcagtctgaagatttttgctagttttattactgtcagcagtataataactggcctcgacgttcggccaagggaccaaggtgaaatcaaacgactgtggctgcaccatctgtcttcatcttcccgcatctgattcgtactgcnctggagcggctggcaaaggcgacatagnnnnn

SEQ ID NO: 260125 - DNA, 520 bp, Homo sapiens
  misc_feature: GYAE6OF01BHGAJ.1.5.A05.1.454.CMB.1.raw
  modified_base (441)..(441): a, c, t, g, unknown or other
  misc_feature (441)..(441): n is a, c, g, or t
  modified_base (451)..(451): a, c, t, g, unknown or other
  misc_feature (451)..(451): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatgggatggatcaacgctggcaatggtaacacaaaaattcaacagaagttccagggcagagtcacctttacagggacacatccgcgaggattactatatggagctgagcagcctgagatcgaagacacggctgtatattttgngtcgaccttntagtggaggtcattattacgcttcaatttgactcgtgggccagggtaccctggtcaccgtcgtcctacg

SEQ ID NO: 260126 - DNA, 182 bp, Homo sapiens; identical to SEQ ID NO: 259873
  misc_feature: GYAE6OF01ER4KJ.1.5.A05.1.454.CMB.1.raw
  modified_base (178)..(182): a, c, t, g, unknown or other
  misc_feature (178)..(182): n is a, c, g, or t

SEQ ID NO: 260127 - DNA, 559 bp, Homo sapiens
  misc_feature: GYAE6OF01ASOPH.1.5.A05.1.454.CMB.1.raw
  modified_base (388)..(388): a, c, t, g, unknown or other
  misc_feature (388)..(388): n is a, c, g, or t
  modified_base (410)..(410): a, c, t, g, unknown or other
  misc_feature (410)..(410): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatgggatggatcgaacgctggcaataggtaacaacaaaaattcaacagaagttccgagggcagagtcaccttacgagggacacgatccgngaggtattactatagtggagtntagagcagccgtagagagtccgaagacacggcttacgtattgtttttgcgtacgtaccttcgttagtggtagtactattacgttacgacttacgtatttgactccggtcgggaccgtacgggtaccctggtaccaccgtcgtcctaccg

SEQ ID NO: 260128 - DNA, 179 bp, Homo sapiens
  misc_feature: GYAE6OF01BW2H1.1.5.A05.1.454.CMB.1.raw
  modified_base (179)..(179): a, c, t, g, unknown or other
  misc_feature (179)..(179): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaaggactacttcctcgtagcactctgagcgggctggcaaggcgcatagn

SEQ ID NO: 260129 - DNA, 551 bp, Homo sapiens
  misc_feature: GYAE6OF01C4KPO.1.5.A05.1.454.CMB.1.raw
  modified_base (207)..(207): a, c, t, g, unknown or other
  misc_feature (207)..(207): n is a, c, g, or t
  modified_base (219)..(219): a, c, t, g, unknown or other
  misc_feature (219)..(219): n is a, c, g, or t
  modified_base (227)..(227): a, c, t, g, unknown or other
  misc_feature (227)..(227): n is a, c, g, or t
  modified_base (275)..(275): a, c, t, g, unknown or other
  misc_feature (275)..(275): n is a, c, g, or t
  modified_base (400)..(400): a, c, t, g, unknown or other
  misc_feature (400)..(400): n is a, c, g, or t
  modified_base (435)..(435): a, c, t, g, unknown or other
  misc_feature (435)..(435): n is a, c, g, or t
tcagacgagtgcgtcacgaccggtgctcgatttagatagatagacaggggacccaacaaccacatccctcctcagaacgccccagagcacaacgccccaccatggactggacctggaggatccttctttttggtggcagcagccacaggtgcccactcccaggtccagcttgtgcagtctggggctgaggtgaagagcctgggcctnagtgaggtttcngcaggctnaggatcacttcactaggtatgctatacattggtgcgacaggccccganaaagcttgagtggatggatggatgaacgctgcaataggtaacaacaaaaaattcaacagaacgttccgaagggcagagtcaaccttacagggacacgatccgagaggtattacttaatatcggancgtagagacacggctgaacagtccgaagacacggntacgtattatttgtgtaccgtacttacgtagtcggagttacgatttagtacgtcttagaactttgacttccggacgggtccgacgggtacccgtagtaccgaccgtctccgtaccg

SEQ ID NO: 260130 - DNA, 540 bp, Homo sapiens
  misc_feature: GYAE6OF01BKYTR.1.5.A05.1.454.CMB.1.raw
  modified_base (407)..(407): a, c, t, g, unknown or other
  misc_feature (407)..(407): n is a, c, g, or t
  modified_base (479)..(479): a, c, t, g, unknown or other
  misc_feature (479)..(479): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatggggatggatcaacgctggcaatggtaaacacaaaaaattcaacagaaagttccaggggcagagtcacctttaccagggacacatccgacgagattacttatatgganctgagcagcctgagatccgaagacgacggctagtattattttgtgcgtacctctagtggagtcattatacgntcgtatttgacttccgtggggccacggggtaacccctggtaccacccggtctcccgtaccg

SEQ ID NO: 260131 - DNA, 563 bp, Homo sapiens
  misc_feature: GYAE6OF01DHCBD.1.5.A05.1.454.CMB.1.raw
  modified_base (244)..(244): a, c, t, g, unknown or other
  misc_feature (244)..(244): n is a, c, g, or t
  modified_base (283)..(283): a, c, t, g, unknown or other
  misc_feature (283)..(283): n is a, c, g, or t
  modified_base (401)..(401): a, c, t, g, unknown or other
  misc_feature (401)..(401): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttnactaggtatgctatacattgggtgcgccaggccccgganaaaggcttgagtggagtgggatggatcgaacgctggcaatggtaaacacaaaaaattcaacagaagttccagggcagagtacacctttaccagggcacatccgcgaaggattacttanattggagctagagcaagcctgagatccgaagacgacggctagtacttaagtttttgagtacgtaccttgtacgtggaggttctaatttagtaccgtcgtactaattttgaaccttccgtacggggaccacgggtaaccctggtccaccgtcgtcccgtaccg

SEQ ID NO: 260132 - DNA, 572 bp, Homo sapiens
  misc_feature: GYAE6OF01CBG96.1.5.A05.1.454.CMB.1.raw
  modified_base (283)..(283): a, c, t, g, unknown or other
  misc_feature (283)..(283): n is a, c, g, or t
  modified_base (381)..(381): a, c, t, g, unknown or other
  misc_feature (381)..(381): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggttcctgcaaggcttcaggatacacctttcactaggtatgctatacattgggtgcgccaggccccgganaaaggcttgagtggagtgggatggatcaacgctggcaagtggtaacaactaaaaaattcaacagaacgttccgagggcagatcaccttacagggacanactccgcgagattactatagtggagctgacgcagcctagagtacgtaccgaaagcgacggcttagtattatttttggcgtcgtaccttgtacggttggaacgttcgtaatttacgttacgacttacttaagtttcgaccgttccgtcggggacccaacggggtaccctaggtccaccgttcgtccctaccg

SEQ ID NO: 260133 - DNA, 672 bp, Homo sapiens
  misc_feature: GYAE6OF01CXYDD.1.5.A05.1.454.CMB.1.raw
  modified_base (282)..(282): a, c, t, g, unknown or other
  misc_feature (282)..(282): n is a, c, g, or t
  modified_base (362)..(362): a, c, t, g, unknown or other
  misc_feature (362)..(362): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagccttgggcctcagtgaaggtttcctgcaaggcttcaggatacaccttcactaggtatgctatacattgggtgcgccaggccccgganaaaggcttgagtggatgggatggatcaacgctggcaatggaacaacaaaactaaaactacaacgaagtaacgtacgaganaggtactacctaccttaacggacgaacacgtcgtaccgaggacgttaactttaacttagtaacggtaggacgtacgtaggaacgacgaccgtcgtagaacgtaaccgtaacggaactacggaccgtacgttaaggttatttttaggttttacggtcgtaccgttacttacggttaggtacgggtacgttacgttaatttacggttacgtcgttaaactttaagtttaccggtaccgttccggggtaccggggtaacccggtaacccggggtaacccgttcggtaaccccgttcccgtccccgttaccccg

SEQ ID NO: 260134 - DNA, 250 bp, Homo sapiens
  misc_feature: GYAE6OF01B080G.1.5.A05.1.454.CMB.1.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
  modified_base (242)..(242): a, c, t, g, unknown or other
  misc_feature (242)..(242): n is a, c, g, or t
  modified_base (245)..(250): a, c, t, g, unknown or other
  misc_feature (245)..(250): n is a, c, g, or t
tcagacgagtgcgtcacgaccggtgctcgatttagatagatagacaggggcagttccagatttcaactgctcatcagcagcctgcagtctgaagtattttgctagttttattactgtcagcagtataataactgcctccgacgttcggaccaaggacaaggtgaaatcaaacgactgtgctgcacatctatctcatcttccncatctgatcgtatgcgctgagcggntggacaaggccatanagnnnnnn

SEQ ID NO: 260135 - DNA, 791 bp, Homo sapiens
  misc_feature: GYAE6OF01BZA9R.1.5.A05.1.454.CMB.1.raw
  modified_base (356)..(356): a, c, t, g, unknown or other
  misc_feature (356)..(356): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtctggggctgaggtgaagagccgtggggcctcagtgaaggtttcctgcaaggcttcgaggatacaccttcactaggtatgctatacagttgggtgcgccgacggccccggacaaaggcttagaggtggagtgggatggatcaacgctggcaagtggtaaacaactaaaaaattaccaanaacgaagtttaccgaagggacgaacggtaaggtacctaaccgttttaaccgaacggggtaaccaacgtaacgttacccggacgtaagggtaactttaaccgttagtaagttagggtacgtaccgtagtaacggacgtaaacggtcctacgggaagtacgtaacccggaaaggaaccgtaaccggtcgttaagtttaacgtttaacgtttttttacgggtaccggttaccgttaaccccgtttacggttaacggttacggggtacggtttaccgttaaacgtttttaacgttaccggtaccgtttaaccgttaaaggttttaccggttaacccgtttaccccgggttacgggggtacccccgtaaaccgggggttaacccccgtttacgggttacccccgtaaccccgggtttcccgttaccccgttaaccccggg

SEQ ID NO: 260136 - DNA, 710 bp, Homo sapiens
  misc_feature: GYAE6OF01DKTDS.1.5.A05.1.454.CMB.1.raw
  modified_base (231)..(231): a, c, t, g, unknown or other
  misc_feature (231)..(231): n is a, c, g, or t
  modified_base (555)..(555): a, c, t, g, unknown or other
  misc_feature (555)..(555): n is a, c, g, or t
tcagacgagtgcgtcacgaccggtgctcgatttagatagatagacaggggacccaacaaccacatccctcctcagaacgcccccagagcacaaccgccccaccatggactggacctggatgattccttctttttggtggcagcagccacaggtgcccactcccaggtccagcttgtgcagtcgtggggctggaggtgaagagccgtggggcctgaaaagtgaaggtttccngcaaggtcttcgaggactactaccttcaacgttaggtatgctatactagttgggtgcgccgacggcccccggaagaaacggtcttaggaggtggagtgggatggactcgaacgtctaggactaagtaggtaaacaacgtaaaaaattcaacgtaagtaaacgttaccgaagggacaaggtacgtaccgtaacccgtttaacgaacgggtaaccaacgtacgttacccggacggtaacgggtactttaaccgttaataacggttagggacgtcgttaggacgtaccgagtcccgtagaacgaacgtacccggaagacgaacggtnttaggttaatttagttttcggagtccgtaaccgttcgttaggtcggtaaggttctagtttacgttacgtcgtttacgtaagttttcgacccgtttccgggtacgggtacccgtacgggtaccccgttgggttcccgtacccgttccttaccccgg

SEQ ID NO: 260137 - DNA, 252 bp, Homo sapiens
  misc_feature: GYAE6OF01BZ15T.1.5.A05.1.454.CMB.1.raw
  modified_base (250)..(252): a, c, t, g, unknown or other
  misc_feature (250)..(252): n is a, c, g, or t
tcagacgagtgcgtcacgaccggtgctcgatttagatagatagacaggggcagttccagatttcaactgctcatcagcagcctgcagtctgaagattttgctagttttattactgtcagcagtataataactggcctcgacgttcggccaagggaccaaggtggaaatcaaacgaactgtggctgcaccatctgtcttcatcttcccgcatctgatcgtactgcgctgagcggctggcaaggcgcatagnnn

SEQ ID NO: 260138 - DNA, 529 bp, Homo sapiens
  misc_feature: GYAE6OF01AFCY8.1.5.A05.1.454.CMB.1.raw
  modified_base (477)..(477): a, c, t, g, unknown or other
  misc_feature (477)..(477): n is a, c, g, or t
  modified_base (524)..(524): a, c, t, g, unknown or other
  misc_feature (524)..(524): n is a, c, g, or t
tcagacgagtgcgtcacgaccggtgctcgatttagatagatagacaggggacccaacaaccacatccctcctcagaagccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatgggatggatcaacgctggcaatggtaacacaaaaattcaacagaagttccagggcagagtcacctttacaggacacatccgcgaggattacttatagtggagctgagtcagcctagagatccgaagacacggctgtacttattttgtgtcgtacctctagtggagtcgattattacgntttaattgtactcgtcgggcctagggaaccctggtcaccgtctcctntaccg

SEQ ID NO: 260139 - DNA, 256 bp, Homo sapiens
  misc_feature: GYAE6OF01DHVNZ.1.5.A05.1.454.CMB.1.raw
  modified_base (252)..(256): a, c, t, g, unknown or other
  misc_feature (252)..(256): n is a, c, g, or t
tcagacgagtgcgtcacgaccggtgctcgatttagatagatagacaggggcagttccagatttcaactgctcatcagcagcctgcagtctgaagattttgcagttttattactgtcagcagtataataactggcctccgacgttcggccaagggaccaaggtggaaatcaaacgaactgtggctgcaccatctgtcttcatcttcccgccatctgatcgtactgcgctgagcgggctggcaaggcgcatagnnnnn

SEQ ID NO: 260140 - DNA, 707 bp, Homo sapiens
  misc_feature: GYAE6OF01AGZWY.1.5.A05.1.454.CMB.1.raw
  modified_base (270)..(270): a, c, t, g, unknown or other
  misc_feature (270)..(270): n is a, c, g, or t
  modified_base (286)..(286): a, c, t, g, unknown or other
  misc_feature (286)..(286): n is a, c, g, or t
tcagacgagtgcgtcacgaccggtgctcgatttagatagatagacaggggacccaacaaccacatccctcctcagaagcccccagagcacaaccgccccaccatggactggacctggaggatcctctttttggtggcagcagccacaggtgcccactcccaggtccagcttgtgcagtctggggctgaggtgaagagcctggggcctcagtgaaggtttcctgcaaggtcttcgaggatacaccttcactaggtatgctatacattgggngcgccacggccccganaaggcttggagtggagtgggatggatcgaacgcgtggcaagtggtaacaactaaaaacttcaacgtagaaacgttccgaaggggcaaggacgtacctaacccgtttaaccgaggggaccacgtacgtcccggacggaacggtaactttacttaagtagttagggacgtcgtaggacgtcgaacgccgtaggacgtaacgtacccggaacgtaccgtaccggtacttaggttaattttgttttttcggacgtaccggttaccgttaccggttagggttacgggtaacggttacgttaagtttacgtttaccgtaccgttaccgttaaacggttttcggacccgtttccgggtacgggggacccctaaccgggggttaccccgttcgggttaccccgacccggtttcccgtcccgttacccgg

SEQ ID NO: 260141 - DNA, 624 bp, Homo sapiens
  misc_feature: GYAE6OF01ENJZT.1.5.A05.1.454.CMB.1.raw
  modified_base (285)..(285): a, c, t, g, unknown or other
  misc_feature (285)..(285): n is a, c, g, or t
  modified_base (413)..(413): a, c, t, g, unknown or other
  misc_feature (413)..(413): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcgaggatacaccttcactaggtatgctatacattgggtgcgccacggccccgganaaaggcttgagtggatgggatggatcgaacgcgtggacaatggtaaacactaaaaaattcaacagaagttccagggcagagtcacgtttaccgaggacacatccgcgaggtattacgttatagtggancgtagagcgagcctagagactaccggaagtaccgacggtcttagtaagtttacgtttttagtcggtaccgtaccttacgttaggttacgggacgttacgtaagtttaacgtttaccgaccgttacgttaaacgtttcgtaaccgttccggttacggggtacccgaacgggttaaccccgttcggtaccgtacccgttccgtcccgtacccg

SEQ ID NO: 260142 - DNA, 556 bp, Homo sapiens
  misc_feature: GYAE6OF01EK076.1.5.A05.1.454.CMB.1.raw
  modified_base (282)..(282): a, c, t, g, unknown or other
  misc_feature (282)..(282): n is a, c, g, or t
  modified_base (444)..(444): a, c, t, g, unknown or other
  misc_feature (444)..(444): n is a, c, g, or t
  modified_base (452)..(452): a, c, t, g, unknown or other
  misc_feature (452)..(452): n is a, c, g, or t
  modified_base (491)..(491): a, c, t, g, unknown or other
  misc_feature (491)..(491): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaggtttcctgcaaggcttcaggatacaccttcactaggtatgctatacattgggtgcgccaggccccgganaaaggcttgagtggatgggatggatcaacgctggcaataggtaacaacaaaaaaattcaacaagaagttccagggcagagtcacctttaccgaggacacactccgcgaggattacttatatggagctgagcagcctgagatccgaagacacggatgtaattntttttagngtacgtaccttcgttaggtggaggtctattattaccgtntacgtaattttgacgttccgtaggggacccacggggtacccttggaccacccgttctcctacccg

SEQ ID NO: 260143 - DNA, 550 bp, Homo sapiens
  misc_feature: GYAE6OF01C9DWR.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggccccggacaaaggcttgagtggatgggatggatcaacgctggcaatggtaacacaaaaattcacagaagttccagggcagagtcacctttaccgagggacacatccgcgaggtattacttatatggagctgagacagcctgagactccggaagacgacggtctagtattatttttggagtcgtaccttcgtaggttggagttctatttactacgtcttacgtaatttgacttccggtcgggtccacgggtaccctggtaccaccgtctccgtaccg

SEQ ID NO: 260144 - DNA, 1058 bp, Homo sapiens
  misc_feature: GYAE6OF01DT6ZV.1.5.A05.1.454.CMB.1.raw
  modified_base (233)..(233): a, c, t, g, unknown or other
  misc_feature (233)..(233): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtcgcccactcccaggtccagcttgtgcagtcgtggggctggaggtgaagaagtccgtcggggtcctcgtagtagaaggttttccngacgaaggtcttcgaggtactacctaccgttacacgttaggtatcgtacttatacgtagttcggggtacgcccgaccggaccccgggacccgaaaaggtacgttcggaggtagggtaggtaggggagtacggtagtaccgaacgtaccgtacggtacgtaaacgtaacggtaacgtaaaacctaaaaaacgttaacctaacgtaacggtaaacggtttaaccggaaccgggacgtaacggtaacgtacccgttaaccccgtttaaaccggtaaccggaaccgaaactaccgtaccggtacgggtaaacggttaacgtttaaacgtttaacgttaaggtacgggtaacgggtcgttaacggtacggtaaccgtacggtaacccgttaccgggtaaagtaacccggtttaaaccgggaaaacccgggttaacggtaaccccgggtttaacgttttaaccggtttttaacggtttttaaacgtttttttaccggggtaacccgggttacccccggtttaaaccccttaaggggtttttaaccggggtaaacgggggttttacggttaaaaccggtttttaacccgttttttaaaacgggttaacccccttttttaccgggaaaaaccgttttttaaccggggttttaaacccggtttacccccgggtttaaacccgggggtttccccccgggggggtaaaacccgggggttaaaaccccccccgggtttaccccggggggtttaaacccccggttttacccccgggttaaacccccgttttaccccccccggttacccgtaacccccgggtttaaaaacccccccggg

SEQ ID NO: 260145 - DNA, 251 bp, Homo sapiens
  misc_feature: GYAE6OF01BB051.1.5.A05.1.454.CMB.1.raw
  modified_base (250)..(251): a, c, t, g, unknown or other
  misc_feature (250)..(251): n is a, c, g, or t
tcagacgagtgcgtcacgaccggtgctcgatttagatagatagacagggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatctgatcgtactgcgctgagcgggctggcaaggcgcatagnn

SEQ ID NO: 260146 - DNA, 185 bp, Homo sapiens
  misc_feature: GYAE6OF01CSDF1.1.5.A05.1.454.CMB.1.raw
  modified_base (179)..(185): a, c, t, g, unknown or other
  misc_feature (179)..(185): n is a, c, g, or t
tcagacgagtgcgtcacgaccggtgctcgatttagatagatagacagggcaccaagggcccatcggtcttcccctggcaccctcctccaagagcacctcgtggggcacagcggccctgggctgcctggtcaaggactacttccagtactctatctgagcgggctggcaaggcgcatagnnnnnnn

SEQ ID NO: 260147 - DNA, 179 bp, Homo sapiens; identical to SEQ ID NO: 259841
  misc_feature: GYAE6OF01AZ2YX.1.5.A05.1.454.CMB.1.raw
  modified_base (178)..(179): a, c, t, g, unknown or other
  misc_feature (178)..(179): n is a, c, g, or t

SEQ ID NO: 260148 - DNA, 555 bp, Homo sapiens
  misc_feature: GYAE6OF01DIK26.1.5.A05.1.454.CMB.1.raw
  modified_base (419)..(419): a, c, t, g, unknown or other
  misc_feature (419)..(419): n is a, c, g, or t
  modified_base (448)..(448): a, c, t, g, unknown or other
  misc_feature (448)..(448): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggcccccggacaaaggcttgagtggagtgggatggatcaacgctggcaatggtaaacacaaaaaattcacaagaagttaccagggcagagtacactttaccagggacacatccgcgaggattacttatatgagctgagcagcctganatccgaagacacgctgtattaatttttgngtcgtactctagtgggtagtctagtttacttacgtcttacaattttcgacttccggtcggggtacccaggggtaaccccttgggtcctacccggtctcccgtacccg

SEQ ID NO: 260149 - DNA, 534 bp, Homo sapiens
  misc_feature: GYAE6OF01B2BRB.1.5.A05.1.454.CMB.1.raw
  modified_base (284)..(284): a, c, t, g, unknown or other
  misc_feature (284)..(284): n is a, c, g, or t
  modified_base (443)..(443): a, c, t, g, unknown or other
  misc_feature (443)..(443): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctataaattgggtgcgccaggcccccgganaaaggcttgagtggatgggatggatcaacgctggcaatggtaacaacaaaaaattcaacagaagttcagggcagagtcaccttacaggacacatccgcgagattacttatatggagctgagcagcctgagataccgaagacacggctgtattattttgngtcgacctctaggtggtagtcattattacgctactaatttcgacttccgtggggcctagggaaccctggtaccaccggtctccgtctaccg

SEQ ID NO: 260150 - DNA, 525 bp, Homo sapiens
  misc_feature: GYAE6OF01BK1HR.1.5.A05.1.454.CMB.1.raw
  modified_base (267)..(267): a, c, t, g, unknown or other
  misc_feature (267)..(267): n is a, c, g, or t
  modified_base (380)..(380): a, c, t, g, unknown or other
  misc_feature (380)..(380): n is a, c, g, or t
  modified_base (433)..(433): a, c, t, g, unknown or other
  misc_feature (433)..(433): n is a, c, g, or t
  modified_base (439)..(439): a, c, t, g, unknown or other
  misc_feature (439)..(439): n is a, c, g, or t
  modified_base (447)..(447): a, c, t, g, unknown or other
  misc_feature (447)..(447): n is a, c, g, or t
  modified_base (470)..(470): a, c, t, g, unknown or other
  misc_feature (470)..(470): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtncgccaggccccggacaaaggcttgagtggatgggatggatcgaacgctggcaatggtaaacacaaaaattcacagaagtccagggcagagtcaccttacagggacacatccgngagattactatatggagctgagcacgcctgagatccgaagacacggctgtatnttttgngcgtactntagtggacgtacattattaccgnttacgtaatttgacttccgtgggaccaggtaccctggtaccaccgtctccgtccg

SEQ ID NO: 260151 - DNA, 577 bp, Homo sapiens
  misc_feature: GYAE6OF01DHYAB.1.5.A05.1.454.CMB.1.raw
  modified_base (285)..(285): a, c, t, g, unknown or other
  misc_feature (285)..(285): n is a, c, g, or t
  modified_base (349)..(349): a, c, t, g, unknown or other
  misc_feature (349)..(349): n is a, c, g, or t
tcagacgagtgcgtcacgaccggtgctcgatttagatagatagacaggggacccaacaaccacatccctcctcagaagcccccagagcacaacgccccaccatggactggacctggaggatccttcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattggtgcgccacggaccccgganaaaggctgagtggagtgggagtggatcgaacgctggacaagtggtaaacaacaaaaaattcaanagaagttccgagggacagagtcaccttacaggacacatccgacgaggattacttatataggagacgtgacgacaagccgtagagacgtaccgaagacgacggcttagtactttagttttgtgtcgtaccgttgtagtagggagttacctagttacttacgtctacgtaactttgtaccgtccgtacggggtccaacgggtaccctacggtcctaccgtctccgtaccg

SEQ ID NO: 260152 - DNA, 622 bp, Homo sapiens
  misc_feature: GYAE6OF01CIIPB.1.5.A05.1.454.CMB.1.raw
  modified_base (316)..(316): a, c, t, g, unknown or other
  misc_feature (316)..(316): n is a, c, g, or t
tcagacgagtgcgtcacgaccggtgctcgatttagatagatagacagggggacccgaacaaccacatccctcctcagaagcccccagagccacaacgccccaccatggactggacctggaggatcctcttttggtggcagcagccacaggtgcccactcccaggtccagcttgtgcagtctggggctgaggtgaagagcctggggctcagtgagttcctgcaggcttcaggatacaccttcactaggtatgctatacattgggtagtcgccaggccccggacaaaggcttggacgtggagtgggatggatcaacgntggctaatggaacacaaaaattcaacagaactcagggcagacgtcgacctttacgagggacacgatccgacgtagattacttatagtggagtctagagcgaagcctagtacgagtccgaagtaccacgggtctacgtagttactttttaggcgtacgtaccgttacgttacggtacgggacggttacctagtttaacttaccggtccttacgtaacgttttccggtaccttccccggttacgggggtaccctaaacgggggtaccctaccgggttacccgtaacccggttccgtcccgtaccccgg

SEQ ID NO: 260153 - DNA, 600 bp, Homo sapiens
  misc_feature: GYAE6OF01BWZTO.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacgacgggcccccggaggacggggtcttggaggtggagtggggagtggatcgacggtacccgttaacggaaactaaaacgagaagtagtaggagagtaagttcgagggcagagtcatcatcgaccggcggacacactccgaacgtacgtacacgtacctaacagtacggaacgtggacggacgtcctacgagtactcgtacggaccgacgaccggacctacgtttacgttaccgtggaccgacgagtagtatttagtgaccgtacgttcggtcctggtccttacgtaacccgacgttcgttagggtcggcgtcggtcggggaaccccgg

SEQ ID NO: 260154 - DNA, 182 bp, Homo sapiens
  misc_feature: GYAE6OF01BIHOP.1.5.A05.1.454.CMB.1.raw
  modified_base (178)..(182): a, c, t, g, unknown or other
  misc_feature (178)..(182): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctcgatcgcgtctgagcgggctggcaaggcgcatagnnnnn

SEQ ID NO: 260155 - DNA, 539 bp, Homo sapiens
  misc_feature: GYAE6OF01EPU81.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactccccaggtccagcttgtgcagtctggggctgaggtgaagagcctggggcctcagtgaaggtttcctgcaaggcttcaggatacaccttcactaggtatgctatacattgggtgcgccaggccccggacaaaggcttgagtggatgggatggatcaacgctggcaagtggtaaacacaaaaaattcaacagaagttccagggcagagtcacctttacagggacacatccgcgaggattacttatatggagctagagcagcctgagataccgaagacacggctgtattattttgtgtcgtacctgtagtggagtcatttattacgtcttctaatttgacttccgtggggcccaacgggtaaccctcggtccaccgttcctcctcg

SEQ ID NO: 260156 - DNA, 776 bp, Homo sapiens
  misc_feature: GYAE6OF01BZ4G4.1.5.A05.1.454.CMB.1.raw
  modified_base (244)..(244): a, c, t, g, unknown or other
  misc_feature (244)..(244): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttnactaggtatgctatacattgggtgcgccacggccccggaacaaaggcttgaggtggagtgggagtggactcgaacgctggacaagtacggtaaacaacaaaaaacttcaacgaagaacgttaccgaaggggacaaggtagtacctaaccgtttaaccgaacgggtaaccaaccgtaacgtacccggacggtaacgggtaacgttttaacgtttaacgttaacgttagggtacgtacgttaggaacgtacgtaacggtacccgttagggaacggtacgtaacccggaaacgaaccggtaaccgggtacgttaacggtttaacgttttaagttttttacggtacggtacccggttaacccgttacggttaaggttacggggttacggttaacgttaacgttttaacgttaccgtaaccgtttacgttaaacgttttacggtacccgtttcccgggtacggggtaccccggtaaacggggttaacccccgttcgggtaccccgttaaccccggttcccgttccccgttaacccgg

SEQ ID NO: 260157 - DNA, 550 bp, Homo sapiens
  misc_feature: GYAE6OF01C2MML.1.5.A05.1.454.CMB.1.raw
  modified_base (282)..(282): a, c, t, g, unknown or other
  misc_feature (282)..(282): n is a, c, g, or t
  modified_base (395)..(395): a, c, t, g, unknown or other
  misc_feature (395)..(395): n is a, c, g, or t
  modified_base (415)..(415): a, c, t, g, unknown or other
  misc_feature (415)..(415): n is a, c, g, or t
  modified_base (442)..(442): a, c, t, g, unknown or other
  misc_feature (442)..(442): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggccccgganaaaggcttgagtggatgggatggatcaacgctggcaatggtaaacacaaaaaattcacaagaagttccagggcagagtcaactttacagggacacatcgcgaggattacttanatggagctgagcagcctganatccgaagacacggctgtatattttgngtcgacctctagtggagtcgtaattattacgcttactaatttacggacttcccgtaggggtacccaaggggtaaccccttggtacctacccggttctcccgtaacccg

SEQ ID NO: 260158 - DNA, 181 bp, Homo sapiens; identical to SEQ ID NO: 259842
  misc_feature: GYAE6OF01EPD88.1.5.A05.1.454.CMB.1.raw
  modified_base (178)..(181): a, c, t, g, unknown or other
  misc_feature (178)..(181): n is a, c, g, or t

SEQ ID NO: 260159 - DNA, 557 bp, Homo sapiens
  misc_feature: GYAE6OF01BAZ3K.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggataccaccttcactaggtatgctatacattgggtgcgccaggccccggacaaaggcttgagtggatgggatggatcaagctggcaatggtaacacaaaaattcaacagaagttccagggacagagtcaccttacagggacacatcgacgagattacttatatggagactgagcagcctagagactccgaagacacggactgtattagttttgtgcgtacctcgtagtggtaggtactattacttacgtcttactaatttgtaccgttcgtcggggaccctacggggtaaccccttaggtcccgtacccgtcctcccgtacccg

SEQ ID NO: 260160 - DNA, 601 bp, Homo sapiens
  misc_feature: GYAE6OF01CVC93.1.5.A05.1.454.CMB.1.raw
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
  modified_base (284)..(284): a, c, t, g, unknown or other
  misc_feature (284)..(284): n is a, c, g, or t
  modified_base (415)..(415): a, c, t, g, unknown or other
  misc_feature (415)..(415): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctnagtgaaggtttccngcaaggcttcaggatacaccttcactaggtatgctatacattgggtgcgccaggccccgganaaaggcttgagtggagtggatggatcaacgctggcaatggtaaacaacgaaaaaattcaacaagaagttccgaagggcaagagtacacctttacgagggactacacgtcgcgaggtattactatagtgagntgagtcagcctagagactacgaagtacgacggtactagttattagtttttgacgtacgtaccgttacgtagttacggtggtactagtttaactacggtacttacgtaagtttacgacgttccggtcggggacccttacggggtaacccccgttaggtacccgtacccggtcgttccccgttacccg

SEQ ID NO: 260161 - DNA, 637 bp, Homo sapiens
  misc_feature: GYAE6OF01BCT9W.1.5.A05.1.454.CMB.1.raw
tcagacgagtgcgtcacgaccggtgctcgatttagatagatagacaggggacccaacaaccacatccctcctcagaagcccccagagcacaaccgccccaccatggactggacctggaggatcctcttttggtggcagcagccacaggtgcccactcccaggtccagcttgtgcagtctggggctgaggtgaagaagcctggggcctcagtgaaggtttcctgcaaggcttcgaggataccaccttcactaggtatgactatacagttggtgcgcgacggcccggacaaaggcttggagtggatgggagttggatcgaacgctggacaagtaggtaacaacaaaaattcaacgaagaacgttaccaagggacaagacgtactaacctttaccgagggacacgaactccgacgagtattaacgttatagtggagactagacgacgacggcctaggacgtacgtaccggtaagaccgacggtcttagttaacgtttagttttacgtcgtacgtaccttacggttaaggtcggtaggtacttagttacgtttaccgtacttacgtaagtttacgtacgttcccggttagggtacccgtacgggtacccgtacggtaccctaccggttccgtccgtacccg

SEQ ID NO: 260162 - DNA, 631 bp, Homo sapiens
  misc_feature: GYAE6OF01DG2DG.1.5.A05.1.454.CMB.1.raw
  modified_base (342)..(342): a, c, t, g, unknown or other
  misc_feature (342)..(342): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtctggggctgaggtgaagagcctggggcctcagtgaaggtttcctgcaaggcttcaggatacaccttcactaggtatgctatactattgggtgcgccgaggccccggacaaacggcttgaggtggagtgggatggatcgaacgcgtggacaagtaggtaaacaanaaaaaattcaacagaagttccgagggacagagtcacctttacgaggacacatccgcgaggtattacttatatggagtcgtgacgcgacgcctagacgtactccgaaagtaccgacgggtctgttactttaagtttttgtcgtaccgtaaccgttcggttaacgttgggtacggtactaattttaacgttaccgtcttaacgttaaagttttccggacgttcccgggtacggggtacccgtaacggggtaacccttcggggtacctacccggttccgttcccgttacccg

SEQ ID NO: 260163 - DNA, 541 bp, Homo sapiens
  misc_feature: GYAE6OF01DFR14.1.5.A05.1.454.CMB.1.raw
  modified_base (447)..(447): a, c, t, g, unknown or other
  misc_feature (447)..(447): n is a, c, g, or t
  modified_base (457)..(457): a, c, t, g, unknown or other
  misc_feature (457)..(457): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatgggatggatcaacgctggcaatggtaaacacaaaaaaattcaacagaagttccagggacagagtcacctttaccagggacacatccgcgaggattacttatatggagctgagcagcctgagatccgaagacacggctgtatattttgngtcgtacctntagtggaggtctattattacgtctacgtaatttgacttccgtcggggccagggtaacccctgggtccaccggtcctcgtacccg

SEQ ID NO: 260164 - DNA, 255 bp, Homo sapiens
  misc_feature: GYAE6OF01C3B11.1.5.A05.1.454.CMB.1.raw
  modified_base (247)..(255): a, c, t, g, unknown or other
  misc_feature (247)..(255): n is a, c, g, or t
tcagacgagtgcgtcacgaccggtgctcgatttagatagatagacaggggcagttccagatttcaactgctcatcagcagcctgcagtctgaagattttgctagtttattactgtcagcagtataataactggcctcgacgttcggccaagggaccaaggtgaaatcaaacgaactgtggctgcaccatctgtcttcatctccgcatctgatcgtactgcgctgagcgggctggcaaggcgcatagnnnnnnnnn

SEQ ID NO: 260165 - DNA, 530 bp, Homo sapiens
  misc_feature: GYAE6OF01BRJSA.1.5.A05.1.454.CMB.1.raw
  modified_base (475)..(475): a, c, t, g, unknown or other
  misc_feature (475)..(475): n is a, c, g, or t
  modified_base (516)..(516): a, c, t, g, unknown or other
  misc_feature (516)..(516): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaagggcttcaggataccaccttcactaggtatgctatacattgggtgcgccaggccccggacaaaggcttgagtggatgggatggatcaacgctggcaatggtaacaacaaaaaattcaacagaagttcaggcagagtcaccttacagggtacacatccgcgagattactatatggagctgagcagcctgagatacgaagacacggctgttattattttgtgtcgtactctagtggagtctattattacgtntacgtatttgactcgtcgggccgacgggtaaccctggtacnccgtctccgtaccg

SEQ ID NO: 260166 - DNA, 259 bp, Homo sapiens
  misc_feature: GYAE6OF01DX030.1.5.A05.1.454.CMB.1.raw
  modified_base (247)..(247): a, c, t, g, unknown or other
  misc_feature (247)..(247): n is a, c, g, or t
  modified_base (254)..(259): a, c, t, g, unknown or other
  misc_feature (254)..(259): n is a, c, g, or t
tcagacgagtgcgtcacgaccggtgctcgatttagatagatagacaggggcagttccagatttcaactgctcatcagcagcctgcagtctgaagattttgctagtttattactgtcagcagtataataactggcctccgacgttcggccaagggaccaaggtggaaatcaaacgaactgtggctgcaccatctgtcttcatccttcccgccatctgatcgtactgcgctgagcgggctggcaaggcncgatagnnnnnn

SEQ ID NO: 260167 - DNA, 254 bp, Homo sapiens
  misc_feature: GYAE6OF01DSFHL.1.5.A05.1.454.CMB.1.raw
  modified_base (251)..(254): a, c, t, g, unknown or other
  misc_feature (251)..(254): n is a, c, g, or t
tcagacgagtgcgtcacgaccggtgctcgatttagatagatagacagggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatcctgagagtgcgtctctggagcggctggcaaggcgcatagnnnn

SEQ ID NO: 260168 - DNA, 179 bp, Homo sapiens; identical to SEQ ID NO: 259841
  misc_feature: GYAE6OF01C2RNC.1.5.A05.1.454.CMB.1.raw
  modified_base (178)..(179): a, c, t, g, unknown or other
  misc_feature (178)..(179): n is a, c, g, or t

SEQ ID NO: 260169 - DNA, 531 bp, Homo sapiens
  misc_feature: GYAE6OF01B37B7.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacacctttcactaggtatgctatacattgggtgcgccaggcccccggacaaaggcttgagtggatgggatggatcaacgctggcaatggtaacacaaaaaattcaacagaagttcagggcagagtcactttacaggacacatccgcgaggattacttatatgagctgagcagcctgagagtccgaagacacggctagttatattttgtgcgtactacgtagtggtagtctattagttacgctctaatttgactccgtgggccacgggtacctcggtacacccgtctccgtaccg

SEQ ID NO: 260170 - DNA, 566 bp, Homo sapiens
  misc_feature: GYAE6OF01BBZM1.1.5.A05.1.454.CMB.1.raw
  modified_base (220)..(220): a, c, t, g, unknown or other
  misc_feature (220)..(220): n is a, c, g, or t
  modified_base (457)..(457): a, c, t, g, unknown or other
  misc_feature (457)..(457): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagccgtggggcctcagtgaggtttccngcaaggcttcaggatacaccttcacgtaggtatgctatacattgggtgcgccaggccccggacaaacggcttgagtggatgggatggatcaacgctggcaagtggtaacaacaaaaattcaacagaagttccgagggcaggagtctacctttacgagggacacagtccgcgaggtattacttatatggagctgagcagtcctgagatccgaagacgacggtctagtattagttttgngtcgtacctcgttaggtggtagtcgtatttagttacgtacttacgtagtttagaccgttccgtacggggtccgaacgggtaccctggtacccaccgtcgtccgtacccg

SEQ ID NO: 260171 - DNA, 558 bp, Homo sapiens
  misc_feature: GYAE6OF01A19PV.1.5.A05.1.454.CMB.1.raw
  modified_base (453)..(453): a, c, t, g, unknown or other
  misc_feature (453)..(453): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggataccaccttcactaggtatgctatacattgggtgcgccaggccccggacaaaggcttgagtggatgggatggatcaacgctggcaatggtaacaacaaaaaattcaacagaagttccagggacagagtacacctttaccagggacacagtccgcgaggattacttatatggagctgagcagcctgagatccgaagacgacggctgtattatttttgngtccgtaccttgtacgtaggacgtcgtattattacgtctacgtaatttgacttccgtcggggaccctacggggtaacccttggtaccgacccgttgtccctaccg

SEQ ID NO: 260172 - DNA, 254 bp, Homo sapiens
  misc_feature: GYAE6OF01ANSL8.1.5.A05.1.454.CMB.1.raw
  modified_base (181)..(187): a, c, t, g, unknown or other
  misc_feature (181)..(187): n is a, c, g, or t
  modified_base (189)..(254): a, c, t, g, unknown or other
  misc_feature (189)..(254): n is a, c, g, or t
tcagacgagtgcgtcacgaccggtgctcgatttagatagatagacagggcaccggaagggcccatcggtcttccccctggcaccctcctccaagagcacctctggggcacagcggccctgggctgcctggtcaaggactacttcctctctcgactctgagcgggctggcaaggcgcatagnnnnnnncnnnnnnnnnnnnnnnnnnnnnnnnnnnnnnnnnnnnnnnnnnnnnnnnnnnnnnnnnnnnnnnnnn

SEQ ID NO: 260173 - DNA, 725 bp, Homo sapiens
  misc_feature: GYAE6OF01B7OE4.1.5.A05.1.454.CMB.1.raw
  modified_base (221)..(221): a, c, t, g, unknown or other
  misc_feature (221)..(221): n is a, c, g, or t
  modified_base (253)..(253): a, c, t, g, unknown or other
  misc_feature (253)..(253): n is a, c, g, or t
  modified_base (285)..(285): a, c, t, g, unknown or other
  misc_feature (285)..(285): n is a, c, g, or t
tcagacgagtgcgtcacgaccggtgctcgatttagatagatagacaggggacccaacaaccacatccctcctcagaacgcccccagagcacaacgccccaccatggactggacctggaggatcctcttttggtggcagcagccacaggtgcccactcccaggtccagcttgtgcagtctggggctgaggtgaagagcctggggcctcagtgaaggtttccngcaaggcttcaggatacacctttcactaggtntgctatacattgggtgcgccacggccccgganaaaggcttagaggtggagtgggatggatcgaacgcgtggacaagtagggtaaacaaactaaaaaaattcaaacaaggtaaacgtttaccgaagggtacaaggacgtacctaaccgtttaacccgaaggggaccaaccgtaacgtacccggacggtaacggttaactttaacgttaagttaacgtaggtacgtcgttagacggtacgtacgtcgtagaacgtacgtacggaacgacggaccgtacttagtttagtttagttttcggacgtaccgttaccggttacgttaagggttacgggtacgttacgttaagtttaacgtaccgttaccgttaaacgttaacgttttcgtacccgttcggggtacccggggaaccggttaacccgggttaacccggttcggttaaccccggtacccgtttcccgttccccgtaacccgg

SEQ ID NO: 260174 - DNA, 817 bp, Homo sapiens
  misc_feature: GYAE6OF01BUV7F.1.5.A05.1.454.CMB.1.raw
  modified_base (287)..(287): a, c, t, g, unknown or other
  misc_feature (287)..(287): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacagttgggtgcgccgacggccccgganaacggcttggagtggagtgggatggatcgaacgctaggacaagtaggtaaacaaactaaaaattcaacgaaggtaacgttaccgaagggacaaggacgtacctaacccgtttaaccgaacgggtaccaactacgtacccggacggtaacgggtaacttttaacgtttaagtacggttacgggtaacggtacgttaggtaacggtaccgtaaacgggtccccgttaaggaaccgggtaaccgttaaccccggggaaaaggtaccccgtaaccgggggttacctttaagggttttaaacgtttttacggtttttttacgggtacggtaccccgggtttaaacccgtttaccgggtttaaagggttacggggtacggtttaaccgttaacgttttaacggttaacccggtacctttaacgtttaaacgttttcggtaaccccgtttccgggtaccgggggtaaccccgtaaaccgggggttaacccccttcggggttaccccctacccggtttcccgttccccgttaacccgg

SEQ ID NO: 260175 - DNA, 742 bp, Homo sapiens
  misc_feature: GYAE6OF01BNV6F.1.5.A05.1.454.CMB.1.raw
  modified_base (273)..(273): a, c, t, g, unknown or other
  misc_feature (273)..(273): n is a, c, g, or t
tcagacgagtgcgtcacgaccggtgctcgatttagatagatagacaggggacccaacaaccacatccctcctcagaacgcccccagagcacaacgccccaccatggactggacctggaggatcctcttttggtggcagcagccacaggtgcccactcccaggtccagcttgtgcagtctggggctgaggtgaagaagccgtggggcctcgagtgaaggtttcctgcaaggcttcgaggatacaccttcactaggtatgactatacattgggtncgccgacggcccgacaaaggcttgagtggagtggatggatcgaacgcgtggacaagtaggtaaacaaactaaaaaagttacaacgtaaggaaacgtttacccgaaggggtaccaaggtaacgtaccgtaaaccgttttaacccgaacggggtaaccaaaccgtaacgttacccggaacggtaacgggtaactttaaccgtttaagttaagttacgggtaacggtaccgttaggaacgtcgaacggtcccgttaagaacggtaacgttacccggaaagacccgaacgggtacttaggttaatttacggttttttaggtacggtacccggtaacccgttacggttaaggttacgggtaacggttcgtaagtttagttacccggttacttacgttaagtttacggaccgttccggtcggggtacccgaacgggtacccgttcggtacccgtacccgttcttcccgtaacccg

SEQ ID NO: 260176 - DNA, 183 bp, Homo sapiens; identical to SEQ ID NO: 260080
  misc_feature: GYAE6OF01BQDLC.1.5.A05.1.454.CMB.1.raw
  modified_base (178)..(183): a, c, t, g, unknown or other
  misc_feature (178)..(183): n is a, c, g, or t

SEQ ID NO: 260177 - DNA, 180 bp, Homo sapiens
  misc_feature: GYAE6OF01D1OB9.1.5.A05.1.454.CMB.1.raw
  modified_base (178)..(180): a, c, t, g, unknown or other
  misc_feature (178)..(180): n is a, c, g, or t
tcagacgagtgcgtcacgaccggtgctcgatttagatagatagacaggcaccaagggcccatcggtcttcccctggcaccctcctccaagagcacctcgtggggcacagcggccctgggctgcctggtcaaggactacttcctcgtactgcgctgagcgggctggcaaggcgcatagnnn

SEQ ID NO: 260178 - DNA, 571 bp, Homo sapiens
  misc_feature: GYAE6OF01AFCB9.1.5.A05.1.454.CMB.1.raw
  modified_base (435)..(435): a, c, t, g, unknown or other
  misc_feature (435)..(435): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacacctttcactaggtatgctatacattgggtgcgccaggccccggacaaaggcttgagtggatgggatggatcgaacgctggcaatggtaacacaaaaaattcaacagaagttccagggcagagtacactttaccaggacacatccgcgagattacttatatggagctgagcacgcctgagactccgaagacgacggntagtattagtttttagtgtcgtaccttcgtaggttggtaggtctagttacttaccgtacttacgtaagtttcgaccgttccgtacggggacctaacggggtaccccgttaggtaccaccggttcctcccgtacccg

SEQ ID NO: 260179 - DNA, 599 bp, Homo sapiens
  misc_feature: GYAE6OF01ECL69.1.5.A05.1.454.CMB.1.raw
  modified_base (284)..(284): a, c, t, g, unknown or other
  misc_feature (284)..(284): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccacggccccgganaaggcttgagtggatgggatggatcgaacgctggacaataggtaaacaactaaaaaattcaacaagaagttccgagggtacaagagtactaacctttaccgagggacacatccgcgagtattactatatgagctgagcagcctagagactaccgaagacgacggtctagttattagtttttgagtaccgtaccttcgtaggtggacggttctaatttacgttacgtcttacgtaaagttttcgaccgttccggtacggggtaccccgtaacggggtaaccccgttcgggtaccctaccggttcctcccgtacccg

SEQ ID NO: 260180 - DNA, 520 bp, Homo sapiens
  misc_feature: GYAE6OF01AQ68L.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatgggatggatcaacgctggcaatggtaacacaaaaaattcaacagaagttccaagggcagagtcacctttacagggtacacatccgcgagattactatatggagctgagcagcctgagatccgaagacacgggctgtatatttgtgtcgactctagtggagtcattatacgctctaatttgactccgtgggccagggaccctggtaccaccgtctccgtccg

SEQ ID NO: 260181 - DNA, 256 bp, Homo sapiens; identical to SEQ ID NO: 260049
  misc_feature: GYAE6OF01B8A7F.1.5.A05.1.454.CMB.1.raw
  modified_base (251)..(256): a, c, t, g, unknown or other
  misc_feature (251)..(256): n is a, c, g, or t

SEQ ID NO: 260182 - DNA, 751 bp, Homo sapiens
  misc_feature: GYAE6OF01D4JFA.1.5.A05.1.454.CMB.1.raw
  modified_base (228)..(228): a, c, t, g, unknown or other
  misc_feature (228)..(228): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtcgcccactcccaggtccagtcttgtgcagtcgtggggctgaggtgaagagccgtggggcctcgagtggtaacgtttccngcaaggcttacgaggactaccaccttcaactaggtatgacctatactagttgggtcgccgaccgaccggaccccggaacgaaaggtcgttaggagtggaagtgggtagtaggatacgaacgctggacaagtaggaaacaataaaaaatcaacgaagtaacgttaccgaaggacgagtacgtctaaccttaccgagggaaccacacgtaccgacgaaggtattaacttaagtagtagggacgtacgtagacgacgacgtccgtaggtaagaccgtaccggaaacgtaccgaacggtcgttagttaagttttaacgtttttgggtacgttacccgggtaccgtttacggttaacgggttacgggtaggttaccgttaaagtttaaccgttaaccggttacctttaacgttaaaggttttacccgtaacccggttacccgggttaccgggggacccggttaaacccggggttaaccccgttaccgggttacccttaaccccggttccccgttccccgttaaacccg

SEQ ID NO: 260183 - DNA, 181 bp, Homo sapiens
  misc_feature: GYAE6OF01AY2SN.1.5.A05.1.454.CMB.1.raw
  modified_base (179)..(181): a, c, t, g, unknown or other
  misc_feature (179)..(181): n is a, c, g, or t
tcagacgagtgcgtcacgaccggtgctcgatttagatagatagacagggcaccaagggcccatcggtcttcccctggcaccctcctccaagagcacctcgtggggcacagcggccctgggctgcctggtcaaggactacttccacgcactcgtctgagcgggctggcaaggcgcatagnnn

SEQ ID NO: 260184 - DNA, 181 bp, Homo sapiens
  misc_feature: GYAE6OF01EA9GP.1.5.A05.1.454.CMB.1.raw
  modified_base (179)..(181): a, c, t, g, unknown or other
  misc_feature (179)..(181): n is a, c, g, or t
tcagacgagtgcgtcacgaccggtgctcgatttagatagatagacagggcaccaagggcccatcggtcttccccctggcaccctcctccaagagcacctctggggcacagcggccctgggctgcctggtcaaggactacttcctctctcgactctgagcgggctggcaaggcgcatagnnn

SEQ ID NO: 260185 - DNA, 584 bp, Homo sapiens
  misc_feature: GYAE6OF01C517U.1.5.A05.1.454.CMB.1.raw
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
  modified_base (410)..(410): a, c, t, g, unknown or other
  misc_feature (410)..(410): n is a, c, g, or t
  modified_base (416)..(416): a, c, t, g, unknown or other
  misc_feature (416)..(416): n is a, c, g, or t
  modified_base (431)..(431): a, c, t, g, unknown or other
  misc_feature (431)..(431): n is a, c, g, or t
  modified_base (445)..(445): a, c, t, g, unknown or other
  misc_feature (445)..(445): n is a, c, g, or t
tcagacgagtgcgtcacgaccggtgctcgatttagatagatagacagggacccaacaaccacatccctcctcagaacgccccagagcacaacgccccaccatggactggacctggaggatccttctttttggtggcagcagccacaggtgcccactcccaggtccagcttgtgcagtcgtggggctgaggtgaagagcctggggcctcgagtgaagtttccngcaaggctnagatacacttcactaggtatgctatacattgggtgcgccgacggccccggacgaaaggcttagagtggagtgggatggatcgaacgctggacaagtaggtaaacaacaaaaaattcaacagaagttccaagggcagagtcaacgttacagggtacacagtccgacgaggtactacttanatgganctgagcagctgaganacgaagtacacggntgtacttagtttgtcgtacgtaccgtgtagtggagtacgtattagttaccggattacgttaacgttagtacccgttccggttacgggtacccgtaacgggtaaccccgttggtaccctaccgttcccgtccgttacccg

SEQ ID NO: 260186 - DNA, 540 bp, Homo sapiens
  misc_feature: GYAE6OF01DWPNK.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatgggatggatcaacgctggcaatggtaaacacaaaaaatcacagaagttccagggcagagtcacctttacagggacacatccgcgaggattacttatatggagctgagcagcctgagatccgaagacacggctagtattattttgtcgcgtactcgtagtggtagtctattattacgtcttcgtaatttgacttccgtacggggcccaagggtacccctaggtaccaccgtctccgtaccg

SEQ ID NO: 260187 - DNA, 566 bp, Homo sapiens
  misc_feature: GYAE6OF01DJPJT.1.5.A05.1.454.CMB.1.raw
  modified_base (399)..(399): a, c, t, g, unknown or other
  misc_feature (399)..(399): n is a, c, g, or t
tcagacgagtgcgtcacgaccggtgctcgatttagatagatagacaggggacccaacaaccacatccctcctcagaagcccccagagcacaaccgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggccccggacaaaggcttgagtggatgggatggatcaacgctggcaatggtaacacaaaaattcaacagaagttcagggcagagtcaccttacagggacacatccgcgagattactatatagganctgagcgaagcctgagataccgaagaccgacggctagttatatttttgtcgtcgtacctcgttagtggagttctattagttacgcttactaatttggaccttccggtacggggtccctaacggggtaccccttcgggttacccgtaccggttccctcccgttacccg

SEQ ID NO: 260188 - DNA, 530 bp, Homo sapiens
  misc_feature: GYAE6OF01A4CX3.1.5.A05.1.454.CMB.1.raw
  modified_base (207)..(207): a, c, t, g, unknown or other
  misc_feature (207)..(207): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctnagtgaaggtttcctgcaaggcttcaggatacaccttcactaggtatgctatacattgggtgcgccaggccccggacaaaggcttgagtggatgggatggatcaacgctggcaatggtaacacaaaaattcacagaagttccagggcagagtcacctttacaggacacatccgcgaggattacttatatggagctgagcagcctgagataccgaagacgacggctgtattattttgtgtcgtactctagtggtaggtctattagttacgctcgtaatttgactccgtagggccagggtaccctggtaccaccgtctccgtaccg

SEQ ID NO: 260189 - DNA, 630 bp, Homo sapiens
  misc_feature: GYAE6OF01BYZZP.1.5.A05.1.454.CMB.1.raw
  modified_base (220)..(220): a, c, t, g, unknown or other
  misc_feature (220)..(220): n is a, c, g, or t
  modified_base (336)..(336): a, c, t, g, unknown or other
  misc_feature (336)..(336): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaggtttccngcaaggcttcaggatacaccttcactaggtatgactatacattgggtgcgccaggcccccggacgaaacggcttggagtgggatggggatggatcgaagcgtggcaatggtaacanaaaaattcaacagaagttccgaggcagagtcacctttaccgaggacacactccgacgaggattacttatatggagctgagcagccgtgagacgtaccggaaagaccgaacggccttagttactttaagttttttaggtcggtaccgtaccttaccgttaggttacgggacggttcgttaagtttacgtttaacgtaccttacgtaacgttttacggaccgtttccggttcggggacccgtaaccggggtaaccccttacggggtaccctacccggttccgtcccgttaccccgg

SEQ ID NO: 260190 - DNA, 548 bp, Homo sapiens
  misc_feature: GYAE6OF01A21EE.1.5.A05.1.454.CMB.1.raw
  modified_base (404)..(404): a, c, t, g, unknown or other
  misc_feature (404)..(404): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcgaggatacaccttcactaggtatgctatacattgggtgcgccaggccccggacaaaggcttgagtggatgggatggatcaacgctggcaatggtaaacacaaaaaattcaacagaagttccagggcagagtcacctttacagggacacatccgcgaggtattactatatgganctgagcagcctgagatcccgaagacgacggctgtatagttttgtgcgtacctctacgtggaggtctagttactacgtctacgtaatttgacgttccgtggggtcccgaagggtaaccctgggtacctacccggtctcccgtccg

SEQ ID NO: 260191 - DNA, 182 bp, Homo sapiens
  misc_feature: GYAE6OF01C4YNG.1.5.A05.1.454.CMB.1.raw
  modified_base (179)..(182): a, c, t, g, unknown or other
  misc_feature (179)..(182): n is a, c, g, or t
tcagacgagtgcgtcacgaccggtgctcgatttagatagatagacagggcaccaagggcccatcggtcttccccctggcaccctcctccaagagcacctctggggcacagcggccctgggctgcctggtcaaggactacttcctctctcgactctgagcgggctggcaaggcgcatagnnnn

SEQ ID NO: 260192 - DNA, 627 bp, Homo sapiens
  misc_feature: GYAE6OF01C8AJ7.1.5.A05.1.454.CMB.1.raw
  modified_base (223)..(223): a, c, t, g, unknown or other
  misc_feature (223)..(223): n is a, c, g, or t
tcagacgagtgcgtcacgaccggtgctcgatttagatagatagacaggggacccaacaaccacatccctcctcagaacgcccccagagcacaacgccccaccatggactggacctggaggatccttcttttggtggcagcagccacaggtgcccactcccaggtccagcttgtgcagtctggggctgaggtgaagaagcctggggcctcagtgaaggtttccngcaaggcttcaggatacaccttcactaggtatgctatacatttgggtgcgccaggccccggacaaaggcttgagtggatgggatggatcgaacgctggcaatcggtaaacaacaaaaaaagttcaacaagaacgttaccagggacaggagtaccacctttaaccaaggggtaccaacgactaccgcgacgggtaatttacgttaactagttcgggtaagcttaggacgtacaacgcccgttagacgaacgtacccgaaggacccaacgggcttaggttaattaagtttttggacgtcgttaaccttgtaacggttggacgttctaattacgtacgtctatactttcgtacttccggacgggccgtaccggtacccgttacggtccctaccgtcctccgtaaccg

SEQ ID NO: 260193 - DNA, 732 bp, Homo sapiens
  misc_feature: GYAE6OF01EIJSY.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagccgtggggcctcagtgaaggtttcctgcaaggcttcgaggatacaccttcactaggtatgctatacattgggtgcgccgacggccccggacaaacggcttgagtggagtggggatggatcgaacgcgtggactaagtaggtaaacaactaaaaaattcaacagtaacgttccgagggcaagagtactaacctttaaccgacgggacaccacgtcccgacgtacggtaactttaacgttagtaacgtagggagtacgtaggaacgtcgacggtcccgtaggaacgtacgtaccgaacgaccgacggtacttagttaatttagttttttcggtacgtaccgttacccgttaccgttagggttacgggtaacgggtttcctaaagttttaaccgtttaccggtacgtttacgttaaacgtttttcggtaacccgtttccgggttaaccggggggtaaccccggtaaaaccgggggttaccccgtaacccggggttacccccgttaaccccggtttccccgttaccccgttaaccccggg

SEQ ID NO: 260194 - DNA, 537 bp, Homo sapiens
  misc_feature: GYAE6OF01ENTJA.1.5.A05.1.454.CMB.1.raw
  modified_base (245)..(245): a, c, t, g, unknown or other
  misc_feature (245)..(245): n is a, c, g, or t
  modified_base (412)..(412): a, c, t, g, unknown or other
  misc_feature (412)..(412): n is a, c, g, or t
  modified_base (417)..(417): a, c, t, g, unknown or other
  misc_feature (417)..(417): n is a, c, g, or t
  modified_base (460)..(460): a, c, t, g, unknown or other
  misc_feature (460)..(460): n is a, c, g, or t
  modified_base (482)..(482): a, c, t, g, unknown or other
  misc_feature (482)..(482): n is a, c, g, or t
  modified_base (493)..(493): a, c, t, g, unknown or other
  misc_feature (493)..(493): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaagggcttcaggatacaccttnactaggtatgctatacattgggtgcgccaggccccggacaaaggcttgaggtggatggggatgggatcgaacgctgggcaatggtaaacacaaaaaagttcaacagaaagttccagggcagagtcacctttaccagggacacatccgcgagattacttatactgganctgancagcctgagatccgaagacaggctgtatattttgtgcgtactntagtgaggtctaattattacgnttctaagtttnacttccgtgggcccagggtaccctggtacaccgtctccgtaccg

SEQ ID NO: 260195 - DNA, 552 bp, Homo sapiens
  misc_feature: GYAE6OF01A45OT.1.5.A05.1.454.CMB.1.raw
  modified_base (450)..(450): a, c, t, g, unknown or other
  misc_feature (450)..(450): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatgggatggatcaacgctggcaagtggtaacaacaaaaaattcaacagaagtccagggcagagtcacctttaccagggacacatccgcgaggattacttatatggagctgagcagcctgagatccgaagacacggctgttattagtttttgngtccgtaccttcgtagtggaggtctattattacgtactctaatttgacttccgtggggacccacggggtaacccctgggtacccaccgttcctccgtacccg

SEQ ID NO: 260196 - DNA, 542 bp, Homo sapiens
  misc_feature: GYAE6OF01E0P4H.1.5.A05.1.454.CMB.1.raw
  modified_base (142)..(142): a, c, t, g, unknown or other
  misc_feature (142)..(142): n is a, c, g, or t
  modified_base (231)..(231): a, c, t, g, unknown or other
  misc_feature (231)..(231): n is a, c, g, or t
  modified_base (416)..(416): a, c, t, g, unknown or other
  misc_feature (416)..(416): n is a, c, g, or t
tcagacgagtgcgtcacgaccggtgctcgatttagatagatagacagggggtacccgaacaaccacactccctccctcagaacgcccccagacgcacaaccgccccaaccatggactggacctggaggatcctctttttggnggcagcagccacaggtgcccactcccaggtccagcttgtgcagtctggggctgaggtgaagagcctggggcctcagtcgaaggtttccngcaaggcttcaggatacaccttcactaggtatgctatacattgggtgcgccaggccccggacaaaggcttgagtggatggggatggatcaacgctggcaatggtaacaacgaaaaaatcaacagaagttccagggcagagtcacctttacgagggacacgatccgacgaggattactatagtgangtgagtcgagcctgagacgtccgaagacacggctagtattattttgagtcgactgtagtggagtcagttatcgctcgtaattgactcgtgggccacgggtaccctggtaccaccgtcctcgtaccg

SEQ ID NO: 260197 - DNA, 591 bp, Homo sapiens
  misc_feature: GYAE6OF01C2SN4.1.5.A05.1.454.CMB.1.raw
  modified_base (223)..(223): a, c, t, g, unknown or other
  misc_feature (223)..(223): n is a, c, g, or t
  modified_base (287)..(287): a, c, t, g, unknown or other
  misc_feature (287)..(287): n is a, c, g, or t
  modified_base (459)..(459): a, c, t, g, unknown or other
  misc_feature (459)..(459): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtctggggctgaggtgaagaagcctggggcctcagtgaaggtttccngcaaggcttcaggatacaccttcactaggtatgctatacattgggtgcgccgacggccccgganaaaggcttgagtggatgggatggatcaacgctggcaaagtggtaaacaacgaaaaaaattcaacaagaagttaccgaaggggacaagagtactaaccgtttacgaacgggacacagtccgacgaaggtattaacttatagtaggacgctgagcagcctagagactaccgaanacgacgctagtattagttttgtcgtcgtaccttcgtagtggtaggtactagttacttactctactaagtttgacttccgtacggggcccgtaacgggtaaccctacgggtaccacccggttctcccgtaccg

SEQ ID NO: 260198 - DNA, 562 bp, Homo sapiens
  misc_feature: GYAE6OF01B1A44.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggccccggacaaaggcttgagtggatgggatggatcgaacgctggcaatggtaacaacaaaaaattcaacagaagttccagggcagagtcacctttacagggacacatccgcgaggtattacttatatggagctgagcagcctgagactccgaagaccgacggctgtattagtttttgtgtccgtaccgtctaggtggagttctagtttatacgtcgttactaatttgaccgttccgtagggggcccacggggtacccctgggttaccctaccggtccttccctacccg

SEQ ID NO: 260199 - DNA, 768 bp, Homo sapiens
  misc_feature: GYAE6OF01BAGZT.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagccgtggggcctcagtgaaggtttcctgcaaggcttcaggatacaccttcactaggtatgctatactagttgggtgccgccgacggccccggagaaaggcgttgaggtggagtgggatggatcgaacgcgtggactaagtacggaaacaaacgaaaaaattcaacgaaggtaacgttaccgaagggacaacggtacgtacctaacccgtttaaccgaacgggaacctaaccgaacgtacccggacggtaacgggttaactttaacgtttaacgttaagtagggtaaggtcgttaggaacggtaccgtaacggccgttacgggaacgtaccgtaacccggaacggtaacccgtaaccgggtactttacggttaacttttaacggtttttttcggtacggttacccgtaaccgtttacgttagggttacgggtacgttacgttaacgtttaacgttaaccgttccgttaacgttaaacgttttaccggtaacccgttccgggtacggggtaccccgtaaaccggggttaccccgttacgggttaccctacccggttccccgttcccgtaacccg

SEQ ID NO: 260200 - DNA, 254 bp, Homo sapiens
  misc_feature: GYAE6OF01DW409.1.5.A05.1.454.CMB.1.raw
  modified_base (223)..(223): a, c, t, g, unknown or other
  misc_feature (223)..(223): n is a, c, g, or t
  modified_base (250)..(254): a, c, t, g, unknown or other
  misc_feature (250)..(254): n is a, c, g, or t
tcagacgagtgcgtcacgaccggtgctcgatttagatagatagacaggggcagttccagatttcaactgctcatcagcagcctgcagtctgaagtattttgctagttttattactgtcagcagtataatactggcctcgacgttcggccaagggaccaaggtgaaatcaaacgactgtggctgcacatctgtcttcatccttcccgcatctgatcgtactgcnctgagcgggctggcaaaggcgcatagnnnnn

SEQ ID NO: 260201 - DNA, 584 bp, Homo sapiens
  misc_feature: GYAE6OF01D1783.1.5.A05.1.454.CMB.1.raw
  modified_base (471)..(471): a, c, t, g, unknown or other
  misc_feature (471)..(471): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcgagtgaaggtttcctgcaaggcttcaggatacaccttcactaggtatgctatacattgggtgcgccaggccccggacaaaggctgagtggatgggatggatcaacgctggcaagtggtaaacacgaaaaaaattcaacgaagaagttaccaagggcaggagtacgaacctttaacgagggtacacatccgcgaggattactatatggagctagagcagccgtgagacgtaccgaagtacgacggactagtattaagtttttgnggtccgtacgttcgttaggtggtaggtcagtttacgttacgcttacgtaatttacgacttccggtgggtacccgaacgggtaaccctggtaccgtacccgtcgtccgtacccg

SEQ ID NO: 260202 - DNA, 217 bp, Homo sapiens
  misc_feature: GYAE6OF01EXKVT.1.5.A05.1.454.CMB.1.raw
  modified_base (167)..(167): a, c, t, g, unknown or other
  misc_feature (167)..(167): n is a, c, g, or t
  modified_base (172)..(217): a, c, t, g, unknown or other
  misc_feature (172)..(217): n is a, c, g, or t
tcagacgagtgcgtcacgaccggtgctcgatttagatagatagacaggcaccaagggcccatcggtcttcccctggcaccctcctccaagagcacctctggggcacagcggcctggctgcctggtcaaggactacttcctcgtactgcgctgagcggctggcaggcncatgnnnnnnnnnnnnnnnnnnnnnnnnnnnnnnnnnnnnnnnnnnnnnn

SEQ ID NO: 260203 - DNA, 667 bp, Homo sapiens
  misc_feature: GYAE6OF01AII12.1.5.A05.1.454.CMB.1.raw
  modified_base (283)..(283): a, c, t, g, unknown or other
  misc_feature (283)..(283): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgcacggccccgganaaggcttggagtggatgggatggatcgacgctggcaatggtaaacacaaaaattcaacagaagttccgagggcagtagtctacctttaccgagggaccacgacgttccggcgtacgggtatttaccgttatagtgggacgtctaggacgcgacgtccgtggaacgtacgtaccggaacgaccgacggtcttagtaattttacgtttttaggcgtaccgttaccttacgttaaggttcgggtaacggtttctaacgttttacgttaacccggtctttaaccgttaacgttttacggaacccgtttcccgggtacgggggtaccccgtaacggggtaacccccgttgggttaacccgtaccccgtttccgttccccgttaacccgg

SEQ ID NO: 260204 - DNA, 545 bp, Homo sapiens
  misc_feature: GYAE6OF01DJZG0.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatgggatggatcaacgctggcaatggtaaacacaaaaaattcaacagaagttccagggcagagtcacctttaccagggacacatccgcgaggattacttatatggagctgagcagcctgagatccgaagacacggctgttatatttttgtcgtcgtacctcgtagtggaggtcatttactacgtctactaatttgacttccgtggggcccacggggtaaccctcgggtaccaccgtctcccgtacccg

SEQ ID NO: 260205 - DNA, 779 bp, Homo sapiens
  misc_feature: GYAE6OF01ELPQL.1.5.A05.1.454.CMB.1.raw
  modified_base (214)..(214): a, c, t, g, unknown or other
  misc_feature (214)..(214): n is a, c, g, or t
  modified_base (226)..(226): a, c, t, g, unknown or other
  misc_feature (226)..(226): n is a, c, g, or t
  modified_base (295)..(295): a, c, t, g, unknown or other
  misc_feature (295)..(295): n is a, c, g, or t
tcagacgagtgcgtcacgaccggtgctcgatttagatagatagacaggggacccaacaaccacatccctcctcagaacgcccccagagcacaaccgccccaccatggactggaccgtggaggatccttctttttggtggcagcagccacaggtcgcccactcccaggtccagcttgtgcagtcgtgggctggaggtgaagagccgtggggcctnagtgagtttccngcaggcttcgagactacaccttcacgtagtatgactatactagttgggtgcgccgacggaccccggaanaaacggcttaggagtggagtgggatggatcgaacgcgtggctaagtaggtaacaactaaaaattcaactaagaacgttccgagggcaaggacgtacgtaaccgtttaccggaacgggtaaccacgtaaccgtccggacgtaacgggtaactttaaccgtttaagtaaggtacgggtacgtaccgttaggaacgacgtaacggtaccttacgggtaacgtaaccgttaacccgggtaacgtaaccggtaccggggtaaccttagggttttaaggtttacgttttttacggtcggtaaccccgtttaccgttacggtttacggggtcgggttaaacggttacgttaaacgtttaccgtttaacggtaaccctttaacggttaaacgttttacccggtaccgttaccgggtaccggggtaccccgtaaaccggggttaccccgttacggttacccggtacccgtttcccgtaccccgttaacccggg

SEQ ID NO: 260206 - DNA, 591 bp, Homo sapiens
  misc_feature: GYAE6OF01CT3YK.1.5.A05.1.454.CMB.1.raw
  modified_base (252)..(252): a, c, t, g, unknown or other
  misc_feature (252)..(252): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtntgctatacattgggtgcgccaggccccggacaaaggctgagtggagtgggatggatcgaacgctggcaatggtaaacaacaaaaaattcaacagaagttaccagggcagagtacaccgtttaccagggacacgactcgacgaggattacttagtagtggagactggagcgacgcctggaagactaccggaagaccgacgggcttagttattatttttggtcgtacgtacctgtagtaggtagtactagttacgttacgcttacgtaagtttgaaccgttccggttacggggaccctaacggggtaaccccttggtaccctaccggtccctccgtacccg

SEQ ID NO: 260207 - DNA, 232 bp, Homo sapiens
  misc_feature: GYAE6OF01C167K.1.5.A05.1.454.CMB.1.raw
  modified_base (160)..(160): a, c, t, g, unknown or other
  misc_feature (160)..(160): n is a, c, g, or t
  modified_base (179)..(179): a, c, t, g, unknown or other
  misc_feature (179)..(179): n is a, c, g, or t
  modified_base (185)..(232): a, c, t, g, unknown or other
  misc_feature (185)..(232): n is a, c, g, or t
tcagacgagtgcgtcacgaccggtgctcgatttagatagatagacagggcaccgaagggcccatcggtcttccccctggccaccctcctccaagagcacctcgtggggcaccaggccggccctgggctgcctggtcaaggactacttcagtactctatcngagcgggctggacaaggcnatagcnnnnnnnnnnnnnnnnnnnnnnnnnnnnnnnnnnnnnnnnnnnnnnnn

SEQ ID NO: 260208 - DNA, 180 bp, Homo sapiens; identical to SEQ ID NO: 259970
  misc_feature: GYAE6OF01AYBRE.1.5.A05.1.454.CMB.1.raw
  modified_base (178)..(180): a, c, t, g, unknown or other
  misc_feature (178)..(180): n is a, c, g, or t

SEQ ID NO: 260209 - DNA, 564 bp, Homo sapiens
  misc_feature: GYAE6OF01CTP9U.1.5.A05.1.454.CMB.1.raw
  modified_base (388)..(388): a, c, t, g, unknown or other
  misc_feature (388)..(388): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgcaggccccggacaaaggcttgagtggatgggatggatcaacgctggcaatggtaacgacaaaaaattcaacagaagttccagggcagacgtacacctttaccagggacacactccgngacggattaacttatatggagctgagcagcctgagataccgaagacgacggctacgttattagtttttggtgtcgtaccttcgttacgtggtaggtctagtttattacgtcttacgtaactttgaaccttccggtcggggtcaacgggtaccctcggtcacccgtctcccgtaccg

SEQ ID NO: 260210 - DNA, 603 bp, Homo sapiens
  misc_feature: GYAE6OF01BANS3.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccacggccccggacaaaggcttgagtggagtgggatggatcaacgctggcaatggtaaacacaaaaaattcaacagaagttccagggcagagtcacttacagggtacacatccgtgaggtattacttatatggagcgtagagtcgagcctagacgacgtaccgaagacgacggtctagttagtttagtttttgcgtacgtaccttacgtagtcggtagttactagtttagttaccgtacgttactaagttttacgaccgtttccgtacgggggaccccgtaacggggtaccccgttacgggtaccctacccggttccgttcccgtaacccgg

SEQ ID NO: 260211 - DNA, 849 bp, Homo sapiens
  misc_feature: GYAE6OF01D3O2T.1.5.A05.1.454.CMB.1.raw
  modified_base (225)..(225): a, c, t, g, unknown or other
  misc_feature (225)..(225): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtcgtggggctgaggtgaagaagccgtggggcctcgagtgaaggtttccngcaaggcttcgaggataccaccttcacgtaggtatgctatacattgggtgccgccgacggccccggacgaaacggcttggagtggagtgggagtggactcgaacgcgtaggactaagtacggtaaactaaactaaaaaaacttccgaaacgaacggtaaacgttacccggtaacggggaccgtaacggtaacgttacccttaacccgtttaaacccggaaacggggtaacccaaacccgtaacggtaccccggacggtaacgggttaacttttaaaccgttaagttaacgttagggaacgtaccgttaggaacgtaccgtaaggtacccgtacggtaacgtaaccgtaacccggtaaagacccggtaacggttacgttacggtttaagtttacgttttttacgggacgttacccggttaaaccctttacgggttaagggttcggtaagggttaccttaaacggtttttacgttaacccggttaccgttaaacgtttaaacggttttaccgaaccccggtttcccgggtaaccgggggtaaccccgttaaaccgggggtaaccccccgttttacggggtaccccgtttaaccccggtttccccggtaccccgtttaaacccccgg

SEQ ID NO: 260212 - DNA, 651 bp, Homo sapiens
  misc_feature: GYAE6OF01CWHLB.1.5.A05.1.454.CMB.1.raw
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
  modified_base (453)..(453): a, c, t, g, unknown or other
  misc_feature (453)..(453): n is a, c, g, or t
  modified_base (473)..(473): a, c, t, g, unknown or other
  misc_feature (473)..(473): n is a, c, g, or t
tcagacgagtgcgtcacgaccggtgctcgatttagatagatagacaggggacccaacaaccacatccctcctcagaagcccccagagcacaaccgccccaccatggactggacctggaggatcctctttttggtggcagcagccacaggtgcccactcccaggtccagcttgtgcagtctggggctgaggtgaagagcctggggcctnagtgaaggtttccngcaaggcttcaggatacacttcactaggtatgctatacattgggtgcgccgacggccccggacgaaaggcttggagtggaatggggatggatcaagcgtggcaagtaggaaacaaactaaaaaattcaacgaagaaagttccaagggcaagagtcaacctttacgagggacactaagtcccgacgaaggtacttaacttatattggagtcgtagagacagccgtagaaganaccggaagaacgaccgggtnttagtaatttagtttttaggcgtaccgtaacttccgtaagggttcggaaggttaccgtaaagtttacgttaaccggtcttaaccgtaaattttacggaaccttcccgggttacggggacccgtaaaccggggtaaccccgttcggttaacccgacccggttcccttcccgtaaccccg

SEQ ID NO: 260213 - DNA, 878 bp, Homo sapiens
  misc_feature: GYAE6OF01DAZB2.1.5.A05.1.454.CMB.1.raw
  modified_base (137)..(137): a, c, t, g, unknown or other
  misc_feature (137)..(137): n is a, c, g, or t
  modified_base (257)..(257): a, c, t, g, unknown or other
  misc_feature (257)..(257): n is a, c, g, or t
tcagacgagtgcgtcacgaccggtgctcgatttagatagatagacaggggacccaacaaccacatccctcctcagaacgcccccagagcacaaccgccccaccatggactggacctggaggactccttcgttttggnggcagcacgaccagtacggtccacccacctaccgacggtaccgacgtcgttgtcgacgtagtcggtgggctaggaggtagaagacggtccggtcgggcctagtagtacggttacgttcgngacgagtctagagtactacctactacacgtagtatgtactatacgtggttggcgaccgaccggacccggacccggaaagtacggtcgttaggacggtaggtaggtaggtacgtacggtaacctaccgaacggtcggtaaccggtaaacgtaaacgggttaaaccgaaaaacctaaaaaacttaaaacgttcccgaaaaggttaacggttaaacccggttcggggaaacgggtaaccgtaaacggttaaccccgttaaaccccgtttaacccggtaaacggggtaacgaaacccgtaacgtaccgggtaacccggtaagggttaacgtttaacttttaacgtaaggtacggggtacgaccgttacggtaaggaaccgtacggtaacgtcggtaaacggtaccggtaaaccgtaacccgggaagacccggtacggttgtttaagtttaacgtttttcgttaccggaccgtaaccgtttacgttagggtagggttacgggtaccctttaagttaacgttaaccgttccgtaatttaaccgttaacgttccggaacccggttccggggaacccggtaacggtaaccccgtcggttaccgaccccgttccgtacccttccgacccg

SEQ ID NO: 260214 - DNA, 192 bp, Homo sapiens
  misc_feature: GYAE6OF01BSIJ1.1.5.A05.1.454.CMB.1.raw
  modified_base (178)..(192): a, c, t, g, unknown or other
  misc_feature (178)..(192): n is a, c, g, or t
tcagacgagtgcgtcacgaccggtgctcgatttagatagatagacagggcaccaagggcccatcggtcttccccctggcaccctcctccaagagcacctctggggcacagcggccctgggctgcctggtcaaggctacttcctcgtactgcgctgagcgggctggcaaggcgcatagnnnnnnnnnnnnnnn

SEQ ID NO: 260215 - DNA, 783 bp, Homo sapiens
  misc_feature: GYAE6OF01A5TDS.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccacggccccggacaaaggcttggagtggatgggatggatcgaacgctggcaagtggtaaacaacaaaaaattcaaccaagtaaacgttccgaaggggtaccaaggtaacggttaccaaaccgttttaacccaagggggtaacctaaccgaacgttacccggaaccggaagggtaacttttaaccgttaagttaaagtacggggtaacgtaccgtttaggaacggtaccgtaacggtaccccgttagaacggtaacgttaccccgaaaggtaacccgacgggtaccttaggttaagttttaagtttttacggttaggttacccgtaacccgttccggtttaaggttacggggtacggttacctaagttttaaccggttaacccgttcttaaccgttaaaatttttccgggaacccgtttcccggtacggggggttaacccccgaaacggggttaaacccccgttccgggggttaacccgttacccgggttccccgttcccgttaaaccccggg

SEQ ID NO: 260216 - DNA, 540 bp, Homo sapiens
  misc_feature: GYAE6OF01BI0Y4.1.5.A05.1.454.CMB.1.raw
  modified_base (444)..(444): a, c, t, g, unknown or other
  misc_feature (444)..(444): n is a, c, g, or t
  modified_base (495)..(495): a, c, t, g, unknown or other
  misc_feature (495)..(495): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatgggatggatcaagctggcaatggtaaacacaaaaaattcaacagaagttcagggcagagtcacctttacagggacacatccgcgaggattactatatggagctgagcagcctgaagataccgaagacacggctgtatatttttgngtcgtacctcgtagtggagtctattattacgacttctaatttgacttccgnggggtccacggggtaccctcgggtacaacccggtctcccgtaccg

SEQ ID NO: 260217 - DNA, 544 bp, Homo sapiens
  misc_feature: GYAE6OF01E0J2N.1.5.A05.1.454.CMB.1.raw
  modified_base (382)..(382): a, c, t, g, unknown or other
  misc_feature (382)..(382): n is a, c, g, or t
  modified_base (400)..(400): a, c, t, g, unknown or other
  misc_feature (400)..(400): n is a, c, g, or t
  modified_base (444)..(444): a, c, t, g, unknown or other
  misc_feature (444)..(444): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggccccggacaaaggcttgagtggatgggatggatcaacgctggcaatggtaacacaaaaattcaacagaagttccagggcagagtcacctttacagggacacatccgngaggattactatatgganctgagcagcctgagtatccgaagacacggctggtattattttgngtcgtaccttctaaggtggaggtcagttattacgcttcgtaatttgactccgttaggggcccacggggtaacccttgggtaccaccgttcctcccgtccg

SEQ ID NO: 260218 - DNA, 554 bp, Homo sapiens
  misc_feature: GYAE6OF01AH9J1.1.5.A05.1.454.CMB.1.raw
  modified_base (400)..(400): a, c, t, g, unknown or other
  misc_feature (400)..(400): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgagagcctggggcctcagtgaaggtttcctgcaaggcttcaggataccaccttcactaggtatgctatacattgggtgcgccaggccccggacaaaggcttgagtggatgggatggatcaacgctggcaatggtaacaacaaaaattcacagaagttccagggcagagtcacctttacagggacacatccgcgagattactatatggagntgagcagcctggagataccgaagacgacggctgtattattttgtgcgtacctcgttagtggaggtctagttattaccgtctacgtaatttgacttcccggtcggggtacccaacggggtaacccttcggtacccaccggttccgtcccgtaccg

SEQ ID NO: 260219 - DNA, 581 bp, Homo sapiens
  misc_feature: GYAE6OF01DABP8.1.5.A05.1.454.CMB.1.raw
  modified_base (220)..(220): a, c, t, g, unknown or other
  misc_feature (220)..(220): n is a, c, g, or t
  modified_base (284)..(284): a, c, t, g, unknown or other
  misc_feature (284)..(284): n is a, c, g, or t
  modified_base (432)..(432): a, c, t, g, unknown or other
  misc_feature (432)..(432): n is a, c, g, or t
  modified_base (486)..(486): a, c, t, g, unknown or other
  misc_feature (486)..(486): n is a, c, g, or t
  modified_base (509)..(509): a, c, t, g, unknown or other
  misc_feature (509)..(509): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttccngcaaggtcttcaggatacaccttcactaggtatgctatacattgggtgcgccacggccccgganaaacggcttgagtggagtggatggatcgaacgctggcaatgggtaaacaactaaaaaattcgaacaagaacgttaccgaaggggacaagacgtcaacctttaaccgaagggactaacacgtaccgcgaaggtattaacttatatggangtgagcagcctagactacgtaccgaagaccacggctaggttattagtttttagngtccgtactcgttagtgacggtntattagtacgtctactaagttagacttcgtaggggaccctaggggtacccctggtccaaccgtctcctaccg

SEQ ID NO: 260220 - DNA, 564 bp, Homo sapiens
  misc_feature: GYAE6OF01B21ET.1.5.A05.1.454.CMB.1.raw
  modified_base (282)..(282): a, c, t, g, unknown or other
  misc_feature (282)..(282): n is a, c, g, or t
  modified_base (409)..(409): a, c, t, g, unknown or other
  misc_feature (409)..(409): n is a, c, g, or t
  modified_base (456)..(456): a, c, t, g, unknown or other
  misc_feature (456)..(456): n is a, c, g, or t
tcagacgagtgcgtcacgaccggtgctcgatttagatagatagacaggggacccaacaaccacatccctcctcagaagcccccagagcacaacgccccaccatggactggacctggagatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggccccgganaaaggcttgagtggatgggatggatcgaacgctggcaatggtaacaacaaaaaattcaacagaagttccgagggcaagagtcactttaccgagggacacagtccgacgaggattaactatagtgganctgagcagcctgagataccgaagacgacgctgttattatttttcggngtaccgtacttcgttagtggaggttctaatttagttacgtctacgtaagtttgaccgttccgtggggaccctagggtaccccttggtacccaccgttctcccgtaccg

SEQ ID NO: 260221 - DNA, 784 bp, Homo sapiens
  misc_feature: GYAE6OF01CLCU1.1.5.A05.1.454.CMB.1.raw
  modified_base (273)..(273): a, c, t, g, unknown or other
  misc_feature (273)..(273): n is a, c, g, or t
  modified_base (288)..(288): a, c, t, g, unknown or other
  misc_feature (288)..(288): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtctggggctgaggtgaagagcctggggcctcagtgtaaggtttcctgcaaggcttcgaggataccaccttcacgtaggtatgctatacattgggtncgccaggccccgganaaaggcttgagtggagtgggatggatcaacgctggacaagtaggtaaacaacgaaaaaattcaacgagaaacgttccaagggacaggtacgtacgaaccctttaaccgaagggtaaccaacgacgttacccggacggtaggtaactttaaccgttaagttagttagggacgtcgttaggaacgacgtacgtcccgttaggaagtacgttacccgaaaggaacccgtacgggtacttaggtttaacgtttaatttttttcgggacggttacccggtaaccgtttcggttaacgggtttcgggttaacgggtacgtttaaagttttaacgtttaaacccgggtactttaaccgtttaaacggttttaccggttaacccgtttccccggggttagggggggttaaccccccgtaaacggggggtttaaacccccccgttacgggggttacccccggtaaacccccgggtttccccgtttccccccggttaaacccccgg

SEQ ID NO: 260222 - DNA, 562 bp, Homo sapiens
  misc_feature: GYAE6OF01D8QWE.1.5.A05.1.454.CMB.1.raw
  modified_base (463)..(463): a, c, t, g, unknown or other
  misc_feature (463)..(463): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggataccaccttcactaggtatgctatacattgggtgcgccaggccccggacaaaggcttgagtggatggggatggatcgaacgctggcaagtggtaaacaactaaaaaattcaacagaagttccaagggcagagtcacctttaccgagggacacatccgacgaggtattacttaatatggatcgtagagacagcctgagactccgaagaccgaggctgtattagttttgngtacgtaccttgtagtggagttctattactacgtctacgtaagtttgacttccggtacgggccgaacgggtacccttggcccgtaccgtctccgtaccg

SEQ ID NO: 260223 - DNA, 666 bp, Homo sapiens
  misc_feature: GYAE6OF01D88XV.1.5.A05.1.454.CMB.1.raw
  modified_base (287)..(287): a, c, t, g, unknown or other
  misc_feature (287)..(287): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtctggggctgaggtgaagagcctggggcctcagtgaaggtttcctgcaaggcttcaggataccaccttcactaggtatgctatacattgggtgcgccgacggccccgganaaacggcttgagtggatggggatggatacgaacgcgtaggcaagtaggtaaacaactaaaaaattcaacaagaacgttccgaagggtacaggtacgtcctaaccgtttaccgaagggacacgacgtccgacgtaggtaatttaacttaatacgttaggagtcgtagacgtacgacggccttagaacgtacgtaccgaaacgaccgaacggtcttacgttaatttagtttttcggtacgtaccgtaaccgtttcgttaggttgggtacggttacttaactttagttaccgtacttacgttaacgtttcgtaaccgttccggtacggggacccgtaacggggtaacccttgggtaccccgtaccgttccgtcccgtacccg

SEQ ID NO: 260224 - DNA, 602 bp, Homo sapiens
  misc_feature: GYAE6OF01BRFRA.1.5.A05.1.454.CMB.1.raw
  modified_base (206)..(206): a, c, t, g, unknown or other
  misc_feature (206)..(206): n is a, c, g, or t
  modified_base (220)..(220): a, c, t, g, unknown or other
  misc_feature (220)..(220): n is a, c, g, or t
  modified_base (244)..(244): a, c, t, g, unknown or other
  misc_feature (244)..(244): n is a, c, g, or t
  modified_base (283)..(283): a, c, t, g, unknown or other
  misc_feature (283)..(283): n is a, c, g, or t
  modified_base (383)..(383): a, c, t, g, unknown or other
  misc_feature (383)..(383): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctgggcctnagtgaaggtttccngcaaggcttcaggactacaccttnacttaggtatgctatacattgggtgcgccaggccccganaaaggcttgagtggagtgggatggatcaacgctggcaagtggtaacataaaaaatcacaagagttccagggcagagtcacttacgaggacacactaccgngaggaacttacttatacgtgagtctagacgcaagcctagagtactaccggaagaccacggacttagttattaagtttttgcgtacgtacccttagtaggtggtaggttctaagtttacttaccgtccgttacttaacgttttggaccgttccggtaccgggggtaccaaccggggttaacccgttacggttaccgacccggttcccgtcccgttacccg

SEQ ID NO: 260225 - DNA, 866 bp, Homo sapiens
  misc_feature: GYAE6OF01EMJOA.1.5.A05.1.454.CMB.1.raw
  modified_base (223)..(223): a, c, t, g, unknown or other
  misc_feature (223)..(223): n is a, c, g, or t
  modified_base (261)..(261): a, c, t, g, unknown or other
  misc_feature (261)..(261): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagccgtggggcctcagtgaaggtttccngacaaggcttcaggatacaccttcactaggtatgatanactgtggtgccacgaccggacccgaagaacggtcgtaggtagtaggtaggtagggtagtaggtacgtaaccgtaccggtacggtaccggtaactaaaggttaaccgggtaaaaccttaaaaaaaacaaccgttaacgaaacgtaaaggttaaaccggttaccgggaacggaacgtaacggtaaccgttaaccgtttaaaccccgttaaccgggaaacgggtaacctaaactacccggtacccgggtaacgggtaaacggttactttttaaaccgtaagtttaagggacgggtaagttccggtaaggaacgtaccggaccgtaccgtaagggtaacgtaaccgtaacccggaacgtaaccgacgggttaccgtttagtttaactttttacgttttacgggtcggtacccgttaacccgttagggtttagggtacggggtaacgttacgttaacgttttaaacgttaccgtaacccttaaacgttttacgtttaacccggtaacccgggtttccggggtacccggggtaaaaccgggtaccccgggtaaacccggttttaccgggaaccccgtttaccccggtttccccgtacccgttaaaccccgg

SEQ ID NO: 260226 - DNA, 647 bp, Homo sapiens
  misc_feature: GYAE6OF01CLSGG.1.5.A05.1.454.CMB.1.raw
  modified_base (282)..(282): a, c, t, g, unknown or other
  misc_feature (282)..(282): n is a, c, g, or t
  modified_base (431)..(431): a, c, t, g, unknown or other
  misc_feature (431)..(431): n is a, c, g, or t
  modified_base (464)..(464): a, c, t, g, unknown or other
  misc_feature (464)..(464): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctgggctgaggtgaagagcctggggcctcagtgaaggtttcctgcaacggcttcaggatacaccttcactaggtatgctatacattgggtgcgcaggccccgganaaaggcttgagtggatggatggatcaacgctggcaatggtaaacaacgaaaaaattacaacaagaaagttccgaagggacaagaggtaccaaccgtttaaccgaaggggtaaccacgactaccgacgagggaattaacttatactggancgtagtagcagcctgagatccgaagacacggtntacgtagttatttttaggtgtaccgtaccgttccgttaggttacgggtacgttcgtaatttaacgttaccgtacgttaccgtaaagttttacggtaaccgttcccggttcggggggaccctaaccgggggtaaacccccgttgggttacccccgtaacccggttccgttccccgttaacccgg

SEQ ID NO: 260227 - DNA, 620 bp, Homo sapiens
  misc_feature: GYAE6OF01C7P2R.1.5.A05.1.454.CMB.1.raw
  modified_base (221)..(221): a, c, t, g, unknown or other
  misc_feature (221)..(221): n is a, c, g, or t
  modified_base (456)..(456): a, c, t, g, unknown or other
  misc_feature (456)..(456): n is a, c, g, or t
tcagacgagtgcgtcacgaccggtgctcgatttagatagatagacagggacccaacaaccacatccctcctcagaacgcccccagagcacaacgccccaccatggactggacctggaggatcctcttttggtggcagcagccacaggtgcccactcccaggtccagcttgtgcagtctgggctgaggtgaagaagcctggggcctgagtgtaaggtttccngcaaggtcttcgaggatacaccttcactaggtatgctatactagttgggtgcgccgacggccccgaacgaaaggcttgaggtggagtagggagtgatacgtaacggttggactaataggtaaacaaactaaaaaacttcaacgaagtaacgttacgaggacgagtacgtactaccgttaaccgaggacacactcgacgaggtattactagtacgtaggacgtcgtagagacgacnccgtagacgataccgaagacacggtctagttaacttagttttgtacgtcgtacccgtatacggtaggtacggtactaattacgtaccgtctactaagtttcgacgttccggtggggaccctaagggtaacccgtcggtactacccgtcctcccgtccgtacccg

SEQ ID NO: 260228 - DNA, 723 bp, Homo sapiens
  misc_feature: GYAE6OF01C39ZS.1.5.A05.1.454.CMB.1.raw
  modified_base (221)..(221): a, c, t, g, unknown or other
  misc_feature (221)..(221): n is a, c, g, or t
tcagacgagtgcgtcacgaccggtgctcgatttagatagatagacaggggacccaacaaccacatccctcctcagaagcccccagagcacaaccgccccaccatggactggacctggaggatcctcttttggtggcagcagccacaggtgcccactcccaggtccagcttgtgcagtctggggctgaggtgaagagcctgggcctcgagtgaaggtttccngcaaggcttcaggataccaccttcactaggtatgctatacagttgggtgccgccgacggacccccggaacgaaaggtccttggaggtgggagtgggagtggatcgaacgctggcaagtaggtaaacaactaaaaaacttcaacgaacgaacgttaccgaagggacgaaggtacgtcctaacccgtttaccgaagggaccacgtacgtcccgacggaagtactttaacttaagtacgtagggtacgcgtaggacgacgaacgtcccgtagaagtaacgtaccgaacgaccgtacggacttaggtttaactttagttttttaggacggtaccgttacccgttacgttacgggttacgggtacggttacttaagttttaacgttaaccgtaccgttaacgttaacgttttacggtacccgtttcccgggtacgggggtaccccgtaaacggggttaaccccggttacgggttaccctaaccccgggttcctccccgttaacccgg

SEQ ID NO: 260229 - DNA, 211 bp, Homo sapiens
  misc_feature: GYAE6OF01EWKWF.1.5.A05.1.454.CMB.1.raw
  modified_base (181)..(211): a, c, t, g, unknown or other
  misc_feature (181)..(211): n is a, c, g, or t
tcagacgagtgcgtcacgaccggtgctcgatttagatagatagacgaggcaccgaaggcccatcggtcttcccctggcaccctcctccaagagcacctcgtggggccacagccggcccctggctgcctggtcaaggactacttcctatgtatactctgagcgggctggcaaggcgcatagnnnnnnnnnnnnnnnnnnnnnnnnnnnnnnn

SEQ ID NO: 260230 - DNA, 629 bp, Homo sapiens
  misc_feature: GYAE6OF01AS30M.1.5.A05.1.454.CMB.1.raw
  modified_base (132)..(132): a, c, t, g, unknown or other
  misc_feature (132)..(132): n is a, c, g, or t
  modified_base (209)..(209): a, c, t, g, unknown or other
  misc_feature (209)..(209): n is a, c, g, or t
  modified_base (223)..(223): a, c, t, g, unknown or other
  misc_feature (223)..(223): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggnggcagcagccacaggtgcccactcccaggtccagcttgtgcagtcgtggggctggaggtgaagagccgtggggcctnagtgaaggtttccngcaaggcttcgaggtataccaccttcacgttaggtatgactatacagttgggtgcgccgacgggccccggaagaacggtcttggagtggagtgggatggatcgaacgcgtgacaagtacggtaaacaactaaaaatcaacgagtaacgtcgagggacagagtactaccgttacgaggacacgactccggacgagtattactatagtggagtctagagtcagcctagacgtacgtaccgaacgacgaacggtcttagttacgttagttttcggtcgtacgtacccgttggtaggtgggtacgttcgtaagttacgtccgtacgttacgttacgttacggtaccttccggtacgggtacccgtaccggggtaacccgtcggttacctacccggttccgtccgtacccg

SEQ ID NO: 260231 - DNA, 676 bp, Homo sapiens
  misc_feature: GYAE6OF01B609M.1.5.A05.1.454.CMB.1.raw
  modified_base (358)..(358): a, c, t, g, unknown or other
  misc_feature (358)..(358): n is a, c, g, or t
tcagacgagtgcgtcacgaccggtgctcgatttagatagatagacagggacccaacaaccacatccctcctcagaacgcccccagagcacaaccgccccaccatggactggacctggaggatccttctttttggtggcagcagccacaggtgcccactcccaggtccagcttgtgcagtctggggctggaggtgaagaagccgtggggcctgagtgaaggtttcctgacgaaggcttcgaggactacgaccttcacgtaggtatgctatactagttgggtgcgccgacggaccccggacaaaggcttgagtggagtggatgatcaagctgacaagtggtaaacaagaaaaattacaanaagaacgttaccagggcaagagtacaccgttacgacgggacactacgtccgagaggtattacgttatagtggagtaccgttgaagacgtacgaccgttaggacgtacgtacccgaaagaccgaaccgggtcttaacggtttaattttaacgttttttacggtcggtaccggttaacccgttacgttagggttagggtaacggttacgtagttttaacgttaccgtacttacttaacgtttacgtaccgttaccggtacggggacccgtaacgggtaccccttacgggtaccctacccggttccgttcccgttaacccg

SEQ ID NO: 260232 - DNA, 808 bp, Homo sapiens
  misc_feature: GYAE6OF01EOIHF.1.5.A05.1.454.CMB.1.raw
  modified_base (305)..(305): a, c, t, g, unknown or other
  misc_feature (305)..(305): n is a, c, g, or t
tcagacgagtgcgtcacgaccggtgctcgatttagatagatagacaggggacccaacaaccacatccctcctcagaacgcccccagagcacaacgccccaccatggactggacctggaggatcctctttttggtggcagcagccacaggtgcccactcccaggtccagcttgtgcagtctggggctggaggtgaagagccgtggggcctcgagtgtaacggtttcctgacaaggtcttcgaggtactaccaccttcaacgtaggtatgacttatactagttgggtgccgccgacggccccggaanaaacggtcttagacggtggagtcgggatgggatcgaacggtcgtcggactaaagtacgggtaaacaaaacgtaaaaaattcgaacgaacggtaaacgttaccgaagggacaacggtacgtacctaaccgtttaaccgaacgggaaccaacgtacgtacccggacggtaacggttaactttaacgtttaagtagtagggacgtacgtaggacgtacgaacgtaccgtaggaacgtacgtacccgggaaagaccggtaacggtaccgttaggtttaatttacggtttttacggtacgtacccgggttaccttacggttagggttacgggtacggttaccgtaagttttaaccgttaccggtaaccgttttaaccgttaaacgttttacgggtaacccgtttcccggggttaacccggggggtacccgttaaaacccgggggtaaccccggtttacccgggttaaccccgttaccccgggtttccccgttccccggttaaccccgg

SEQ ID NO: 260233 - DNA, 561 bp, Homo sapiens
  misc_feature: GYAE6OF01DYWEC.1.5.A05.1.454.CMB.1.raw
  modified_base (221)..(221): a, c, t, g, unknown or other
  misc_feature (221)..(221): n is a, c, g, or t
  modified_base (458)..(458): a, c, t, g, unknown or other
  misc_feature (458)..(458): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttccngcaaggcttcaggatacaccttcactaggtatgctatacattgggtgcgccaggccccggacaaaggcttgagtggatgggatggatcgaacgctggcaatggtaaacaactaaaaaattcaacagaagttccgaagggcagagtcacctttaccgaggacacatccgacgaggtattacttatagtgagctagagcagctagagactacgaagacgacggcttagtattattttgngtcgtaccttgtagtggtagtctagtttacgtacgtcttactacgtttgacctccggtacggggccaacggggtaccctaggtacctccggtctcccgtaccg

SEQ ID NO: 260234 - DNA, 182 bp, Homo sapiens
  misc_feature: GYAE6OF01BLFVL.1.5.A05.1.454.CMB.1.raw
  modified_base (176)..(182): a, c, t, g, unknown or other
  misc_feature (176)..(182): n is a, c, g, or t
tcagacgagtgcgtcacgaccggtgctcgatttagatagatagacagggcaccaagggcccatcggtcttcccctggcaccctcctccaagagcacctctggggcacagcggcctggctgcctggtcaaggactacttcctcgtactgcgctgagcgggctggcaaggcgcatagnnnnnnn

SEQ ID NO: 260235 - DNA, 182 bp, Homo sapiens; identical to SEQ ID NO: 259873
  misc_feature: GYAE6OF01CNI1S.1.5.A05.1.454.CMB.1.raw
  modified_base (178)..(182): a, c, t, g, unknown or other
  misc_feature (178)..(182): n is a, c, g, or t

SEQ ID NO: 260236 - DNA, 694 bp, Homo sapiens
  misc_feature: GYAE6OF01BW7V1.1.5.A05.1.454.CMB.1.raw
  modified_base (283)..(283): a, c, t, g, unknown or other
  misc_feature (283)..(283): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccacggccccgganaaacggcttgacggtgatgggatggatcgaacgcgtggacaagtacggtaaacaactaaaaaattcaacaagtaacgttccgaagggacagagtacctaacctttaaccgaggggaccacgacgttaccggacgtaacggtaactttacgttaagtagtacgggtagtacgttaggaagtaccgaacgtccgtaggaacgtaacgtacccgaaaggtaccgaacggttctagtttaatttagtttttcggacgtccgttaccgttaccggttaggttacgggtacggttacgtaagttttaacgtaccggtaccttacgttaaacgtttcgaaccgtttcccgggtacggggtacccgtaacggggtaaccccttgggtacccgtacccggttcccgttcccgtaacccgg

SEQ ID NO: 260237 - DNA, 566 bp, Homo sapiens
  misc_feature: GYAE6OF01DD6ZF.1.5.A05.1.454.CMB.1.raw
  modified_base (221)..(221): a, c, t, g, unknown or other
  misc_feature (221)..(221): n is a, c, g, or t
  modified_base (390)..(390): a, c, t, g, unknown or other
  misc_feature (390)..(390): n is a, c, g, or t
  modified_base (463)..(463): a, c, t, g, unknown or other
  misc_feature (463)..(463): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttccngcaaggcttcaggatacgaccttcactaggtatgctatacattgggtgcgccaggccccggacaaaggctgagtggatgggatggatcaacgctggcaatggtaacacaaaaatcacagaagttccagggacagagtacacctttacagggtacacactccgcgaaggnttaacttatacgtggagctgagcagcctgagactccgaagaccaggctagtacttattttggtgtcgtacctntaggttgtaggtactaagtttacgtaccgctctaagtttgtacgtcccgtacggggtaccgaaccgggtaccctacgggtctacccggtccgttccctacccg

SEQ ID NO: 260238 - DNA, 254 bp, Homo sapiens
  misc_feature: GYAE6OF01BTLC4.1.5.A05.1.454.CMB.1.raw
  modified_base (247)..(254): a, c, t, g, unknown or other
  misc_feature (247)..(254): n is a, c, g, or t
tcagacgagtgcgtcacgaccggtgctcgatttagatagatagacaggggcagttccagatttcaactgctcatcagcagcctgcagtctgaagattttgcagttttattactgtcagcagtataataactggcctccgacgttcggccaagggaccaaggtgaaatcaaacgactgtggctgcacatctgtcttcatctcccgcatctgatcgtactgcgctgagcgggctggcaaggcgcatagnnnnnnnn

SEQ ID NO: 260239 - DNA, 261 bp, Homo sapiens
  misc_feature: GYAE6OF01BCWU4.1.5.A05.1.454.CMB.1.raw
  modified_base (251)..(252): a, c, t, g, unknown or other
  misc_feature (251)..(252): n is a, c, g, or t
  modified_base (254)..(261): a, c, t, g, unknown or other
  misc_feature (254)..(261): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctcgacgttcggccaagggaccaaggtgaaatcaaacgactgtggctgcaccatctgtcttcatccttcccgccatctgagagtgcgtctctgagcgggtctggcaaggcgacatagnngnnnnnnnn

SEQ ID NO: 260240 - DNA, 712 bp, Homo sapiens
  misc_feature: GYAE6OF01DNBTD.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccgacggccccggacaaacggcttgaggtggagtgggatgggatcgaacgcgtggacaagtggtaaacaacaaaaaacttcaacaagaacgttacccgaaggggtaccaaggtacgtacctaacccgttttaacccgaacggggaacctaacgacgttacccggacggaacgggtactttaacgtttaatagttagggagtacgttaggacgccgacgacccgttggaacgtacgtaccggaacgaccgacggtcttagttaagtttagtttttggtacggtacgtaccgttcgttacggttagggtacgggttactaagtttacgttacggtccttacgttaaacgttttcgtaacccggtttcccggtaccgggggtacccgaaccgggggttaaccccttacgggttcccgaaccccggtttccgtccccgttaacccg

SEQ ID NO: 260241 - DNA, 590 bp, Homo sapiens
  misc_feature: GYAE6OF01ADEMW.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccacggccccggacaaggcttgagtggagtgggatggatcgaacgctggacaagtcggtaaacaacaaaaattcaacagaagttcgagggacagagtactacctttacgaggacacactcgacgagtacttacttatagtggagtctagagacacgcctagagacgtaccgaagtacgacggtctgttaatttagttttagtcgtcgtaccttacgtaggtaggagtactagttattacgtcttacgtagtttagaccgtccgtcggggacccgtacgggtaaccccgttggtacccgtacccggttcctcccgtacccg

SEQ ID NO: 260242 - DNA, 718 bp, Homo sapiens
  misc_feature: GYAE6OF01EKRZC.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcctactcccaggtccagcttgtgcagtctggggctgaggtgaagaagccgtggggcctcaggtgaaggtttcctgcaaggcttcaggataccaccttcactaggtatgctatacattgggtgcgccacggccccggagaaaggcttgagtggatgggatgggatacaacggctgggacaagtaggtaaacaaactaaaaaagttcaacgtaagtaacgttaccgaagggacaggacgtactaaccgtttaaccgagggaccacacgtaccgacggtaaggtattaacttagtagtagggagtcttaggaacgcgagtccctagggaacgtaccgtaccggaaacgaaccggtacggtaccttaggttaacgtttaacgttttttaggtacggtacgtaaccccgtttacgttaagggttgggttaacgggttactaacgttttaacgtttaaccgtaccgtttacgttaaacgtttttcgaacccggtttcccgggttaacggggaccccggtaacggggttaaccccgttcgggtaccccgtaccggtttccctcccggttaacccg

SEQ ID NO: 260243 - DNA, 573 bp, Homo sapiens
  misc_feature: GYAE6OF01B3CTB.1.5.A05.1.454.CMB.1.raw
  modified_base (465)..(465): a, c, t, g, unknown or other
  misc_feature (465)..(465): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccacggccccgacaaaggcttagagtggatgggatggatacgaacgctggcaagtggtaaacaacaaaaattcaacagaacgttcagggtcagagtcactttaccgagggtacacataccgcgaggtattacttagtatggagctgagcgagcctggagacgtaccgaagacgacggctgttaacttatttttgngtaccgtactcgttagtggtagtacctagtttactacgtacttacgtaatttcgacgttccgtggggtacccacgggtacctacggtacctaccgtccgtcctacccg

SEQ ID NO: 260244 - DNA, 254 bp, Homo sapiens
  misc_feature: GYAE6OF01CW3Z7.1.5.A05.1.454.CMB.1.raw
  modified_base (244)..(244): a, c, t, g, unknown or other
  misc_feature (244)..(244): n is a, c, g, or t
  modified_base (250)..(254): a, c, t, g, unknown or other
  misc_feature (250)..(254): n is a, c, g, or t
tcagacgagtgcgtcacgaccggtgctcgatttagatagatagacaggggcagttccagatttcaactgctcatcagcagcctgcagtctgaagattttgcagttttattactgtcagcagtataataactggcctccgacgttcggccaagggaccaaggtggaaatcaaacgaactgtggctgcacatctgtcttcatcttccgcatctgatcgtactgcgctgagcgggctggcaagggcncatagnnnnn

SEQ ID NO: 260245 - DNA, 616 bp, Homo sapiens
  misc_feature: GYAE6OF01D0WRX.1.5.A05.1.454.CMB.1.raw
  modified_base (207)..(207): a, c, t, g, unknown or other
  misc_feature (207)..(207): n is a, c, g, or t
  modified_base (242)..(242): a, c, t, g, unknown or other
  misc_feature (242)..(242): n is a, c, g, or t
  modified_base (471)..(471): a, c, t, g, unknown or other
  misc_feature (471)..(471): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctnagtgaaggtttcctgcaaggtcttcgaggataccnccttcactaggtatgcttatacagttgggtgccgccacgggcccccggaacgaaacggcttgagtggagtggggatggatcgaacgctggcaagtaggtaaacaacgaaaaaattcaacagaagttccgaaggcagagtacaccgtttaccgaggacacatccgacgaggtacttacttagtagtaggagtctagacgcgacgcctgagacgtaccgaagacgacggtntagttagttagtttttgtcgtacgtaccttcgtaggttggacgttctaatttacgttacgccttagtaacgttttagacctttccggtacggggtacccgtaacgggtacccgtacggtaccctacccgtccgttcccgtacccg

SEQ ID NO: 260246 - DNA, 634 bp, Homo sapiens
  misc_feature: GYAE6OF01DPFEX.1.5.A05.1.454.CMB.1.raw
  modified_base (428)..(428): a, c, t, g, unknown or other
  misc_feature (428)..(428): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggataccaccttcactaggtatgctatacagttgggtgcgccgacggccccggaacgaaacggcttggagtcggaagtgggagtggatccgaacgctggacaagtggtaaacaacaaaaaattcaacagaacgttcgaagggcagagtactaaccgttacagggacacagtccgagacggtattactaatataggngactgaagcaacgcctagagactccgaagtacgaacggtctagttattacgtttttgtacgtcttacctcgttaggtaggtacggttctaagtttattacggtaccttacgtaaacttttcggaaccgttccccgggttagggggaccccgtaaacggggtaacccctttggggtaccctaacccggttccgttaccccttaaccg

SEQ ID NO: 260247 - DNA, 178 bp, Homo sapiens
  misc_feature: GYAE6OF01A40ZS.1.5.A05.1.454.CMB.1.raw
  modified_base (177)..(178): a, c, t, g, unknown or other
  misc_feature (177)..(178): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttccacgcactcgtctgagcggctggcaaggcgcatagnn

SEQ ID NO: 260248 - DNA, 542 bp, Homo sapiens
  misc_feature: GYAE6OF01CVYHI.1.5.A05.1.454.CMB.1.raw
  modified_base (221)..(221): a, c, t, g, unknown or other
  misc_feature (221)..(221): n is a, c, g, or t
  modified_base (404)..(404): a, c, t, g, unknown or other
  misc_feature (404)..(404): n is a, c, g, or t
  modified_base (448)..(448): a, c, t, g, unknown or other
  misc_feature (448)..(448): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttccngcaaggcttcaggatacaccttcactaggtatgctatacattgggtgcgccaggccccggacaaaggcttgagtggatgggatggatcaacgctggcaatggtaaacacaaaaaattcaacagaagttccagggcagagtcacctttaccagggacacatccgcgaggattacttatatgganctgagcagcctgagatccgaagacacggctgtattagtttttgngtcgtaccttctagtggaggtctattattacgcttacgtaatttgacttccgtaggggtccacgggtacccctggtaccaccgtctccgtaccg

SEQ ID NO: 260249 - DNA, 520 bp, Homo sapiens
  misc_feature: GYAE6OF01A4OAS.1.5.A05.1.454.CMB.1.raw
  modified_base (399)..(399): a, c, t, g, unknown or other
  misc_feature (399)..(399): n is a, c, g, or t
  modified_base (442)..(442): a, c, t, g, unknown or other
  misc_feature (442)..(442): n is a, c, g, or t
  modified_base (457)..(457): a, c, t, g, unknown or other
  misc_feature (457)..(457): n is a, c, g, or t
  modified_base (463)..(463): a, c, t, g, unknown or other
  misc_feature (463)..(463): n is a, c, g, or t
  modified_base (506)..(506): a, c, t, g, unknown or other
  misc_feature (506)..(506): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttcctgcaaggcttcaggatacaccttcactaggtatgctatacattggtgcgccaggccccgacaaaggcttgagtggatgggatggatcaacgctggcaatggtaaacacaaaaattcacagaagttccaggcagagtcacttaccgaggacacatccgacgaggattacttatataggagntagagcagcctgagatccgaagacaggctagtattagttttgngtcgtacctcgtagngacgtnattatcgctagtattgacttcgcgggcacggtacctcggtacncccgtgtcctaccg

SEQ ID NO: 260250 - DNA, 263 bp, Homo sapiens
  misc_feature: GYAE6OF01BBOVD.1.5.A05.1.454.CMB.1.raw
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
  modified_base (252)..(263): a, c, t, g, unknown or other
  misc_feature (252)..(263): n is a, c, g, or t
tcagacgagtgcgtcacgaccggtgctcgatttagatagatagacaggggcagttccagatttcaactgctcatcagcagcctgcagtctgaagtattttgctagttttattactgtcagcagtataataactggcctccgacgttcggccaaggaccaaggtgaaaatcaaaagactgtgctgacacatctgtcttcatccgttcccgcatctgatcgactgcgctgagcggntggacaaggccanaatgnnnnnnnnnnnn

SEQ ID NO: 260251 - DNA, 663 bp, Homo sapiens
  misc_feature: GYAE6OF01E4UDH.1.5.A05.1.454.CMB.1.raw
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
  modified_base (441)..(441): a, c, t, g, unknown or other
  misc_feature (441)..(441): n is a, c, g, or t
  modified_base (459)..(459): a, c, t, g, unknown or other
  misc_feature (459)..(459): n is a, c, g, or t
tcagacgagtgcgtcacgaccggtgctcgatttagatagatagacagggacccaacaaccacatccctcctcagaacgcccccagagcacaaccgccccaccatggactggacctggaggatccttctttttggtggcagcagccacaggtgcccactcccaggtcccagcttgtgcagtctggggctgaggtgaagagccgtggggcctcgagtgaaggtttccngcaaggcttcgaggatacaccttnactaggtatgctatactagttgggtgccgccgacggcccccggaacaaaggcttgagtggagtgggatggatcgaacgcgtggctaagtaggtaaacaaactaaaaattcaacaagtaagttccgagggacagtacgtaccgtaacctttaccgagggaccacacgtccgcgaggtattactatagtggancgtagagcagccctaganacgtaccggaaagaccgtacggtacttagtaagtttagtttttcggacgtaccgtaccgttacttaggttaggtacggttacgttaatttacgttaccgtactttacgtaacttttacggtacccgttccgggttacggggacccgttaaccggggttaaaccccgttcggttaccccgtacccggtttccgtcccgttacccg

SEQ ID NO: 260252 - DNA, 991 bp, Homo sapiens
  misc_feature: GYAE6OF01EHCH3.1.5.A05.1.454.CMB.1.raw
  modified_base (268)..(268): a, c, t, g, unknown or other
  misc_feature (268)..(268): n is a, c, g, or t
tcagacgagtgcgtcacgaccggtgctcgatttagatagatagacaggggaccccaacgaaccacatccctcctcagaacgcccccagagcacgaaccgccccgacctacttggtacgtgggaccgtggaggacttacccttcgtttttgggtggccaaggccaggccacgtaggtgcccactacccaggtccgagtcttagtgacgagtccgtgggggtcctggaggtagaagacgccgtcggggcctcgagtaggaacggtttccngactaaggcttacgagtacttacaccttcgacgttaggtactagaccttacgtacgtagtttaggggttcgccggtacccgaacgggaccccccgggtaaggtaaaacggggtcctttacgggtaaccggttaggggttaacggtacgggggtaagttaccggggaaaacgtttaccggaaaaccggtaccgttaaggggtaacctaaacggttacggggtaaaaacctaaaaccgtaaaaaaaaccgtttccaaaaccgtaaacggttaaaccggtttaccccgggaaaaggggtaacctaaccggaaacggtttacccgttaaacccgttttaacccgggaaaacggggtaaccctaaacgtaaccggttacccgggaaccggtaacggttaaccgtttaaccgtttaacgttaaacggtacgggtaacggtacgtttacggaacggtaacccgtaacggtacccccgttagggtaaacgttaacccgttaacccggaaggaacccggtacgggttacgtttaaacgggtttaactttttacggtttttttaccggacggtttaccgggtaaacccgttttacgtaagggtttacggtaacggttacgttaagtttacgttaccggttacgttaccgtaaacgtttacgggaccgtttccggtacgggtcccgtaaacggggtcccttacggtacctacccggtccgttcccgtaacccgg

SEQ ID NO: 260253 - DNA, 728 bp, Homo sapiens
  misc_feature: GYAE6OF01DB8ZX.1.5.A05.1.454.CMB.1.raw
  modified_base (225)..(225): a, c, t, g, unknown or other
  misc_feature (225)..(225): n is a, c, g, or t
tcagacgagtgcgtcacgaccggtgctcgatttagatagatagacaggggacccaataaccacatccctcctcagaagcccccagagcacaacgccccaccatggactggacctggaggatcccttctttttggtggcagcagccacaggtgcccactccccaggtccagcttgtgcagtctggggctgaggtgaagaagcctggggcctcagtgaaggtttccngcaaggcttcaggactacaccttcactaggtatgacttaatacagtttgggtgccgcccgacggacccccggacgaaacggtcttgaggtggagtgggatggatcgaacgctggacaaagtaggtaaacaaacgtaaaaaacttcaacaagtaacgttaccgaaggggacaaggacgtactaacctttaaccgaacggggtaccaacacgtacccgacggtaacggtatttaaccgtttaatagtagggacgacgttaggagtacaagcccgtagaacgtacgttacccggaaggaaccgacgggtacttggttaattttacgttttttggtacgttaccgtaccttcggttaggttagggtacggttacgttaattttaaccgttacgtaccttacgtaaacggttttacgtaacccgtttcccgggttacggggaccccgttaacggggtaacccccgtttacgggtaccctaacccgggttccctttccccgtaaccccg

SEQ ID NO: 260254 - DNA, 560 bp, Homo sapiens
  misc_feature: GYAE6OF01AVQZZ.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccgacggccccggacaaaggcttgagtggagtgggatggatcgaacgcgtggacaagtggtaacaacaaaaattcaacagaacgtcgaggcagagtcacctttacgagggacacgacgtccgacgtaggtattacttatagtaggagctagagcagtctagagacgtcgaagacacggtctagtattagttttgcgtcgtactgtagtggagtactagttatcgtatacgtatttgaccttcgtcgggtaccgacgggtaccgtacggtacctccgttcgtccgtaccg

SEQ ID NO: 260255 - DNA, 183 bp, Homo sapiens
  misc_feature: GYAE6OF01DE78R.1.5.A05.1.454.CMB.1.raw
  modified_base (178)..(183): a, c, t, g, unknown or other
  misc_feature (178)..(183): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttccagtactctatctgagcgggctggcaaggcgcatagnnnnnn

SEQ ID NO: 260256 - DNA, 549 bp, Homo sapiens
  misc_feature: GYAE6OF01A5BMG.1.5.A05.1.454.CMB.1.raw
  modified_base (283)..(283): a, c, t, g, unknown or other
  misc_feature (283)..(283): n is a, c, g, or t
  modified_base (450)..(450): a, c, t, g, unknown or other
  misc_feature (450)..(450): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccgganaaaggcttgagtggatgggatggatcaacgctggcaatggtaacaacaaaaaattcaacagaagttccgagggcagagtcaccttacaggacacatccgcgaggtattacttatatggagctgagcagcctgagactaccgaagaccgacggctagtattattttgngtcgtaccttcgtagtggagtctagttattacgcttacgtatttgaccgttccgtaggggacccacgggtaccctggtacccaccgttcctcccgtccg

SEQ ID NO: 260257 - DNA, 651 bp, Homo sapiens
  misc_feature: GYAE6OF01BDY4Y.1.5.A05.1.454.CMB.1.raw
  modified_base (283)..(283): a, c, t, g, unknown or other
  misc_feature (283)..(283): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctgggctgaggtgaagaagcctggggcctcagtgaaggtttcctgcaaggcttcaggatacaccttcactaggtatgctatacattgggtgcgccaggccccgganaaacggcttggagtggagtgggatggatcgaacgcgtggcaagtggtaacaacaaaaaattcaacagaacgttcagggcagagtcacctttacgaggtacacatccgacgacggtattacttatactaggtagcgttagagacgtacgacctgacgagtccggaaacgaccgaacggtcttagtagtttaacgtttttggtacgaccggtacttaccgttaggttacgggtacgggtactaagtttacgttaaccggtcttacgttaagttttacggacctttccccgggttacgggggtaccccgtaacggggtaaacccccggttgggttaccccttaccccgggttccgttacccgttaccccgg

SEQ ID NO: 260258 - DNA, 187 bp, Homo sapiens
  misc_feature: GYAE6OF01BJKJS.1.5.A05.1.454.CMB.1.raw
  modified_base (178)..(187): a, c, t, g, unknown or other
  misc_feature (178)..(187): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctctctcgactctgagcgggctggcaaggcgcatagnnnnnnnnnn

SEQ ID NO: 260259 - DNA, 558 bp, Homo sapiens
  misc_feature: GYAE6OF01BXV7U.1.5.A05.1.454.CMB.1.raw
  modified_base (222)..(222): a, c, t, g, unknown or other
  misc_feature (222)..(222): n is a, c, g, or t
  modified_base (457)..(457): a, c, t, g, unknown or other
  misc_feature (457)..(457): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttccngcaaggcttcaggatacaccttcactaggtatgctatacattgggtgcgccaggcccccggacaaaggcttgagtggatgggatggatcaacgctggcaatggaacacaaaaaattcaacagaagttccagggcagagtcacctttacagggacacatccgcgagattacttatatggagctgagcagcctgagatccgaagccacggctgttattagttttagtcgcgtacctnttaggtaggagtctagtttacttaccgtacgttcgtaagtttgaccgttccgacgggaccgtaacgggtacccgtggtacccaccggttcctcccgtaccg

SEQ ID NO: 260260 - DNA, 750 bp, Homo sapiens
  misc_feature: GYAE6OF01DOEC1.1.5.A05.1.454.CMB.1.raw
tcagacgagtgcgtcacgaccggtgctcgatttagatagatagacagggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagccgtggggcctcagtgaaggtttcctgcaaggcttcgaggatacctaccttcactaggtatgctatacattgggtgccgccgacggccccggaacgaaacggcttacggagtgggagtgggagttagggacttacgaacgtcgtagggacaaagtacggtaaacaaactaaaaaacgttacaaacgaagtaacgttaccgagggacgaagacgtactaacctttaccgaacggacacacgtccgacgtaggtaacttaacttataacgtcggtagtccgtagtacgacagtccgtaggacgtaaccgtaccgaaacgtaccgacggtacgttacgttagttttaacgtttttagggtcgtacccgttaaccgttacggttaacgggttagggtaacgggttacttaaacgtttaacgtttaccggtacttaaccgtttaaacgttttacggtacccggtttaccgggtaccgggggtacccggtaaacccgggggtaacccccgttaccgggtttaaccccgtaccccgggttacccttccccgttaaccccggg

SEQ ID NO: 260261 - DNA, 575 bp, Homo sapiens
  misc_feature: GYAE6OF01DAXPM.1.5.A05.1.454.CMB.1.raw
  modified_base (222)..(222): a, c, t, g, unknown or other
  misc_feature (222)..(222): n is a, c, g, or t
  modified_base (284)..(284): a, c, t, g, unknown or other
  misc_feature (284)..(284): n is a, c, g, or t
tcagacgagtgcgtcacgaccggtgctcgatttagatagatagacaggggacccaacaaccacatccctcctcagaagcccccagagcacaaccgccccaccatggactggacctggaggatcctcttttggtggcagcagccacaggtgcccactccccaggtccagcttgtgcagtctggggctgaggtgaagagcctggggcctcagtgaaggtttccngcaaggcttcaggatacaccttcactaggtatgctatacattgggtgcgccaggccccgganaaaggcttgagtggatgggatggatcaacgctggcaatggtaaacacaaaaaattcacagaagttccagggcagagtacaccttacagggacacatccgacgagtatacttatactgagcgtgagcagcctgagactaccgaagacacggtctagtacttatttttgcgtacgtacctctagtggtaggtctaagtttactacgtcttacgtaaactttgtaccgttccggtacggggtacccgaacggggtacccccttacgggtacctacccggtcctcccgtaacccg

SEQ ID NO: 260262 - DNA, 828 bp, Homo sapiens
  misc_feature: GYAE6OF01DSMHT.1.5.A05.1.454.CMB.1.raw
tcagacgagtgcgtcacgaccggtgctcgatttagatagatagacaggggacccaacaaccacatccctcctcagaacgcccccagagcacaacgccccaccatggactggacctggaggatccttctttttggtggcagcagccacaggtcgcccactcccaggtccagcttgtgcagtcgtggggctggaggtgaagaagccgtggggcctcgaggtgtaacggtttcctgcgaaggcttcgaggataccaccttcacgtaggtatgctatactagttgggtcgccgccgacgggccccggaacgaaacggcgttaggaggtggagtaggggagtggactcgaacgcgtacggactaagtacggtaaacaaactaaaaattcaacgtaaggtaaacgttcgaagggacaaggtacgtacctaacccgtttaacgaagggtaaccacgtaacgtacccggacggtaacggtaactttaaccgttaattaacggtagggtacggtcgtaggtacgaccgtaacggtacccgttagggaacggtaaccgttacccgggaaacgtaacccgggtaacgggttaccgttagggtttaacttttacggttttttacgggtaccggttaacccggttaaccgtttacggttaacgggttacggggttaacgggttacttaaacggtttttaaccgtttaaccggtaccgtttaaaccgtttaacgtttaccgggttaacccgttcccgggttacgggggaccccggttaaaccggggttaaccccggttaccgggttaaccccgtaccccggtttcccgtcccgttaacccgg

SEQ ID NO: 260263 - DNA, 179 bp, Homo sapiens; identical to SEQ ID NO: 259898
  misc_feature: GYAE6OF01BVVE6.1.5.A05.1.454.CMB.1.raw
  modified_base (178)..(179): a, c, t, g, unknown or other
  misc_feature (178)..(179): n is a, c, g, or t

SEQ ID NO: 260264 - DNA, 308 bp, Homo sapiens
  misc_feature: GYAE6OF01DE35V.1.5.A05.1.454.CMB.1.raw
  modified_base (124)..(124): a, c, t, g, unknown or other
  misc_feature (124)..(124): n is a, c, g, or t
  modified_base (187)..(187): a, c, t, g, unknown or other
  misc_feature (187)..(187): n is a, c, g, or t
  modified_base (201)..(201): a, c, t, g, unknown or other
  misc_feature (201)..(201): n is a, c, g, or t
  modified_base (205)..(205): a, c, t, g, unknown or other
  misc_feature (205)..(205): n is a, c, g, or t
  modified_base (244)..(244): a, c, t, g, unknown or other
  misc_feature (244)..(244): n is a, c, g, or t
  modified_base (268)..(308): a, c, t, g, unknown or other
  misc_feature (268)..(308): n is a, c, g, or t
tcagacgagtgcgtcacgaccggtgctcgatttagatagatagacaggggcagttccagatttcaactgctcatcagcagcctgactagtctagaaagtattttgcttagtttattactgcagnaagtaataataactggcctcgtacgtcggaccgaaggaccaaggtgaaaatacaaaacgatgnggctgcacatcgtntctnactctacccgcatctgactcgatgccgatgacgggcggntagacgacggaccgataagagatnnnnnnnnnnnnnnnnnnnnnnnnnnnnnnnnnnnnnnnnn

SEQ ID NO: 260265 - DNA, 603 bp, Homo sapiens
  misc_feature: GYAE6OF01AC5RS.1.5.A05.1.454.CMB.1.raw
  modified_base (285)..(285): a, c, t, g, unknown or other
  misc_feature (285)..(285): n is a, c, g, or t
  modified_base (593)..(593): a, c, t, g, unknown or other
  misc_feature (593)..(593): n is a, c, g, or t
tcagacgagtgcgtcacgaccggtgctcgatttagatagatagacaggggacccaacaaccacatccctcctcagaatcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccacggccccgganaaaggcttgagtggagtgggatggatcgaacgctggcaagtggtaaacaacaaaaaagttcaacagaacgttccgaagggcagagtacacctttacgagggacacgactccgacgagtattacttatagtggagtcgtagagcaggtcctaggagtactaccggaagaccgacgggcttaggttactttagtttttaggcgtaccgtaccgttacgttaggtcgggtagtacctattacgttacgcttacttaagtttcgacgtccggtacggggaccaacgggtaaccccttggtacccacccgttntcccgtaccg

SEQ ID NO: 260266 - DNA, 184 bp, Homo sapiens
  misc_feature: GYAE6OF01COKKV.1.5.A05.1.454.CMB.1.raw
  modified_base (178)..(184): a, c, t, g, unknown or other
  misc_feature (178)..(184): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttccgtactagacgctgagcgggctggcaaggcgcatagnnnnnnn

SEQ ID NO: 260267 - DNA, 180 bp, Homo sapiens; identical to SEQ ID NO: 259970
  misc_feature: GYAE6OF01APWJ4.1.5.A05.1.454.CMB.1.raw
  modified_base (178)..(180): a, c, t, g, unknown or other
  misc_feature (178)..(180): n is a, c, g, or t

SEQ ID NO: 260268 - DNA, 604 bp, Homo sapiens
  misc_feature: GYAE6OF01AK2B6.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccgaggccccggacaaacggcttggagtggagtggggatggatcgaacgcgtggacaagtggtaaacaacgtaaaaatcaacagaacgttccgagggcagagtacacctttaaccgagggacacacgtccgacgtaggtattacttatatggagctgagcagctgagactaccgaagacgacggtcttagttaatttattttggtcgtacgtaccttacgttaggtcggtacggttctaagttagtttaccgtacttacgtaagtttgtaccgttccggtacggggacccgtaaccgggtacccgttcggtacctaccgtcctcccgtacccg

SEQ ID NO: 260269 - DNA, 895 bp, Homo sapiens
  misc_feature: GYAE6OF01A5KZG.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggatgatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatgggatggatcgaacgctggcaagtggtaaacaacgaaaaaaattccaacaagtaacgttacccgaagggacaaggaacggtacctaacccgttttacccgaaggggaaccctaacgtaacgttaccccggacggtaaggggtaacttttaaccgtttaaagttaacgttacggggtaagtacccgttagggtaacggtaccgtaacggtaccccgtttacgggaaacggtaaaccggtttaaccccggaaaacgggttaaacccccggtaaacggggtacccccggttttaaagggttttaaacgtttttaaacggttttttttttacgggtaaccggggtttaccccggttaaacccccgttttaacggtttaaacggggtttccgggggttaaaacgggttttacccgttaaaacgtttttttaaacggtttaaacccggttacccgtttaaccgtttaaaaacggttttttcgggaaaccccggtttttaccccgggttacggggggtaaccccccggttaaacggggggtaaaccccccgtttagggggtttaccccccgttaacccggtttaccccgtttaaccccccgg

SEQ ID NO: 260270 - DNA, 258 bp, Homo sapiens
  misc_feature: GYAE6OF01DZY9O.1.5.A05.1.454.CMB.1.raw
  modified_base (188)..(188): a, c, t, g, unknown or other
  misc_feature (188)..(188): n is a, c, g, or t
  modified_base (197)..(197): a, c, t, g, unknown or other
  misc_feature (197)..(197): n is a, c, g, or t
  modified_base (205)..(205): a, c, t, g, unknown or other
  misc_feature (205)..(205): n is a, c, g, or t
  modified_base (251)..(258): a, c, t, g, unknown or other
  misc_feature (251)..(258): n is a, c, g, or t
tcagacgagtgcgtcacgaccggtgctcgatttagatagatagacaggggcagttccagatttcaactgctcatcagcagcctgcagtctgaagtattttgctagttttattactgtcagcagtataataactggcctcgacgttcggcaagggaccaaggtgaaatcaaacgaactgtggctgcacntctgtcttnatcctccncatctgatcgtactgcgctgacgcgggctggcaaggcgacagtagnnnnnnnn

SEQ ID NO: 260271 - DNA, 782 bp, Homo sapiens
  misc_feature: GYAE6OF01CFP5K.1.5.A05.1.454.CMB.1.raw
  modified_base (245)..(245): a, c, t, g, unknown or other
  misc_feature (245)..(245): n is a, c, g, or t
tcagacgagtgcgtcacgaccggtgctcgatttagatagatagacaggggacccaacaaccacatccctcctcagaagccccagagcacaacgccccaccatggactggacctggaggatcctcttttggtggcagcagccacaggtgcccactcccaggtccagcttgtgcagtctggggctggaggtgaagaagcctggggcctcgagtgaaggtttcctgcaaggcttcaggatacaccttnactaggtatgctatacagttggtgcgcacgggccccggacgaaaggcttggagtggatgggagtgatacgaacgctaggctaagtaggtaaacacgaaaaaattcaacgtaagtaacgttaccgaagggacaaggtacgtacgtaccgttaacagggtaacaacgagtacccgacggaaggtactttaacgttagtaacgtacgggagtacgttaggaacgtacggtaacgtccgtaggtaacggaacgttacccggaaacggtaacccgtaccgggtaacgttacggtttaaacgtttttacggtttttacgggtaacggtacccgttaaacccgtttacggttaacgttaacggggtaacgggtttaccgttaaagttttaacccggtttaaacggttacccgttaacgtttaaaaccgtttttcgaacccggtttacccgggtcgggggtaaaccccgttaaacgggggtaaccccccgtttacggggttaaccccgttaccccggttacccggttccccgtttaaaccccggg

SEQ ID NO: 260272 - DNA, 629 bp, Homo sapiens
  misc_feature: GYAE6OF01B9DPE.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacatttgggtgcgccaggccccggacaaaggcttgagtggatgggatggatcaacgctggcaagtggtaaacaacaaaaattcaacagaacgttccgagggcaggacgtcacctttacgaggacacactccgacgaggtattacttatagtggagtctgagcagcctaggacgacgtaccggaaagaccgtaacggcttagttatttagttttttaggcggtaccgtaccgttacgttaggttacgggtaggttaccgttaatttaacgttaccggtacttacgttaagttttcgaccgtttcccggacggggtacccgaaacggggtaccccgttacgggtaccctacccggttccttcccgttacccg

SEQ ID NO: 260273 - DNA, 763 bp, Homo sapiens
  misc_feature: GYAE6OF01CVPOT.1.5.A05.1.454.CMB.1.raw
  modified_base (225)..(225): a, c, t, g, unknown or other
  misc_feature (225)..(225): n is a, c, g, or t
tcagacgagtgcgtcacgaccggtgctcgatttagatagatagacaggggacccaacaaccacatccctcctcagaacgcccccagagcacaaccgccccaccatggactggacctggaggattccttctttttggtggcagcagccacaggtgcccactcccaggtccagcttgtgcagtctgggctgaggtgaagagccgtggggcctcgagtgaaggttccngcaaggtcttcaggtataccacttcacgtaggtatgctatactagttgggtgccgccgacggccccgaacgaaggcttggaggtggagtggaagtggatacgacgcgtaggactaaagtacggtaaacaaacgtaaaaaattccgaaacgtaacggtaacgtttacccggaaagggtaaccgaaggtaacgttacccgtaaacccgtttaacgaacgggtaaccaacgtaacgtacccggacgtaagtaacttacttaagtagtaggagtcgtagtagacgtacgtacctaggaacgtacgtaacccggaaacgaccgtacggtaccgttagttaacgttttacgtttttacgggacgttaccggttaacccttaggttaacggttagggtacgtttaactagttttaaaccgtaccgttaaccgttacgtttaaacgtttacgggacccgtttaccgggttaccgggggtacccgttaaacgggtaaccccggtttacggtacccctaacccggtccccgtttcccgtaaccccggg

SEQ ID NO: 260274 - DNA, 755 bp, Homo sapiens
  misc_feature: GYAE6OF01B26EG.1.5.A05.1.454.CMB.1.raw
  modified_base (401)..(401): a, c, t, g, unknown or other
  misc_feature (401)..(401): n is a, c, g, or t
tcagacgagtgcgtcacgaccggtgctcgatttagatagatagacaggggacccaacaaccacatccctcctcagaacgcccccagagcacaacgccccaccatggactggacctggagatccttctttttggtggcagcagccacaggtcgcccactcccaggtccagcttgtgcagtcgtggggctggaggtagaagacgccgtggggcctgaggtgtaaggtttcctgcgaaggtcttacgaggtaactacctacctttacgacgtaggttatcgtacttaatactagtttgggcgccgaccgaccgggccccggaacaaaggtccgttaggaggtggagtgggatggatacgacggtcgtggactaagtaacggtaaacaaactaaaaattccgaanaaggtaacgttaccggaagggacgaacgtacgtacctaaccgtttaacgaacgggtacacgtacgtcccggagtaacggtaactttaacgttacgtaggtaggacgtacgtaggacgacgtaacgacgttagaacgaaccggttaccgaaacggaccgtaacgggttatttacgttacgttttagttttacggtaccgtaccggttacccgttagttacgggtaggtacggttacttaaggtttacgttaccgtacttaaccggtttaacgttccgtaccgttcccgggtacgggtaacccggtaaccgggttaacccgttcggtacccccgttccttcccgtcccgttacccg

SEQ ID NO: 260275 - DNA, 666 bp, Homo sapiens
  misc_feature: GYAE6OF01D4QY0.1.5.A05.1.454.CMB.1.raw
  modified_base (228)..(228): a, c, t, g, unknown or other
  misc_feature (228)..(228): n is a, c, g, or t
tcagacgagtgcgtcacgaccggtgctcgatttagatagatagacaggggacccaacaaccacatccctcctcagaacgcccccagagcacaaccgccccaccatggactggacctggaggatccttctttttggtggcagcagccacaggtcgcccactcccaggtccagcttgtgcagtcgtggggctggaggtagaagacgcgtcgggctgaggtagtacgttcngacgacgtctagagactacctctacacgttagtatcgtattatacgtaggttgggtcgcgtaccggacccggaccccgaaggaacggtcgttaggaggtggaggtacgggtagtaggtactacgtaacggtcgtgaacgtaagtacggaaaactaaaactaaaatcgaagtaacggtacgtacggaggacgtagtacctaccgttaaccgttacgacgtaccacgtacgtacggacgtagttactttacgtagtacgtaggacgttgagacgacacgtacgagacgtaaccgacgaacgcgacgtagttagttagtttgttacgacgtacgtacgttgtagtggtagtactacgttagacctcgtttagtacgttaccgtacgtccggggacggacgttaacccgggtacttcggaccgtttcctaccgtcctaaccg

SEQ ID NO: 260276 - DNA, 704 bp, Homo sapiens
  misc_feature: GYAE6OF01ARGCM.1.5.A05.1.454.CMB.1.raw
  modified_base (206)..(206): a, c, t, g, unknown or other
  misc_feature (206)..(206): n is a, c, g, or t
  modified_base (275)..(275): a, c, t, g, unknown or other
  misc_feature (275)..(275): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctgggctgaggtgaagagcctggggcctnagtgaggtttcctgcgagtctagagatacctaccttacacgtaggtatcgtactatactagttgggtcnccgccgacccggaccccggaagaaacggtcttaggagtggtaggtaggagtggactacgacggtcgtagactaagtaggtaaacaaaactaaaacttacaacgtaagtaacggttaccggaaggacaagtacgtacctaacctttacggagggacacgtacgtccggacgtagttacttacgttataggtaggagtcgtagtagcgtagcgtagagtacgtaccgaagaccgtaccgtagttagttaacgttttgttttacggacgtacccggttacgttacgtttacgggtacggttacggttaccttaaggtttacttaccgtacctttaacgttactttacccggaccgtttccgggtaccggggttacccggaaaccgggttacccgttacggtacccgttacccgtcccgttaccgtaccccgg

SEQ ID NO: 260277 - DNA, 822 bp, Homo sapiens
  misc_feature: GYAE6OF01DM07A.1.5.A05.1.454.CMB.1.raw
  modified_base (297)..(297): a, c, t, g, unknown or other
  misc_feature (297)..(297): n is a, c, g, or t
tcagacgagtgcgtcacgaccggtgctcgatttagatagatagacaggggacccaacaaccacatccctcctcagaagccccccagagcacaacgccccaccatggactggacctggaggatcctctttttggtggcagcagccacaggtgcccactcccaggtccagcttgtgcagtctggggctgaggtgaagaagccgtggggcctcagtgaaggtttcctgcaaggtcttcaggtataccaccttcgactaggtatgctatacagttgggtagccgtccgacggccccggaanaaacggtcttggaggtggagtggggaatgggactacgacgtcgaggactaagtacgaaacgaaaactaaaaagttaccgaagtaacgtaacgttacggaaacggtacgtaaggtaccgttaacccgttaacccgtttaaccggaaacgggtaccaaacgtacccggttacccgggtaacggtaaacggttaacccttttaacgtttaacggttaagggttaacgggtaaccggttaccgttaacgggaaccgtaacccgggtaccggtacccggtaagggtaacggtaacccgtaacccgggaaaacgtaacccgggtaaccggtacgttttaacggtttaattttttcgggttttaacgtaccggttacccgtaaccgtttacggttaacggtagggtacgttacgttaatttaacgtccgttactttacgtttaacgttacgttcccggttccgggaccgggtaacccggtaccccgggttaaccggttcggtaacccgttaccccgttccgtccgtacccgg

SEQ ID NO: 260278 - DNA, 280 bp, Homo sapiens
  misc_feature: GYAE6OF01EFEX6.1.5.A05.1.454.CMB.1.raw
  modified_base (95)..(95): a, c, t, g, unknown or other
  misc_feature (95)..(95): n is a, c, g, or t
  modified_base (261)..(280): a, c, t, g, unknown or other
  misc_feature (261)..(280): n is a, c, g, or t
tcagacgagtgcgtcacgaccggtgctcgatttagatagatagacaggggcagttccagatttcaactgctcatcagcagcctgcagtctgaagnttttgctagttttattactgtcagcagtataataactggcctccgacgttcggccaagggaccaaggtgaaatcaaacgactgtggctgcacatctgtcttcatccttcccgcatctgagagtgccgttctcgtggacggcgggctgggacaaggcgacagttagnnnnnnnnnnnnnnnnnnnn

SEQ ID NO: 260279 - DNA, 646 bp, Homo sapiens
  misc_feature: GYAE6OF01BC83D.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggttaagaagccgtggggcctcagtgaaggtttcctgcaaggcttcaggatacaccttcactaggtatgctatacattgggtgcgcacggccccggacaaaggcttgagtggatgggatggatcgaacgctggcaagtggaacaacaaaaattcaacaagaacgttaccgaggacagagtactaccgttaccgagggacacactccgacgaggtattacttatagtaggagcgtaggacgacgtacgcgtagacgtacgtaaccggaacgaccgcgtacgtagttaagttttagtttgaccgtccgtaccgttacgtacgggttagggtacgttactaacgtttacgttaccgtacttacgttaacgttccgtaccgttacggggttaccgggaacccgggtaacccggtaccggtaccggtacccgttacccgtccccgttcccgtccgtaacccccgg

SEQ ID NO: 260280 - DNA, 888 bp, Homo sapiens
  misc_feature: GYAE6OF01DQ0NZ.1.5.A05.1.454.CMB.1.raw
  modified_base (226)..(226): a, c, t, g, unknown or other
  misc_feature (226)..(226): n is a, c, g, or t
  modified_base (249)..(249): a, c, t, g, unknown or other
  misc_feature (249)..(249): n is a, c, g, or t
tcagacgagtgcgtcacgaccggtgctcgatttagatagatagacaggggacccaacaaccacatccctcctcagaagcccccagagcacaaccgccccaccatggactggacctggaggatccttctttttggtggcagcagccacaggtcgcccactcccaggtccagcttgtgcagtctggggctgaggtgaagagccgtggggcctcagtgtaaggtttccngcaaggcttcaggatacaccttnactaggtatgactatacagttgggtgcgccacggccccggacaaaggcttggagtggatgggatggatcgaacgcgtggacaagtggtaaacaacgtaaaaaattcacaagtaacgttaccgaggggacaaggacgttaccgtaaccttttaaccgaaggggtaccaaccgacgttacccggacggtaaacgggtaacttttaaccgtttaagttaagttacggggtaacgtcccggttaggaacggtaccgaacggtaccccgttagggaacggtaacgttaccccgggaaaacggtaacccggtaaaccggggtacccgtttaagggttttaacgttttaaacggttttttttttcgggtaaccggttacccgggttaaccccgttttaccgggtttaaggggtttacggggggttaaccgggttttaacgtttaaaccgttttttaaaaccggttttaacccggttaccgttttaacccggtttaaaaacgttttttacgggttaaaccccgtttccccggggtttaaccggggggggttaaccccccgtaaaccgggggggttaaaccccccgtttacgggggtttaccccggtaaaacccccggttttccccgtttcccccgttaaaccccggg

SEQ ID NO: 260281 - DNA, 678 bp, Homo sapiens
  misc_feature: GYAE6OF01AGW0P.1.5.A05.1.454.CMB.1.raw
  modified_base (288)..(288): a, c, t, g, unknown or other
  misc_feature (288)..(288): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccggcttgtgcagtctggggctgaggtgaagaagcctggggcctcagtgaaggtttcctgcaaggcttcaggatacaccttcacgtaggtatgctatacagttgggtgcgccacggcccccgganaaaggcttgaggtggacgtggggatggatcgaacgcgtggacaagtaggtaaacaaactaaaaaacttcaacgaagtaacgttccgaagggccaggacgtcctaaccttaccgaggacacacgtccgcgaggatttacttatagtggagcgtgacgcgacgtccgtagacgtacgtaccgaagaccgacgggtacttaggttaatttagtttttggtacggtaccgttaccgttacgttaaggttcgggaagtttaccgtaagttttacgttaaccggtcctttacgttaacgttttaccggaccgttcccgggtaccggggtcccggaaaccgggtaaccccgtttcggggtaccccttacccggttcccttcccgtacccgtacccgg

SEQ ID NO: 260282 - DNA, 569 bp, Homo sapiens
  misc_feature: GYAE6OF01DI3QA.1.5.A05.1.454.CMB.1.raw
  modified_base (270)..(270): a, c, t, g, unknown or other
  misc_feature (270)..(270): n is a, c, g, or t
  modified_base (285)..(285): a, c, t, g, unknown or other
  misc_feature (285)..(285): n is a, c, g, or t
  modified_base (388)..(388): a, c, t, g, unknown or other
  misc_feature (388)..(388): n is a, c, g, or t
  modified_base (408)..(408): a, c, t, g, unknown or other
  misc_feature (408)..(408): n is a, c, g, or t
  modified_base (424)..(424): a, c, t, g, unknown or other
  misc_feature (424)..(424): n is a, c, g, or t
  modified_base (455)..(455): a, c, t, g, unknown or other
  misc_feature (455)..(455): n is a, c, g, or t
  modified_base (479)..(479): a, c, t, g, unknown or other
  misc_feature (479)..(479): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactccccaggtccagcttgtgcagtctggggctgaggtgaagaagcctggggcctcagtgaaggtttcctgcaaggcttcaggatactaccttcactaggtatgctatacattgggtncgccaggccccgganaaaggcttgagtggatggatggatcaacgctggcaatggtaacaacaaaaaattcaacagaagttccagggacagagtacacctttacagggacacataccgngaggattacttatatggagntagagactagcctganataccgaagacacggcttagtattattttgngtcgtacctagttaggtggaggtntaacgtttatacgtctacgtaatttgacgttcccgtggggaccctaacggggaacccttcgggttaccacccggttcctcccgtaacccg

SEQ ID NO: 260283 - DNA, 514 bp, Homo sapiens
  misc_feature: GYAE6OF01AX8S9.1.5.A05.1.454.CMB.1.raw
  modified_base (479)..(479): a, c, t, g, unknown or other
  misc_feature (479)..(479): n is a, c, g, or t
  modified_base (509)..(509): a, c, t, g, unknown or other
  misc_feature (509)..(509): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatgggatggatcaacgctggcaatggtaacacaaaaaattcaacagaagttccagggcagagtcactttaccagggacacatccgcgaggattactatatggagctgagcagcctgagatccgaagacacggctgtatatttttgtgcgactctagtggagtcattattacgctcaatttnactctggggccagggaccctggtcaccgtntcctc

SEQ ID NO: 260284 - DNA, 722 bp, Homo sapiens
  misc_feature: GYAE6OF01DWQ8I.1.5.A05.1.454.CMB.1.raw
  modified_base (135)..(135): a, c, t, g, unknown or other
  misc_feature (135)..(135): n is a, c, g, or t
  modified_base (228)..(228): a, c, t, g, unknown or other
  misc_feature (228)..(228): n is a, c, g, or t
  modified_base (361)..(361): a, c, t, g, unknown or other
  misc_feature (361)..(361): n is a, c, g, or t
tcagacgagtgcgtcacgaccggtgctcgatttagatagatagacaggggacccaacaaccacatccctcctcagaacgcccccagagcacaaccgccccaccatggactggacctggaggatcctctttttggnggcagcagccacaggtcgcccactcccaggtccagcttgtgcagtcgtggggctgaggtgaagagccgtggggcctgagtgtaacggtttccngcaaggctttcgaggactaccgtaccttcgaacgtaggttatcgacttatacgtagttgggtcgccgccgacgggaccccggaagaaacggtcttaggaggtcggtagtggggtagttagggactacgaacgngttacggacgtaagtacggtaaacaaacgtaaaaaacttcgaacgtaacgtaacgttaccgaagggtacgaagtacggtaccctaaccgtttaccgaacgggaccgagtaccgtccggaacggtacggtaacttacgttaagtacgtagggacgtaccgtagacgcgacgtaccgttaggacgtactaccggaaggtaccgtacggccttagttagtttacgttttagcggtaccgtacgtcggttaagtcggtagttacgtatttacgtaccgacttacgttattaccggtacgttccgggacgggttacccgtaccgggtaccccgttggttaaccctcccggttacgtcccgtacccg

SEQ ID NO: 260285 - DNA, 577 bp, Homo sapiens
  misc_feature: GYAE6OF01DJJY1.1.5.A05.1.454.CMB.1.raw
  modified_base (222)..(222): a, c, t, g, unknown or other
  misc_feature (222)..(222): n is a, c, g, or t
  modified_base (284)..(284): a, c, t, g, unknown or other
  misc_feature (284)..(284): n is a, c, g, or t
  modified_base (406)..(406): a, c, t, g, unknown or other
  misc_feature (406)..(406): n is a, c, g, or t
tcagacgagtgcgtcacgaccggtgctcgatttagatagatagacaggggacccaacaaccacatccctcctcagaacgcccccagagcacaacgccccaccatggactggacctggaggatcctcttttggtggcagcagccacaggtgcccactcccaggtccagcttgtgcagtctggggctgaggtgaagaagcctggggcctcagtgaaggtttccngcaaggcttcaggatacaccttcactaggtatgctatacattgggtgcgccacggccccganaaaggcttgagtggagtgggatggatcaacgcgtggcaatggtaacacaaaaattcacagaagttccagggacagacgtctaccttacagggacacatccgcgagtacttacttatagtganctgagcaagcctgagactccgaagacacgctagtacttagttttgtgcgtactgttacgtggtaggtctaattacgtacgtacttacgtaacgttttcgaccttcggtacggggtacccaacggggtaaccccgttcggttacccaaccccggttcgttcccctaacccgg

SEQ ID NO: 260286 - DNA, 519 bp, Homo sapiens
  misc_feature: GYAE6OF01BTGKU.1.5.A05.1.454.CMB.1.raw
  modified_base (411)..(411): a, c, t, g, unknown or other
  misc_feature (411)..(411): n is a, c, g, or t
  modified_base (429)..(429): a, c, t, g, unknown or other
  misc_feature (429)..(429): n is a, c, g, or t
  modified_base (471)..(471): a, c, t, g, unknown or other
  misc_feature (471)..(471): n is a, c, g, or t
  modified_base (487)..(487): a, c, t, g, unknown or other
  misc_feature (487)..(487): n is a, c, g, or t
tcagacgagtgcgtcacgaccggtgctcgatttagatagatagacagggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatgggatggatcaagctggcaatggtaacacaaaaaattcacaagaagttccaggcagagtcacttaccaggacacatccgacgaggattacttatatgagctgagcagccngagatacgaagacgacgntgtattattttgtgtcgtactctagtgaggtcattattacgntactattgacttccgngggcacgggacctggtacctcgtctcgtaccg

SEQ ID NO: 260287 - DNA, 544 bp, Homo sapiens
  misc_feature: GYAE6OF01B07DV.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggccccggacaaaggcttgagtggatgggatggatcgaacgctggcaatggtaaacaacaaaaaattcaacagaagttccagggcagagtcactttaccagggacacatccgcgaggattactatatggagctgagcagcctgagatccgaagacgacggctagttattagtttttgtgtcgtacctcgtagtggaggtctagtttatacgtctacgtaatttgactcgtcgggaccacgggtaccctgggtaccaccgttctccgtaccg

SEQ ID NO: 260288 - DNA, 725 bp, Homo sapiens
  misc_feature: GYAE6OF01BFEGL.1.5.A05.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
  modified_base (228)..(228): a, c, t, g, unknown or other
  misc_feature (228)..(228): n is a, c, g, or t
  modified_base (232)..(232): a, c, t, g, unknown or other
  misc_feature (232)..(232): n is a, c, g, or t
  modified_base (255)..(255): a, c, t, g, unknown or other
  misc_feature (255)..(255): n is a, c, g, or t
  modified_base (271)..(271): a, c, t, g, unknown or other
  misc_feature (271)..(271): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagctgggcctnagtgagttcngcagctcagntacncttnactaggtatgctatacattggtncgccacggccccgganaaaggcttgagtggagtgggatggatcgaacgtctggacaataggtaaacaactaaaaaacttcaactaagaacgttaccgagggacagacgtactaacccgtttacgaacgggaccaactacgttacccggacggtaagggtaactttaacttaacgttaactagggtacgtacgttaggaacgtacgtaacgtcccgttagggaacgtaaccgtacccggaaaacgtacccgaaccggggttaccgttaaggtttaacgttttaacgtttttttacgggtaccggtaccggtttaaccccgtttaggttaacgggttacgggtagggttactaagttttaacgttaccggtactttaacgtaacgttttcggaaccgtttcccggtaccgggggtaccctaacggggtaacccgttcggtaacccgtacccgtttccgtacccggttacccg

SEQ ID NO: 260289 - DNA, 182 bp, Homo sapiens
  misc_feature: GYAE6OF01BA9XK.1.5.A05.1.454.CMB.1.raw
  modified_base (180)..(182): a, c, t, g, unknown or other
  misc_feature (180)..(182): n is a, c, g, or t
tcagacgagtgcgtcacgaccggtgctcgatttagatagatagacagggcaccaagggcccatcgatcttccccctggcaccctcctccaagagcacctctgggggcacagcggccctgggctgcctggtcaaggactacttcctgtcgagcgtctgagcgggctggcaaggcgcatagnnn

SEQ ID NO: 260290 - DNA, 697 bp, Homo sapiens
  misc_feature: GYAE6OF01BYY0I.1.5.A05.1.454.CMB.1.raw
  modified_base (271)..(271): a, c, t, g, unknown or other
  misc_feature (271)..(271): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtctgggctgaggtgaagagccgtggggcctcagtgtaagtttcctgcaaggcttcgaggatacaccttcacgtaggtatgctatacattgggtncgccgacggccccgacaaaggcttgacgtggagtgggactggatcgaacgcgtggacgaagtacggtaacaaacaaaaaattcaaacagtaacgttaccgagggtacaagagtactaccgtttaacagggacacgactaccggacgacgtactttaacgttataagtggtacgcgtagacgtacgacgtcgtacgacgtaacgtaccggaaacgaccgtacggtacgttagttaagttttacgtttttggtacggtaccgttaaccgttacgtttaacggtcggggttaacggttccttaaacgtttacgttaaccggttacttacgttaacgttttacgtaccgtttacccggtccggggtacccggtaaacgggttaaccccggttcggtaacccgttacccggttccgttacccgtaacccgg

SEQ ID NO: 260291 - DNA, 534 bp, Homo sapiens
  misc_feature: GYAE6OF01AZ203.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatgggatggatcaacgctggcaatggtaaacacaaaaaattcaacagaagttccagggcagagtcacctttacagggacacatccgcgaggattacttatatggagctgagcagcctgagatccgaagacacggctgtatatttttgtgcgtacctctagtggaggtcagttattacgcttactaatttgactccgtggggtccacgggtaaccctggtacaccgtctccgtaccg

SEQ ID NO: 260292 - DNA, 180 bp, Homo sapiens; identical to SEQ ID NO: 259970
  misc_feature: GYAE6OF01E1VLG.1.5.A05.1.454.CMB.1.raw
  modified_base (178)..(180): a, c, t, g, unknown or other
  misc_feature (178)..(180): n is a, c, g, or t

SEQ ID NO: 260293 - DNA, 835 bp, Homo sapiens
  misc_feature: GYAE6OF01C52YR.1.5.A05.1.454.CMB.1.raw
  modified_base (230)..(230): a, c, t, g, unknown or other
  misc_feature (230)..(230): n is a, c, g, or t
tcagacgagtgcgtcacgaccggtgctcgatttagatagatagacaggggacccaacaaccacatccctcctcagaacgcccccagagcacaacgccccaccatggactggacctggagatcctcttttggtggcagcagccacaggtgcccactcccaggtccagcttgtgcagtcgtggggctgaggtagaagaacgccgtggggcctcgaggtgtaacggttttccngacgaaggtcttcgaaggactaccaccttcacgtaggtatgactatactagttgggtcgccgccgaccggccccggaagaaacggtcttaggacggtggaagtgggagttggaacgtcgaacgcgtaggactaagtaggtaaacaaactaaaaaattccgaagtaacgtaacgttaccgaagggtacaaggtaacgtacctaaccgttaccgaagggtaccaacgtacgtacccggacggtaacggttaacttacgtttaagtacgttacgggtacgtaccgttaggaacgtacaacgtaccgttacggaacgtaaaccgttaccggaaacggtaccgtaacccgggttactttaacggttttaaacggtttagttttttaccggtaccggttaccggttacccgttaacggttagggtttaaccgggttacggttaacgtttaaaccgttttaacgtttacccggtacgtttaaccgtttaaacggttttacccggtaacccggtttcccggggtacggggtaaccccggttaacccgggggtaacccggttttaccgggttaaccccgttacccccggttcccgttaccccgtaacccccggg

SEQ ID NO: 260294 - DNA, 678 bp, Homo sapiens
  misc_feature: GYAE6OF01DOKPM.1.5.A05.1.454.CMB.1.raw
  modified_base (133)..(133): a, c, t, g, unknown or other
  misc_feature (133)..(133): n is a, c, g, or t
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
  modified_base (239)..(239): a, c, t, g, unknown or other
  misc_feature (239)..(239): n is a, c, g, or t
  modified_base (248)..(248): a, c, t, g, unknown or other
  misc_feature (248)..(248): n is a, c, g, or t
tcagacgagtgcgtcacgaccggtgctcgatttagatagatagacaggggacccaacaaccacatccctcctcagaacgcccccagagcacaacgccccaccatggactggacctggaggatcctcttttggnggcagcagccacaggtgcccactcccaggtccagcttgtgcagtcgtggggctgaggtgaagagcctggggcctnagtgaggttccngcaggctcagatacncctnactaggtangctatacatgggtcgcgccgaccggcccgaacgaacggtcgtagaggtaggaggtggagtaggagtcgaacgtcgtaggactaagtacggtaaacaaactaaaaattacaacgtaagtaaacgttaccgagggacaaggtacgtactaccgttaaccgaggaaccactacgtaccggacggaggtaacttacgttaagtacgtaggtacgtacgtagaacgcgtacgccgtaagacgtaacgtacgaacgtaccggacgtcgttagttatttgttttacggacgttacggtaccgttacgttagggtacggtaggttactagtttacgttcgtacgttacttaacggtttctaaccgttccgggtacggggtaacccggaccgggttacccggttacggtacccgtacccggttcctcccgttaacccgg

SEQ ID NO: 260295 - DNA, 720 bp, Homo sapiens
  misc_feature: GYAE6OF01CKN31.1.5.A05.1.454.CMB.1.raw
  modified_base (278)..(278): a, c, t, g, unknown or other
  misc_feature (278)..(278): n is a, c, g, or t
  modified_base (294)..(294): a, c, t, g, unknown or other
  misc_feature (294)..(294): n is a, c, g, or t
tcagacgagtgcgtcacgaccggtgctcgatttagatagatagacaggggacccaacaaccacatccctcctcagaacgcccccagagcacaaccgccccaccatggactggacctggagatccttctttttggtggcagcagccacaggtgcccactcccaggtccagcttgtgcagtctggggctgaggtgaagagccgtggggcctcagtgaaggtttcctgcgaaggtcttcgaggactaccaccttcactaggtatgctatactagttgggtncgccacggccccgganaaacggtcttgaggtggagtgggatggatcgaacgcgtaggactaagtaggtaaaccaaacgtaaaaaaagttcaaactaacggaaacgttccgaagggacaagacgtacctaaccgtttaaccgaagggaccaacacgtcccgacggaggtactttaacgttaagtagtaggtacacgtagaacgcaacggccttaggaacgtacgtaccggaaagaccgtaacggtcgttaagttaacgttttagtttttacggtacgtaaccgtacccgttcgttaagggttcgggtaacgttacgttaacgtttagtttaccgtacttacgtttaaacgtttacgtaacccggtttcccgggtacgggggtacccctaacggggttaaccccgttcgggttacccgtacccggtttcctaccccggtacccg

SEQ ID NO: 260296 - DNA, 180 bp, Homo sapiens
  misc_feature: GYAE6OF01AXVNW.1.5.A05.1.454.CMB.1.raw
  modified_base (179)..(180): a, c, t, g, unknown or other
  misc_feature (179)..(180): n is a, c, g, or t
tcagacgagtgcgtcacgaccggtgctcgatttagatagatagacagggcaccaagggcccatcggtcttccccctggcaccctcctccaagagcacctctggggcacagcggccctgggctgcctggtcaaggactacttcctcgtactgcgctgagcgggctggcaaggcgcatagnn

SEQ ID NO: 260297 - DNA, 331 bp, Homo sapiens
  misc_feature: GYAE6OF01C4RRO.1.5.A05.1.454.CMB.1.raw
  modified_base (96)..(96): a, c, t, g, unknown or other
  misc_feature (96)..(96): n is a, c, g, or t
  modified_base (272)..(272): a, c, t, g, unknown or other
  misc_feature (272)..(272): n is a, c, g, or t
  modified_base (298)..(331): a, c, t, g, unknown or other
  misc_feature (298)..(331): n is a, c, g, or t
tcagacgagtgcgtcacgaccggtgctcgatttagatagatagacaggggcagttccagatttcaactgctcatcagcagcctgcagtctgaagtnttttgctagttttattactgtcagcagtaataataactcggccctccgacgttccggaccgaaagggaccgaaaggtggaaaactacgaaaacgaactggtaggctgaccactatctgtacttcactccttcccgctatcctgtactcgtacgtcgccgtctgggacggcgggtcnggaccgtaaggccgacaaggagcagnnnnnnnnnnnnnnnnnnnnnnnnnnnnnnnnnn

SEQ ID NO: 260298 - DNA, 701 bp, Homo sapiens
  misc_feature: GYAE6OF01EB2YM.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccacggccccggacgaaaggcttgagtggagtgggatggatcgaacgcgtggacaagtaggtaaacaactaaaaaattcaacaaggtaacgttaccgaaggggacaaggaacgtacctaacccgtttaaccgaacgggaccacacgtacccggacgaaggtaactttaacttaagttaagttacgggaagtacgttaggacgacgacgtcccgtaggaacgacgtaccgaagaccgacggtacttagttaatttgtttttacggtcgtaccgtaccgttcgttaggtacgggtaggttacgtaagtttaacgtttaccgactttacgttaaagttttcggaacccgtttcccgggtacgggggtaaccccgtaaccggggtaacccccgttacgggtacccggtaccccgttcccgtcccgttaaccccgg

SEQ ID NO: 260299 - DNA, 178 bp, Homo sapiens
  misc_feature: GYAE6OF01B8490.1.5.A05.1.454.CMB.1.raw
  modified_base (177)..(178): a, c, t, g, unknown or other
  misc_feature (177)..(178): n is a, c, g, or t
tcagacgagtgcgtcacgaccggtgctcgatttagatagatagacagggcaccaagggcccatcggtcttcccctggcaccctcctccaagagcacctctggggcacagcggcctgggctgcctggtcaaggactacttcctatgtatactctgagcgggctggcaaggcgcatagnn

SEQ ID NO: 260300 - DNA, 756 bp, Homo sapiens
  misc_feature: GYAE6OF01DK6TF.1.5.A05.1.454.CMB.1.raw
  modified_base (229)..(229): a, c, t, g, unknown or other
  misc_feature (229)..(229): n is a, c, g, or t
tcagacgagtgcgtcacgaccggtgctcgatttagatagatagacaggggacccaacaaccacatccctcctcagaacgcccccagagcacaacgccccaccatggactggacctggatgatccttctttttggtggcagcagccacaggtcgcccactcccaggtccagcttgtgcagtcgtggggctggaggtagaagagccgtgggcctgagtgtaacggtttccngacaaggtcttacgaggtactacctacctttcaacgtaggtatgactatactagttgggtcgccgtccgacggcccccggaacgaaacggtccgttaggaggtgggagttgggagtggatacgaacgcgtaggactaaagtacggtaaacaaaactaaaaacttcgaacgtaaggtaacgttaccgagggactagggtacgttacctaaccgtttaaccgaagggtaccaacgtacgtacccggacggtaagtaactttaacgttaacgtaagtagggtaacgtcgtaggaacgccgtaacgtacctaggaacgtaccgttaaccggaacgaccggaacggtcgtttagttaattttacgttttcggacgttacccgtaccgtttagtaacgggttggtaacggttattaacgtttacgttaaccgtacgttaacgttaagtttcggtacccgttcccgggtacggggtaccccgtaacgggttaaccccgttgggttacccctacccggttcccgttaacccccgg

SEQ ID NO: 260301 - DNA, 724 bp, Homo sapiens
  misc_feature: GYAE6OF01ABYVI.1.5.A05.1.454.CMB.1.raw
tcagacgagtgcgtcacgaccggtgctcgatttagatagatagacaggggacccaacaaccacatccctcctcagaagcccccagagcacaacgcccaccatggactggacctggaggatcctcttttggtggcagcagccacaggtgcccactcccaggtccagcttgtgcagtctgggctgaggtgaagagcctggggcctcagtgaaggtttcctgcaaggcttcaggatacaccgttcactaggtatgctatacagttggtgcgcctaggccccggacaaaggccttgagtggagtgggatggatctaacgctggacagtcggtaacaactaaaaattcaactagaaacgttccgaggggcaggtagtaccgtaccgtttaaccgaggggtaccacgtaacgtacccggcggtaacggtaactttaccgtttaagtaacgtagggtaacggtcgtaggttaacggaccgtacgggtaaccccgtgggtaaccggtaacggttacccgggtaaacgtaacccgtaaccggggttaccctagggtttaattacggttttttacgggacggtaccgtaccgttacgttaggtacgggtacggttacgtattaacgttaccggtacgtacgtttaaacgttcggtaaccgttccgttaccgggggtaccctaaccggggtaacccgtttcggtacccgtacccggttcgttccccgtaacccgg

SEQ ID NO: 260302 - DNA, 179 bp, Homo sapiens; identical to SEQ ID NO: 259987
  misc_feature: GYAE6OF01BUFWA.1.5.A05.1.454.CMB.1.raw
  modified_base (178)..(179): a, c, t, g, unknown or other
  misc_feature (178)..(179): n is a, c, g, or t

SEQ ID NO: 260303 - DNA, 624 bp, Homo sapiens
  misc_feature: GYAE6OF01AD1C3.1.5.A05.1.454.CMB.1.raw
  modified_base (211)..(211): a, c, t, g, unknown or other
  misc_feature (211)..(211): n is a, c, g, or t
  modified_base (225)..(225): a, c, t, g, unknown or other
  misc_feature (225)..(225): n is a, c, g, or t
  modified_base (292)..(292): a, c, t, g, unknown or other
  misc_feature (292)..(292): n is a, c, g, or t
  modified_base (420)..(420): a, c, t, g, unknown or other
  misc_feature (420)..(420): n is a, c, g, or t
tcagacgagtgcgtcacgaccggtgctcgatttagatagatagacaggggacccaacaaccacatccctcctcagaacgcccccagagcacaacgccccaccatggactggacctggaggatccttctttttggtggcagcagccacaggtgcccactcccaggtccagcttgtgcagtctgggggctgaggtgaagagccgtggggcctnagtgaaggtttccngcaaggcttcgaggatacaccttcacttaggtatgctatacattgggtgcgccgacggccccggaanaaggcgtggagtggagtgggatggactcgaacggcgtggcaagtacggtaaacaactaaaaaattcaacgagaagttaccgagggcagagtccacttacgaggacacactcgcgacggtattacttanagtggagtctagagcagctagagactaccgagacgacgtctaggttatttagttttggcgtaccgttaccgtacgttaggttacgggtagttcgtaagtttacttaccggtcttaaccgttaagtttacgaaccgtttccggtacgggggtaacccgtacggggtaaccccgttgggtaccctacccggttcctcccgtacccg

SEQ ID NO: 260304 - DNA, 601 bp, Homo sapiens
  misc_feature: GYAE6OF01EI0EK.1.5.A05.1.454.CMB.1.raw
  modified_base (221)..(221): a, c, t, g, unknown or other
  misc_feature (221)..(221): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttccngcaaggcttcaggatacaccttcactaggtatgctatacattgggtgcgccaggccccggacaaacggcttggagtggatggggatgggatcgaacgctggcaatgggtaacaacaaaaaaattcaacagaacgttccaggggcaagagtcacctttacagggacacatccgcgagattacttatatggagctgagcagcctgagactccgaagacgacggacttggtaattcgttttagtcggtacgtacccttgttaaggtgggtacggtctaagttagtttaaccgtcttacgtaagttttagaccttccgtacgggggtccgaaacggggtaaccccgttacgggttaccgacccggtttcccgcccgttacccgg

SEQ ID NO: 260305 - DNA, 772 bp, Homo sapiens
  misc_feature: GYAE6OF01CKWVU.1.5.A05.1.454.CMB.1.raw
  modified_base (219)..(219): a, c, t, g, unknown or other
  misc_feature (219)..(219): n is a, c, g, or t
tcagacgagtgcgtcacgaccggtgctcgatttagatagatagacaggggacccaacaaccacatccctcctcagaagcccccagagcacaaccgccccaccatggactggacctggaggatccttcttttggtggcagcagccacaggtgcccactcccaggtccagctgtgcagtcgtgggctggaggtgaagagcgtgggctcagtgaggtttccngcaaggcttacgagatacaccttcactaggtatgctatacattgggtcgcgccacggccccggaagaaaggcttgaggtggaagtgggagtggattacgaacgtcgtggacaaagttaggtaaacaacgtaaaaaaagtttccaaagtaacgtaaacggtttacccgaaagggggacctaaggtaacgttaccctaacccgttttaaccgaacggggtaaccaaccgtaacgttacccggacggtaacgggttaatttaaccgtttaagtaacggttgggaacgtcgttaggaaggtaccgaacggccttagggaacgaacgtaaccggaaagtaccggaacggtacgttacgtttaattttaggtttttacggtcggtacccgttaacctttacggttaggttagggtacgttacgtacgttttaactaccggttaacgttaccgttaaatttacgggttaacccttcccgggttaggggggtaaccccctaagggggttaaccccccgttagggttacccgtaaccccggtttccgtacccgttaccccgg

SEQ ID NO: 260306 - DNA, 783 bp, Homo sapiens
  misc_feature: GYAE6OF01DD6UC.1.5.A05.1.454.CMB.1.raw
  modified_base (219)..(219): a, c, t, g, unknown or other
  misc_feature (219)..(219): n is a, c, g, or t
tcagacgagtgcgtcacgaccggtgctcgatttagatagatagacaggggacccaacaaccacatccctcctcagaagcccccagagcacaacgccccaccatggactggacctggagatcctcttttggtggcagcagccacaggtgcccactcccaggtccagcttgtgcagtctggggctgaggtgaagagcctggggcctcagtgaaggtttccngcaaggcttcaggatacacctttcactaggtatgctatacattgggtgcgccacggccccggacaaaggcttggagtggagtgggatggatcgaacgcgtggcaagtaggtaaacaacgtaaaaaaattcaactaagtaacgtttaccgaagggtacaacgtaaggtacctaaacccgtttaacccgaacgggggaacctaacccgaacgttacccgggaccggaacgggttaacttttaaaccgtttaagttaacgttaggggtaacgtaccgtttaggaacggtaccgaacggtccccgttaagggaacggtaacgttaaccccggaaaaggaacccgtaacggggtaccgtttagtttaagttttaacggtttttttggttaccggtaccgttacccgttacgtttaacgggttagggttacgggttacttaagttttaacgttaccgttacttaccgttaaagttttcggtaacccgtttcccggtacgggggtaccccgtaaacggggttaacccccttagggttaccccttaaccccggttccgttccccgtaacccg

SEQ ID NO: 260307 - DNA, 759 bp, Homo sapiens
  misc_feature: GYAE6OF01EBJAZ.1.5.A05.1.454.CMB.1.raw
  modified_base (245)..(245): a, c, t, g, unknown or other
  misc_feature (245)..(245): n is a, c, g, or t
tcagacgagtgcgtcacgaccggtgctcgatttagatagatagacaggggacccaacaaccacatccctcctcagaacgcccccagagcacaaccgccccaccatggactggacctggaggatcctcttttggtggcagcagccacaggtgcccactcccaggtccagcttgtgcagtctggggctgaggtgaagagcctggggcctcagtgaaggtttcctgcaaggcttcaggatacaccttnactaggtatgctatacattggtgcgccacggccccggacaaaggcttgagtggatgggatggatcgaacgcgtggctaagtggtaaacaactaaaaaattcaacaagaacgttaccgagggtacgagacgtaccgaaccgttttaaccgaaggggaacctaaccgaacgttaccggacggtaagggtaactttaacgtttaagttaacgttacgggtacgtaccgttaggtaacgtaccgtaaggcccgtttagggaacgtaacgtacccggtaaaggacccggtaacgggtacttaggttaacgttttaacgttttttcggtacggtaccggttaacccgtttacgttacgggttacgggttacggttacctaaagtttacgtttaaaccgtaccgtttaccgtaaacgtttttacggtaccgtttccccggtaggggggtaccccttaaaccgggggtaaccccgtttacgggttaacccgaccccgggtttccctcccgtttaaccccggg

SEQ ID NO: 260308 - DNA, 532 bp, Homo sapiens
  misc_feature: GYAE6OF01D6JYY.1.5.A05.1.454.CMB.1.raw
  modified_base (452)..(452): a, c, t, g, unknown or other
  misc_feature (452)..(452): n is a, c, g, or t
  modified_base (472)..(472): a, c, t, g, unknown or other
  misc_feature (472)..(472): n is a, c, g, or t
  modified_base (484)..(484): a, c, t, g, unknown or other
  misc_feature (484)..(484): n is a, c, g, or t
  modified_base (491)..(491): a, c, t, g, unknown or other
  misc_feature (491)..(491): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggccccggacaaaggcttgagtggatgggatggatcaacgctggcaatggtaacacaaaaaattcacaagaagttccagggcagagtctacctttaccgagggacacatccgcgaggtattacttatatggagctgagcagcctgagatccgaagacgacggtctgtattagtttttgngtcgacttcgtagtggagtntattatacgctntaatttnactcgtgggccacgggtaccctggtaccacgtctcctaccg

SEQ ID NO: 260309 - DNA, 597 bp, Homo sapiens
  misc_feature: GYAE6OF01CFNKE.1.5.A05.1.454.CMB.1.raw
  modified_base (221)..(221): a, c, t, g, unknown or other
  misc_feature (221)..(221): n is a, c, g, or t
  modified_base (285)..(285): a, c, t, g, unknown or other
  misc_feature (285)..(285): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttccngcaaggcttcaggatacaccttcactaggtatgctatacattgggtgcgccgacggccccgganaaacggcttggagtggagtgggatggatcgaacgcgtggcaatggtaaacaactaaaaattcaacaagaagttccaggcagagtcaccttacagggtacacagtccgagaggtattacttatagtaggtacgcgtagagcacgtcctagagactaccgaagtaccacggcttgtattagttttgtcgtacgtacctcgtagtcggtaggtatagttagttacgtacttacgtaagtttcgtaccgttccggttacgggacccgtaaacggggtaccccttagggtaccctacccgttccgtcccgttacccg

SEQ ID NO: 260310 - DNA, 539 bp, Homo sapiens
  misc_feature: GYAE6OF01AGUS7.1.5.A05.1.454.CMB.1.raw
  modified_base (206)..(206): a, c, t, g, unknown or other
  misc_feature (206)..(206): n is a, c, g, or t
  modified_base (220)..(220): a, c, t, g, unknown or other
  misc_feature (220)..(220): n is a, c, g, or t
  modified_base (286)..(286): a, c, t, g, unknown or other
  misc_feature (286)..(286): n is a, c, g, or t
  modified_base (405)..(405): a, c, t, g, unknown or other
  misc_feature (405)..(405): n is a, c, g, or t
  modified_base (411)..(411): a, c, t, g, unknown or other
  misc_feature (411)..(411): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
  modified_base (434)..(434): a, c, t, g, unknown or other
  misc_feature (434)..(434): n is a, c, g, or t
  modified_base (440)..(440): a, c, t, g, unknown or other
  misc_feature (440)..(440): n is a, c, g, or t
  modified_base (453)..(453): a, c, t, g, unknown or other
  misc_feature (453)..(453): n is a, c, g, or t
  modified_base (472)..(472): a, c, t, g, unknown or other
  misc_feature (472)..(472): n is a, c, g, or t
  modified_base (525)..(525): a, c, t, g, unknown or other
  misc_feature (525)..(525): n is a, c, g, or t
  modified_base (530)..(530): a, c, t, g, unknown or other
  misc_feature (530)..(530): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctgggcctnagtgaaggtttccngcaaggcttcacggataccaccttcactaggtatgactatacattgggtgcgccgaggccccgganaaaggcttagagtggatgggatggatcgaacgcgtggcaagtggaacaacaaaaattcaacagaacgttcgagggcaggactacacctttacgaggacacactccgcgagtattactanatggantagagcacgcngagtnaccgaanacacgntagtattatttgngcgtactagtagtggagtntattctacgtctacgttattcgacttcgtcgggaccacggtaccctggtaccnccgtntccgtaccg

SEQ ID NO: 260311 - DNA, 814 bp, Homo sapiens
  misc_feature: GYAE6OF01ARAYH.1.5.A05.1.454.CMB.1.raw
  modified_base (234)..(234): a, c, t, g, unknown or other
  misc_feature (234)..(234): n is a, c, g, or t
  modified_base (290)..(290): a, c, t, g, unknown or other
  misc_feature (290)..(290): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttcctgcaaggcttcaggntacaccttcactaggtatgcctatactattgggtgcgaccgacggtcccccggaanaaagggtcctggagtggagtggggactggatcgaacgcgtggactaagtacggtaaacaaactaaaaaacttcgaaacaaggtaaacgttccgaaaggggtcaacggacgtaaccctaccgttttaacggacggggtaacccacgtaacgtcccggtacggtaacggtaactttaaccgttaattacggttaagggtaacgttcccgttaaggaacggtaccgtaacggtcccgttaggtaaggtaaccgtaacccggtaaacggacccgtaacgggtcccgtttaaggtttaacgtttttaacggttttttggtaccggtacccggttaaccgttccggttaaagggttcgggaacgggtttacctaaggttttacgttaacccggtcgtttaaacgttaagttttacccgggttaacccgtttcccgggttaccggggtaaccccggtttaaaccgggggttaacccccgttacggggtttaccccggaaccccggtttccgttccccggttaaaccccggg

SEQ ID NO: 260312 - DNA, 568 bp, Homo sapiens
  misc_feature: GYAE6OF01DBHIS.1.5.A05.1.454.CMB.1.raw
  modified_base (283)..(283): a, c, t, g, unknown or other
  misc_feature (283)..(283): n is a, c, g, or t
  modified_base (341)..(341): a, c, t, g, unknown or other
  misc_feature (341)..(341): n is a, c, g, or t
  modified_base (452)..(452): a, c, t, g, unknown or other
  misc_feature (452)..(452): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccgganaaaggcttgagtggatgggatggatcaacgctggcaatggtaaacacaaaaaattcanagaagttccagggcagagtcacctttacagggacacatccgcgaggattaactatatggagctgagcagccctagagactaccgaagaccgacggctagtattatttttgngtcgtactcgtagtggtaggtctaattacgttacgctacgtaaagttttcgacgttccggtacggggcccaacggggtaccccttagggtaccctaacccggtcttcccgtacccg

SEQ ID NO: 260313 - DNA, 640 bp, Homo sapiens
  misc_feature: GYAE6OF01BYPH8.1.5.A05.1.454.CMB.1.raw
  modified_base (226)..(226): a, c, t, g, unknown or other
  misc_feature (226)..(226): n is a, c, g, or t
  modified_base (295)..(295): a, c, t, g, unknown or other
  misc_feature (295)..(295): n is a, c, g, or t
  modified_base (305)..(305): a, c, t, g, unknown or other
  misc_feature (305)..(305): n is a, c, g, or t
tcagacgagtgcgtcacgaccggtgctcgatttagatagatagacaggggacccaacaaccacatccctcctcagaacgcccccagagcacaacgccccaccatggactggacctggaggatcctcttttggtggcagcagccacaggtgcccactcccaggtccagcttgtgcagtcgtggggctggaggtgaagaagccgtggggcctcgagtgaaggtttccngcaaggtcttcgaggtactacacctttcactaggtatgctatacattgggtgcgccgacggccccgganaaaggctagnggtggatgggatggatccaagcgtggacaatggtaacaacaaaaattcaacagaagtccgaggacagagtacctaacgttaccgaagggaccacacgtccgagaggtattactatagtggagcgttagagacgacgtcgtagaacgacgtaccgaacgtacacgggtacttagtactttaagttttcgaggtaccgtaccgttcgtaaggtcggtacgttagtacgtttaagttacccgtgttaacgttaacgtttcgaacccgttcgggtacgggtacccgtaacgggtaacccccggttacggttccctaacccggttcctccggtaaccccg

SEQ ID NO: 260314 - DNA, 582 bp, Homo sapiens
  misc_feature: GYAE6OF01BZSN8.1.5.A05.1.454.CMB.1.raw
  modified_base (404)..(404): a, c, t, g, unknown or other
  misc_feature (404)..(404): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggagtgggatggatcaacgctggcaagtggtaaacaacaaaaaattcaacagaagttcagggcagagtcacctttaccagggtacacatccgcgaggattactatanggagctgagcagcctgagataccgaagacgacggcttagttattagtttttgtcggtcgtaccgttcttaggtgggtagttcgtaagtttaagttaccgtcgttacgtaactttgtacttccggtcggggtacctacggggtaaccctcgggttaccacccgttccgtcccgtacccg

SEQ ID NO: 260315 - DNA, 871 bp, Homo sapiens
  misc_feature: GYAE6OF01CSPEE.1.5.A05.1.454.CMB.1.raw
  modified_base (272)..(272): a, c, t, g, unknown or other
  misc_feature (272)..(272): n is a, c, g, or t
  modified_base (289)..(289): a, c, t, g, unknown or other
  misc_feature (289)..(289): n is a, c, g, or t
tcagacgagtgcgtcacgaccggtgctcgatttagatagatagacaggggacccaacaaccacatccctcctcagaacgcccccagagcacaacgccccaccatggactggacctggaggatcctcttttggtggcagcagccacaggtgcccactcccaggtccagcttgtgcagtctggggctgaggtgaagaagcctggggcctcagtgtaaggtttcctggcaaggtcttcgaggatacaccttcactaggtatgctatacattgggngcgccgaggccccgganaaaggcttgagtggagtgggatggatcgaacgcgtggcaagtacggtaaacaactaaaaaattcaacgtaacgtaacggttaccgaaggggaccaaggtaacgttacccgtaacccgttttaacccggaacggggtaccctaaccgtaacgtaccccggaacgggtaacgggttaaccgttttaaaccgtttaacgttaacggttacggggtaacggtaccgttacgggaacggtaccgtaaacgggtccccgtaggggaaacggtaaccgttaccccgggaaaggtaacccggaacccgggtacgtttaacgggtttaaacgtttttaacggtttttttacgggtacggttacccgggtttaacccgttacggtttaaaccggggtttaacggggtacgggtttaccgtaagtttttaaaccgttaaccggttacccgtttaacgttaaacgttttttacccggaaacccggtttccccggggttaaccggggggtaaccccggttaaccgggggtaaaccccccgtttacggggttacccccgtaaaccccggtttcccgttaccccgttaaaccccggg

SEQ ID NO: 260316 - DNA, 731 bp, Homo sapiens
  misc_feature: GYAE6OF01A61B7.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtctggggctgaggtgaagagccgtggggcctcagtgaacggtttcctgcgaaggcttcgaggatacgaccttcacgtaggtatgctatactagttgggtcgcgccgacgggccccggacgaacggcttggaggtggagtggagtggatacgaacgtcgtggactaagtacggtaaacaactaaaaaattcgaacgtaacggtaaacggttaccgaaggggtacgaacggtacgttacccgtaaccgtttaacccggaaggggtaaccaacgtacgtaccggacgtaacgggttactttaacgttaagttagtagggtacgtacgtacggagtacgacgtacccgtagacggtacgtaccgaagtaccgtacggtcttagttactttagttttaggacgtaccgtaccgttagtaggtacggtacgttactaagtttacgttacggtacctttacgttaacgtttcggaccgttccgggtaccggggtaacccggtaaccggggttaccccttccggggtaaccgtttaccccggttccgttcccggttaccccg

SEQ ID NO: 260317 - DNA, 606 bp, Homo sapiens
  misc_feature: GYAE6OF01BI7DY.1.5.A05.1.454.CMB.1.raw
  modified_base (207)..(207): a, c, t, g, unknown or other
  misc_feature (207)..(207): n is a, c, g, or t
  modified_base (267)..(267): a, c, t, g, unknown or other
  misc_feature (267)..(267): n is a, c, g, or t
  modified_base (281)..(281): a, c, t, g, unknown or other
  misc_feature (281)..(281): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctnagtgaaggtttcctgcaggcttcaggatacaccttcactaggtatgctatacattgggtncgccacggcccganaaggcttgagtggatgggatggatcaacgctggacaatggtaaacaactaaaaaattcaacgagaagttccagggacagagtctaccttacgaggacacatccgcgagtattactatatggatcgtagagcgagacctagagtacgtaccgaaagccgtacggcttagttagttaatttttggacgtacgtacccgttgttacggtagggtacgttacgtaagtttaacgttaccgtacttacgtaagttttcggacctttcccggtacggggcccgtaacggggtaccccttgggtaccctaccccggttctcccggttacccg

SEQ ID NO: 260318 - DNA, 625 bp, Homo sapiens
  misc_feature: GYAE6OF01ARLZD.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttcctgcaaggcttcaggatacaccttcactaggtatgactatacagttgggtgccgccgacggcccccggaacaaacggcctttggagtgggagtgggatggatcgaacgcgtggacaagtggtaaacaacgaaaaattcaacagaacgttccgaagggcaagatacctaccgtttaaccgagggactacacgtaccgcgaaggtattaccgttagtagtcggagtctagacgcgacgcctggagacgtaccgagacgacggtctagtatttacgttttgacgtacgtaccgtacgttaggtacggtacgtctaagttacgtacgtactttacgtaacgtttgtacccttcggttacggggaccctaacgggtacccgttgggtaaccctcccgttccgtcccgtaccg

SEQ ID NO: 260319 - DNA, 646 bp, Homo sapiens
  misc_feature: GYAE6OF01CH1DL.1.5.A05.1.454.CMB.1.raw
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctnagtgaaggtttccngcaaggcttcgaggatacaccttnactaggtatgctatacattgggtcgcgccacggccccggacaaaggtcttgagtggagtgggatgggataccaacggcgtggactaatagggtaaacaactaaaaaattcaacagtaagttccgaaggcagagtctaacctttaaccgaggacacacgtaccgacgaggtacttacgttaattagtggagcttagagcgacgtacctgaagtacgtaccgaaagaccacggacttagttatttagtttttcgcgtacgtaccgttagttacggttagggtagtaccgttaagtttaccgtttaccgtaccttacgttaacgttttacgtccttacccggtccggggtaacgtaaccgggtaaccccgttaggtacccctaaccgttcccgtccgtacccg

SEQ ID NO: 260320 - DNA, 624 bp, Homo sapiens
  misc_feature: GYAE6OF01CQ9ZO.1.5.A05.1.454.CMB.1.raw
  modified_base (244)..(244): a, c, t, g, unknown or other
  misc_feature (244)..(244): n is a, c, g, or t
  modified_base (266)..(266): a, c, t, g, unknown or other
  misc_feature (266)..(266): n is a, c, g, or t
  modified_base (498)..(498): a, c, t, g, unknown or other
  misc_feature (498)..(498): n is a, c, g, or t
tcagacgagtgcgtcacgaccggtgctcgatttagatagatagacaggggacccaacaaccacatccctcctcagaagcccccagagcacaacgccccaccatggactggacctggagatccttctttttggtggcagcagccacaggtgcccactcccaggtccagcttgtgcagtcgtggggctgaggtgaagagcctggggcctcagtgaagtttcctgcaaggcttcaggatacaccttnactagtatgctatacattggtncgcacggcccgacaagctgacgtggagtgggatggatcaacgtcgtaggctaagtacggtaaacaactaaaaaattcaacaagtaacgttaccgaagggacagacgtcaacctttaccgaagggacaacagtcccggacgaacgtatttaacgttatagtggtagtcgtaggacgacgaagccctaggaacgtagtaccgaagaccacggtactaggttattaagtttttgngtaccgtacttacgttagtagggagttactagtttacgttaccgtacgttctaagttttgaccgttaccggtcggggtacccaacgggtaccccttgggttaccctacccggttcgtcccttaccg

SEQ ID NO: 260321 - DNA, 974 bp, Homo sapiens
  misc_feature: GYAE6OF01AB1PJ.1.5.A05.1.454.CMB.1.raw
tcagacgagtgcgtcacgaccggtgctcgatttagatagatagacaggggacccaacaaccacatccctcctcagaacgccccagagcacaacgccccaccatggactggacctggaggatccttctttttggtggcagcagccacaggtcgcccactcccgaggtccagcttgtgcagtcgtgggctgaggtgaagagccgtggggcctcgaggtgtaacggtttcctaggcgaaggtcttcgaagggtactacctaacctttcacgttagggttatcggtaccttaagttaccgtaggtttggggtcggacccggtaccccgaacccggggtacccccgggaaacgtaaacggggtccgtttagggaacgggttagggaacggtttagggggtaagttacggggtaaacgttcccgtaaacgggtccggttacgggtaaccggtaaaaggtttaccgggttaaaaaacctaaaacgttaaaaaaaacgtttccggaaaaccgttaaaccggggttaaacggtttaccccggaaagggggtacctaaaacggggttaccgtttaaacccgttacccggttttaaaaccggaacgggggtaaaccctaaacccggttcggtaaccccgggtacgggtaaaccggtttaacgttttaacgtttaaacgtttacggtaaggggttaaccgacggtttacgggaacggtacccgtacggttaaccggtacgggtaaacgtaccggtaaacccggtaaacggaccggtaacccggttagtttaacggtttaaacgtttttcggtttttaacgggtacgtacccggttacggttaccggtttaaggtaacgggttacggtttacttaaacgtttcggttaaacctcggtttacttaaacggtttccgtaaccggttcccgggtaggtaacccggtaccgggtacccgtacggttacccgacccgttctaaccggtcccg

SEQ ID NO: 260322 - DNA, 606 bp, Homo sapiens
  misc_feature: GYAE6OF01AM5Q6.1.5.A05.1.454.CMB.1.raw
  modified_base (289)..(289): a, c, t, g, unknown or other
  misc_feature (289)..(289): n is a, c, g, or t
tcagacgagtgcgtcacgaccggtgctcgatttagatagatagacaggggacccaacaaccacatccctcctcacgaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggataccaccttcactaggtatgctatacattgggtgcgccgacggccccggaanaaaggcttggagtggatgggatggatcgaacgctggcaagtaggtaacaacaaaaattcaacgagaacgttcgagggcagacgtacaccgtttacgagggacacgagtccgagaggtattacttatagtggagctagagcagcctagagtactaccgaagaccgacggtcttaggttattagtttttagcgtaccgttacctacgttagttacgggtaggtactattacgttaccgcttacgtaagtttcgacgttccggtcggggtacccgtaacgggtaaccccgttggtaccctaccgtccgttcccgtacccg

SEQ ID NO: 260323 - DNA, 613 bp, Homo sapiens
  misc_feature: GYAE6OF01DCAPF.1.5.A05.1.454.CMB.1.raw
  modified_base (225)..(225): a, c, t, g, unknown or other
  misc_feature (225)..(225): n is a, c, g, or t
  modified_base (256)..(256): a, c, t, g, unknown or other
  misc_feature (256)..(256): n is a, c, g, or t
  modified_base (428)..(428): a, c, t, g, unknown or other
  misc_feature (428)..(428): n is a, c, g, or t
tcagacgagtgcgtcacgaccggtgctcgatttagatagatagacaggggacccaacaaccacatccctcctcagaacgcccccagagcacaaccgccccaccatggactggacctggaggatccttctttttggtggcagcagccacaggtgcccactcccaggtccagcttgtgcagtctggggctgaggtgaagagccgtggggcctgagtgaaggtttccngcaaggcttcaggatacaccttcactaggtntgactatacagttgggtgcgccgacggccccggagaaaggctagagtggagtggatggatcgaacgcgtggactaagtaggtaaacaactaaaaaattcaacgaagtaagtccgaagggcaagacgtacaaccttacgaggtacacgacgtccgacgaggtattactagtanggagctgagctacgctgaagtcacgagacacggtactgttaacttgttttcggcgtacgtaccgttagtacggtaggtacgttactagtttaataccgtcttacggttaactttggtaccttccggtacggggacccgttacggggtacccgttcgtacccgtccggttacccgtccgtacccgg

SEQ ID NO: 260324 - DNA, 199 bp, Homo sapiens
  misc_feature: GYAE6OF01C4VC1.1.5.A05.1.454.CMB.1.raw
  modified_base (178)..(199): a, c, t, g, unknown or other
  misc_feature (178)..(199): n is a, c, g, or t
tcagacgagtgcgtcacgaccggtgctcgatttagatagatagacagggcaccaagggcccatcggtcttcccctggcaccctcctccaagagcacctctggggcacagcggccctggctgcctggtcaaggactacttcctcgatcgcgtctgaggtcggctggcaaggcgcatagnnnnnnnnnnnnnnnnnnnnnn

SEQ ID NO: 260325 - DNA, 691 bp, Homo sapiens
  misc_feature: GYAE6OF01DDNYJ.1.5.A05.1.454.CMB.1.raw
  modified_base (224)..(224): a, c, t, g, unknown or other
  misc_feature (224)..(224): n is a, c, g, or t
  modified_base (277)..(277): a, c, t, g, unknown or other
  misc_feature (277)..(277): n is a, c, g, or t
tcagacgagtgcgtcacgaccggtgctcgatttagatagatagacgaggggacccaacaaccacatccctcctcagaagccccagagcacaacgccccaccatggactggacctgggaggatcctcttttggtggcagcagccacaggtgcccactcccaggtcccagcttgtgcagtcgtgggctgaggtgaagagccgtggggcctcagtgtacggtttccngacaggtcttcgaggactacaccttacacgtagtatcgctatactattgggtncgccgacggaccccgaacgaacggtcgtagaggtggagtaggagtggagcgaacgtcgtaggtacaagtaggaaacaacgtaaaaactcaacgaaggtaacgtacgacgggacaagtacgtacctaccgtttacgaacgggacacgtacgtaccgtacggaggtactttaacgaattacggtagggacgacggtagacgacgtaacggcgtacgagtaaccgtaccgaacgaccgtacggtacgttagttaactttgttttacgtacgtaccggttacccttacgtacgggttacggtacggttcgttaaacgttacgttaccgtacttaacggttacgtttacgtaccggttcgtaccggggtaccgaacggggttacccgtacgttacccgaccgttccgttccctacccgg

SEQ ID NO: 260326 - DNA, 741 bp, Homo sapiens
  misc_feature: GYAE6OF01DD8SM.1.5.A05.1.454.CMB.1.raw
  modified_base (135)..(135): a, c, t, g, unknown or other
  misc_feature (135)..(135): n is a, c, g, or t
  modified_base (224)..(224): a, c, t, g, unknown or other
  misc_feature (224)..(224): n is a, c, g, or t
  modified_base (550)..(550): a, c, t, g, unknown or other
  misc_feature (550)..(550): n is a, c, g, or t
tcagacgagtgcgtcacgaccggtgctcgatttagatagatagacagggacccaacaaccacatccctcctcagaacgcccccagagcacaaccgccccaccatggactggacctggaggatccttctttttggnggcagcagccacaggtgcccactcccaggtccagcttgtgcagtctggggctggaggtgaagagcctggggcctgagtgaaggtttccngcaaggcttcgaggatacaccttcacgtaggtatggactatacagttgggtgccggccgacggccccggagaaacggcttggagtggagtgggatggatcgaacgtcgtggacaagttacggtaaacaaactaaaaaattccgaaacgtaggtaaacgttaccggagggacaggaacgttaccgtaacccgtttaaccgacggggaacaccgtaacgtccccggacggaacgggttaactttaacgttaagttacggtaggtacgtacgtacggtacgaccgtaacgccttaaggacgtaccgtaaccggaaagtaccgaacggtnttaaggttaactttagttttaggtaccgttacccgttaccgttacggttacgtacgggtacgttacgtaaagtttacgttaaccgttacttaacgtttaacgttttaggtaaccccgttcgggttaccggggaccgttaaccggggtaacccgtttacggacccgttacccggttccctaccggttacccg

SEQ ID NO: 260327 - DNA, 707 bp, Homo sapiens
  misc_feature: GYAE6OF01EJ1PR.1.5.A05.1.454.CMB.1.raw
  modified_base (229)..(229): a, c, t, g, unknown or other
  misc_feature (229)..(229): n is a, c, g, or t
  modified_base (316)..(316): a, c, t, g, unknown or other
  misc_feature (316)..(316): n is a, c, g, or t
tcagacgagtgcgtcacgaccggtgctcgatttagatagatagacaggggacccaacaaccacatccctcctcagaacgcccccagagcacaaccgccccaccatggactggatctggaggatccttctttttggtggcagcagccacaggtcgcccactcccaggtccagcttgtgcagtcgtggggctggaggtgaagagccgtgggcctcgagtgtaaggtttccngcgaaggtcttacgaaggtactacctaccttcacgttaggtatgcttatacgtagtttgggtcgccgaccgtacggacccccggaanaaacgggtcttaggaggtcggagtggggagtggtatccgaaacgtcgtggaactaagttacggtaaaaccaaactaaaaaagttccaaacgtaacgtaaacggttcgaacggggactaggtacgttaccttaccgttaacgacgggaacctacgacttcccggaagacggttaactttaccgttagttaacggtggagtcgtagacgacgacgtcgtaggaagacgtacgaacgcgcggtacttgtattttagtttgacgtccgttactcggttaggtggtagtcttaagttacgtacggtacgttactttaagttacgtaccgttaccgggtaccgggtacccggtaaccgggtaacccggttcgggtaaccctcccggttctaacccgg

SEQ ID NO: 260328 - DNA, 549 bp, Homo sapiens
  misc_feature: GYAE6OF01D5G8U.1.5.A05.1.454.CMB.1.raw
  modified_base (443)..(443): a, c, t, g, unknown or other
  misc_feature (443)..(443): n is a, c, g, or t
  modified_base (455)..(455): a, c, t, g, unknown or other
  misc_feature (455)..(455): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattggtgcgccacggccccggacaaaggcttgagtggatggggatggagtcaacggctggcaatggtaaacgacaaaaaattcaacagaagttccaggcagagtcaaccttaccgagggacacatccggacgaggattattatagtggagcgtagagcagcctagagataccgaagacacggntgtatgttttgngtcgtacttcgtagtggaggtcagttatacgtcttacaatttgaaccttccgacggggtccacggtacccgtgtacccacccgtctccgtaccg

SEQ ID NO: 260329 - DNA, 687 bp, Homo sapiens
  misc_feature: GYAE6OF01ER0NJ.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggagatcctcttttggtggcagcagccacaggtgcccactcccaggtccagcttgtgcagtctggggctgaggtgaagagcctggggcctcagtgaaggtttcctgcaaggcttcaggataccaccttcactaggtatgctatacattgggtgcgccaggccccgacaaaggcttgagtggatgggatggatcgaacgctgggcaagtggtaaacaacgtaaaaaaattcaactaagaaacgttacccgaaggggacaaggacgtacctaacccttttaaccgaaggggtaaccaaccgacgtacccggacgaacgggtaacttttaaccgttaagttaagtcgggaagtccgttaggacgacaggtacccttggaaacgacgttacccggaaagtaaccgacgggtacctaggtttaattaagttttttcggacgtaccgtaaccttaccgttaaggttgggtacgggttactaagtttacgttaccgtacgttactaaacgtttcggaaccttccggttcggggaccctaacgggtaaccctagggttaccacccggttctcccgtaaccg

SEQ ID NO: 260330 - DNA, 586 bp, Homo sapiens
  misc_feature: GYAE6OF01A9T2V.1.5.A05.1.454.CMB.1.raw
  modified_base (378)..(378): a, c, t, g, unknown or other
  misc_feature (378)..(378): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggccccggacaaaggcttgagtggatgggatggatcaacgctggacaatggtaaacaacaaaaaattcaacagaagttccagggcagatcaccttacagggacanatccgacgaggattacttatatggagctgagcagcctgagactaccgaagaccgacggctagttattatttttggcgtcgtaccttcgttaaggtggtacgtctatttagttaccgtcttacgttaagttttgaccgttccggtacgggggtacccctaacggggtaacccccgttgggtaccctacccggttcccgtcccgtacccg

SEQ ID NO: 260331 - DNA, 753 bp, Homo sapiens
  misc_feature: GYAE6OF01B58U1.1.5.A05.1.454.CMB.1.raw
  modified_base (231)..(231): a, c, t, g, unknown or other
  misc_feature (231)..(231): n is a, c, g, or t
tcagacgagtgcgtcacgaccggtgctcgatttagatagatagacaggggacccaacaaccacatccctcctcagaacgccccagagcacaacgccccaccatggactggacctggagatccttctttttggtggcagcagccacaggtcgcccacctcccaggtccagcttgtgcagtcgtggggctggaggtgaagagccgtggggcctcgagtggtaacggttttccnggacctaaggcttcgaaggactactacctttcacgtaggtatgactattactagttgggtgcgaccgacgggacccccggaacgaaaggtccgttaggaggttggagttgggagtggataccgaacgcgtggacgaagtacggtaaacaaacgtaaaaactttaccgaactaaggaaacgttaccgaagggacgaagtaacgtcccgtaaccgtttaaccgaagggacctaacgacgtacccggacggaacggttaacttttaaccgttagttaacgtagggtaccgtagttacggacgacgacggtccgtaggtaacgacgttaaccggaaacggtaccgaacggttccttaaggtttatttaacgttttcggtaccggtacgttaccccgttaagtaggttcgggttaagttacttagttaacgttacgtacgttacgtaatttacgtaccgttccggtacgggggtacccctaacggggttacccgtcggttacctaccccggttcgtccccgtacccg

SEQ ID NO: 260332 - DNA, 552 bp, Homo sapiens
  misc_feature: GYAE6OF01E1WIL.1.5.A05.1.454.CMB.1.raw
  modified_base (383)..(383): a, c, t, g, unknown or other
  misc_feature (383)..(383): n is a, c, g, or t
  modified_base (400)..(400): a, c, t, g, unknown or other
  misc_feature (400)..(400): n is a, c, g, or t
  modified_base (461)..(461): a, c, t, g, unknown or other
  misc_feature (461)..(461): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggccccggacaaaggcttgagtggatgggatggatcgaacgcgtggcaatgtaacaacaaaaaattcaacagaagttcagggcagagtcaccttacgaggacacatccgngagattactatatgganctgacgcagcctgagacgtccgaagaccacggctgtattagtttttgcgtcgtaaccgttntaggtggtagtctagttatacgacttactaatttgaccttccgtaggggtcccgaacgggtacccttggtacccaccgttcctcccgtacg

SEQ ID NO: 260333 - DNA, 767 bp, Homo sapiens
  misc_feature: GYAE6OF01CBDMR.1.5.A05.1.454.CMB.1.raw
  modified_base (134)..(134): a, c, t, g, unknown or other
  misc_feature (134)..(134): n is a, c, g, or t
  modified_base (172)..(172): a, c, t, g, unknown or other
  misc_feature (172)..(172): n is a, c, g, or t
  modified_base (261)..(261): a, c, t, g, unknown or other
  misc_feature (261)..(261): n is a, c, g, or t
  modified_base (279)..(279): a, c, t, g, unknown or other
  misc_feature (279)..(279): n is a, c, g, or t
  modified_base (298)..(298): a, c, t, g, unknown or other
  misc_feature (298)..(298): n is a, c, g, or t
tcagacgagtgcgtcacgaccggtgctcgatttagatagatagacaggggacccgaacaaccacactccctcctcagaacgcccccagagcacaacgccccaccatggactggacctggagatcctcttttggnggcagcagccacaggtgcccactcccaggtccagctgncagtctggggctgaggtgaagacgccgtggggcctcgagtcgaaggtttcctgcaaggtcttacgaggtataccgaccttcactaggtntagctatacagttgggtnccgacctacggccccgganaaacggcttacggagtcggagtgggatggactcacggcgtggacaagtcggtaaacaacaaaaacgttcgaacaaggtaacgttaccgaagggtacagacgtactaaccgttacgacggtacacgtacgtaccggagtaacggttacttaacgttacgtaacggttacgggaacggtacgttaggtacgaacccgtaacggtccccggttaaggaacggttaaaccgtaacccggaaacgggtaacccgtaaccgggtaaccgtttaaggtttaacgttttaacgttttttaccgggaccgttaacccgggttaccctttacggttaagggttacgggtacggttactaacgtttacggtacgtaaccgttactttaacgttacggtaccgttccggggttccggggaaccgttaacccggggtacccttacgggttacccgacccggttccgttacccgttaacccgg

SEQ ID NO: 260334 - DNA, 189 bp, Homo sapiens
  misc_feature: GYAE6OF01B8U9M.1.5.A05.1.454.CMB.1.raw
  modified_base (179)..(189): a, c, t, g, unknown or other
  misc_feature (179)..(189): n is a, c, g, or t
tcagacgagtgcgtcacgaccggtgctcgatttagatagatagacagggcaccaagggcccatcggtcttccccctggcaccctcctccaagagcacctctggggcacagcggccctgggctgcctggtcaaggactacttccagtactctatctgagcgggctggcaaggcgcatagnnnnnnnnnnn

SEQ ID NO: 260335 - DNA, 611 bp, Homo sapiens
  misc_feature: GYAE6OF01EQTMP.1.5.A05.1.454.CMB.1.raw
  modified_base (284)..(284): a, c, t, g, unknown or other
  misc_feature (284)..(284): n is a, c, g, or t
  modified_base (438)..(438): a, c, t, g, unknown or other
  misc_feature (438)..(438): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcgagtgaaggtttcctgcaaggcttcaggatacaccttcactaggtatgctatacattgggtgcgccaggccccgganaaaggcttgagtggatggggatggatcgaacgctggacaagtacggtaaacaaactaaaaaattcaacgaagaaacgttaccgaagggcaagacgtacaaccgtttaaccgagggaacacactccggacgaggtatttaacgttatagtgggancgtagacgcagcctagacgtataccgaagaccgacggtctagttattagtttttagcgtcgtaccttcgtaggtcggtaggttctaagttacttacgcttacttaagtttcgacttcccggtcgggtaccgtaaccgggtaccctcgggtacctacccggttctccgtacccg

SEQ ID NO: 260336 - DNA, 709 bp, Homo sapiens
  misc_feature: GYAE6OF01DRRIL.1.5.A05.1.454.CMB.1.raw
  modified_base (372)..(372): a, c, t, g, unknown or other
  misc_feature (372)..(372): n is a, c, g, or t
tcagacgagtgcgtcacgaccggtgctcgatttagatagatagacaggggacccaacaaccacatccctcctcagaacgcccccagagcacaaccgccccaccatggactggacctggaggatccttctttttggtggcagcagccacaggtgcccactcccaggtccagtcttgtgcagtcgtggggctggaggtagaagaacgccgtggggcctcgaggtgtaacggtttcctggacgaaggtcttcgaggactaccacctttcaacgtaggtatgactagtactagttgggtcgtccgaccgaccggaccccggaacgaaacggtcgttagaggtgggagtgggagtggactacgaacggtcgtcgganaagtaggtaaaacaactaaaaaatcaaagaagtaacgttacgaagggacaaggtacgtactaacccgtttaaccgaacgggtacaaccgacgtacccggaacgtaacgggtaactttaacgttagtaacgttcgggagtctaggacgacgtaacgcctacggacgtaaccgtaaccgaaacggtacgaccggtacgttagttaattttaggttttacgcgtaccgtaccgttcgtaggtacggtggttactagtttataccgttactacgttagttcggttaccgtccggtacgggaccgaccgggtaccgttcgtacccgtcctccgttcctaccg

SEQ ID NO: 260337 - DNA, 255 bp, Homo sapiens
  misc_feature: GYAE6OF01DMR6R.1.5.A05.1.454.CMB.1.raw
  modified_base (254)..(255): a, c, t, g, unknown or other
  misc_feature (254)..(255): n is a, c, g, or t
tcagacgagtgcgtcacgaccggtgctcgatttagatagatagacaggggcagttccagatttcaactgctcatcagcagcctgcagtctgaagattttgctagttttattactgtcagcagtataataactggcctccgacgttcggccaagggaccaaggtggaaatcaaacgaactgtggctgcaccatctgtcttcatccttcccgcatctgatcgtactgcgctggagcgggctggcaaggcgcatagnn

SEQ ID NO: 260338 - DNA, 625 bp, Homo sapiens
  misc_feature: GYAE6OF01A051U.1.5.A05.1.454.CMB.1.raw
  modified_base (286)..(286): a, c, t, g, unknown or other
  misc_feature (286)..(286): n is a, c, g, or t
tcagacgagtgcgtcacgaccggtgctcgatttagatagatagacaggggacccaacaaccacatccctcctcagaagcccccagagcacaacgccccaccatggactggacctggatgatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccacggcccccgganaaaggcttggagtggatgggatggatcgaacgctggcaatggtaaacaacaaaaaattcaacaagaagttccgaggcagacgtctaaccttacgagggacacgacgtccgacgaggtattacttatagtggtagctagagcgacgccgtagagacgtaccgaaggaccgacggtacttagttaatttagtttttacggtcgtaccgtaaccgttcgttaagggtacggtacggttactaagtttaacgttaccgtacgttaccttaagtttcgaccgttcccggtacggggtacccgtaacgggttaaccccgtgggtaccccgtccgttccctacccg

SEQ ID NO: 260339 - DNA, 761 bp, Homo sapiens
  misc_feature: GYAE6OF01CKQ5X.1.5.A05.1.454.CMB.1.raw
  modified_base (222)..(222): a, c, t, g, unknown or other
  misc_feature (222)..(222): n is a, c, g, or t
  modified_base (286)..(286): a, c, t, g, unknown or other
  misc_feature (286)..(286): n is a, c, g, or t
tcagacgagtgcgtcacgaccggtgctcgatttagatagatagacaggggacccaacaaccacatccctcctcagaacgcccccagagcacaaccgccccaccatggactggacctggagatccttctttttggtggcagcagccacaggtgcccactcccaggtccagcttgtgcagtcgtgggctgaggtgaagagcctgggcctcagtgaaggtttccngcaaggcttcgaggatacaccttcactaggtatgctatacattgggtgcgccacggccccgaanaaaggcttgaggtggagtgggatggatcaacgcgtaggactaaagtaggtaaacaaactaaaaaaacttcgaaactaaggtaacgttaccgaagggacaaggtaacgttacctaacccgtttaaccgaaggggtaaccaacgtaacgttcccggaacggtaaggtaactttaaccgtttaataaggttacgggtaacgtacgttaggaacgaccgtaaggacccgtaggaacgtacgttaaccggaaagacccgtaacgggtcttaagtttaagtttaacgttttttcggacgtacccgtaccttacgttagggttacggtacggttactaagttttacgttacgtaccttaacgttaaacgtttacggtaaccctttccgggttaccgggggaaccccgttaaaccggggggttaacccccgttacggggttacccccttaaaccccgggttccttcccccggttaaaccccgg

SEQ ID NO: 260340 - DNA, 851 bp, Homo sapiens
  misc_feature: GYAE6OF01C8GKF.1.5.A05.1.454.CMB.1.raw
  modified_base (135)..(135): a, c, t, g, unknown or other
  misc_feature (135)..(135): n is a, c, g, or t
  modified_base (226)..(226): a, c, t, g, unknown or other
  misc_feature (226)..(226): n is a, c, g, or t
  modified_base (836)..(836): a, c, t, g, unknown or other
  misc_feature (836)..(836): n is a, c, g, or t
tcagacgagtgcgtcacgaccggtgctcgatttagatagatagacaggggacccaacaaccacatccctcctcagaacgcccccagagcacaaccgccccaccatggactggacctggaggatccttcttttggnggcagcagccacaggtcgcccactcccaggtccagcttgtgcagtcgtgggctgaggtagaagagccgtgggcctgagtgtaacgtttccngactaaggtcttacgaggtactacctacctttacacgtaggtatcgacttaatacgtagttcggggtacgccggaccgaccgggacccccggaagtaaacggtccgttaggaggtgggtaaggtgggtagtaggactaccgaacggtcgttagggactaaaggtacggtaaaaccaaaacgtaaaaaacgttcgaaacgtaacggtaacggttaccgaacggggtacgtaaacggtacggttaacccttaaacccgtttaaccgggaacgggtaacctaaccgtaccggtacccggaacggttaacgggttaactttaacgttaagtacgggttacggaagttccgtaggtaaccgacgtaacggtacccgtaaggtaacgtacccggtaaccggaaaggtacccgtacggttacgtttaagttttaacgttttacggtttttaccgggacgtaacccggtttaccgttaagggttacgggttaacgggtcggtttaactttaagtttaccgttaacccggttacttacgtttaaacgttaccgggtaccttcccggggtaacggggtacccccgtaagggtaccccgtttacggcccgttaaccccgtnttaccccgtaccccg

SEQ ID NO: 260341 - DNA, 658 bp, Homo sapiens
  misc_feature: GYAE6OF01CYTGW.1.5.A05.1.454.CMB.1.raw
  modified_base (225)..(225): a, c, t, g, unknown or other
  misc_feature (225)..(225): n is a, c, g, or t
  modified_base (350)..(350): a, c, t, g, unknown or other
  misc_feature (350)..(350): n is a, c, g, or t
tcagacgagtgcgtcacgaccggtgctcgatttagatagatagacaggggacccaacaaccacatccctcctcagaacgcccccagagcacaaccgccccaccatggactggacctggaggatccttctttttggtggcagcagccacaggtgcccactcccaggtccagcttgtgcagtctggggctgaggtgaagaagcctggggcctcagtgaaggtttccngcaaggcttcaggatacaccttcactaggtatgctatacattgggtgcgccacggccccggacaaaggcttgagtggatgggatggatcgaacgctggcaagtggtaaacaacaaaaaattcaanagaagttccgaagggtcagagtacctaaccttaaccgagggacacacgtaccgcgaaggtattaactttaatagtaggagcctagacgacacggcctgacgtacgtaccgaagtaccaacgggtcctagttactttaattttttggtcgtaccgtaccgttacgttaggttaggtacggttactaagtttaacgttaccggtaccttacgttaaattttcgaaccgtttcccggtacgggggtaccccgaacggggttaacccccgttacgggttacccgtaacccggttccgttccccgttaacccg

SEQ ID NO: 260342 - DNA, 682 bp, Homo sapiens
  misc_feature: GYAE6OF01A5TXI.1.5.A05.1.454.CMB.1.raw
  modified_base (266)..(266): a, c, t, g, unknown or other
  misc_feature (266)..(266): n is a, c, g, or t
  modified_base (281)..(281): a, c, t, g, unknown or other
  misc_feature (281)..(281): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagctggggcctcagtgaggtttcctgcaaggcttcaggatacaccttcactaggtatgctatacattgggtncgccaggccccgganaaaggcttggagtggatgggatggatcgaacggctgggacaagtaggtaacaactaaaaaattcaacaacggaaagttccgaaggggcaacggagtaccctaacgtttaacccgaaggggaaccacgaacgtaccgacggtaaggtaactttaacgtttaataacgttaggggtaagtccggtagaaggcgaacgtcccgtagaagacgttaccgaaaggaccacgggtactagttatttaagttttcgggtacgtcgtaacccttggttaacggttagggtaacggttctaagtttaagttaccgactttacgtaagttttacggaccgttccgttcgggggtacccgtaacccggggtaacccgttcgggtaccaacccggtttctacccggttacccg

SEQ ID NO: 260343 - DNA, 667 bp, Homo sapiens
  misc_feature: GYAE6OF01BUMRY.1.5.A05.1.454.CMB.1.raw
  modified_base (222)..(222): a, c, t, g, unknown or other
  misc_feature (222)..(222): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagccgtggggcctcgagtgaaggtttccngcaaggcttcaggataccaccttcactaggtatgctatacagttgggtgcgccacggccccgacaaacggtcttgagtggagtgggagtggatcgaacgcgtggactaagtagtaaacaactaaaaattcaacgaagtaacgttaccgagggtacagtagtactaccgtttaacgagggacacacgtccgacgaggtactttacttagtagtaggagtcgtgagcagtccgtagacgacgtacccggaagaccgacggtacgttagttaagtttagtttttaggtacgtaccggttaccgttacgttagggtacgggtacgttcgttaacgtttacgttaccgtacgtttactaacgtttacggtacccgttcccggtacggggtacccggttaaccgggtaccccggttcggttaccccgtacccgttccgtcccgttacccgg

SEQ ID NO: 260344 - DNA, 808 bp, Homo sapiens
  misc_feature: GYAE6OF01B0JNV.1.5.A05.1.454.CMB.1.raw
  modified_base (133)..(133): a, c, t, g, unknown or other
  misc_feature (133)..(133): n is a, c, g, or t
  modified_base (227)..(227): a, c, t, g, unknown or other
  misc_feature (227)..(227): n is a, c, g, or t
tcagacgagtgcgtcacgaccggtgctcgatttagatagatagacaggggacccaacaaccacatccctcctcagaacgcccccagagcacaacgccccaccatggactggacctggagatcctctttttggnggcagcagccacaggtgcccactcccaggtccagcttgtgcagtcgtggggctggaggtgaagagccgtggggcctcgagtgaaggttttcccnggcgaaggtcttacgaaggtactactaccgtttcactaggtatggacttataactagttgggtacgccggtaccgacgggacccccggagaaaacggtccgttaggaaggtgggaagttaggggatgggtactacgaaccggtcgttacggactaaagtacggtaaaactaaaactaaaaaaactttccaaacgtaaacggtaacggtttaccggaacggggaacgtaacggtacggtaccttaaacccgtttaaccgaacggggaaccaacgtacgttaccggacggtaacgggttactttaaacgttacgttaaggtacgggtaacgacgttagggaacgtaccgtaacggtaccgtaggtaacgtaacgtaccggaaacggaaccgtacgggttacttaggtttaacgtttagtttttacggtacgtaccgttacgttaccgttaggtacgggtagttacgttaagtttacttaccgtacttaccgttaagtttccggaccttcccgggtccggggtaacctaacccggggttaaaccccttgggttaaccccgtacccgtttcccgtcccgtaaccg

SEQ ID NO: 260345 - DNA, 180 bp, Homo sapiens; identical to SEQ ID NO: 259868
  misc_feature: GYAE6OF01DRFV9.1.5.A05.1.454.CMB.1.raw
  modified_base (178)..(180): a, c, t, g, unknown or other
  misc_feature (178)..(180): n is a, c, g, or t

SEQ ID NO: 260346 - DNA, 763 bp, Homo sapiens
  misc_feature: GYAE6OF01BF0XQ.1.5.A05.1.454.CMB.1.raw
  modified_base (235)..(235): a, c, t, g, unknown or other
  misc_feature (235)..(235): n is a, c, g, or t
  modified_base (274)..(274): a, c, t, g, unknown or other
  misc_feature (274)..(274): n is a, c, g, or t
tcagacgagtgcgtcacgaccggtgctcgatttagatagatagacaggggacccaacaaccacatccctcctcagaacgcccccagagcacaaccgccccaccatggactggacctggaggatccttctttttggtggcagcagccacaggtgcccactcccaggtcccagcttgtgcagtcgtggggctggagggtagaagacgccgtggggccctcgaggtgtaaggtttccnggacaaggtcttcgaggactacctaccttcacgtaggtntgctatactagttgggtcgccgtccgaccgggaccccggaagaacggtcgttaggaggttggagtggggtatcgggacttcgaacggtccgtgggactaacgttacggtaaaactaaaacgtaaaaacgttacgaaaccgtaacggttaaaccggttaccggaacgggtacgtaacggttaaccgttaaccccgttaacccggttttaaacggaaccgggtaaccaacgtacgtacccggacggtaagttacgtttacttaagtagtggtacgtgtacggagaccgtagtccgtagaacgtagtacccgaagccgacgttctagttagtttgtttcgacgtcgttacgttagtaggttggtacttacgttagtttacttacgtaccgttagttaaccgttggtacccgttacggggttacgggaccccggttaaccggttaccccggttacgggtaaccccctcccggttccgttacccctaaccccgg

SEQ ID NO: 260347 - DNA, 575 bp, Homo sapiens
  misc_feature: GYAE6OF01EODOB.1.5.A05.1.454.CMB.1.raw
  modified_base (244)..(244): a, c, t, g, unknown or other
  misc_feature (244)..(244): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttnactaggtatgctatacattgggtgcgccacggccccggacaaaggcttggagtggagtggggatgggatcgaacgcgtggcaagtggtaaacaactaaaaaattcaacagaagttaccagggcagagtcacctttacagggactacatccgagagtattacttatatggagtctgagtcgagacctgagataccgaagacacggctgtattagttttgtgtcgtactgttacgtggtagtctattagtacgtactacgtaatttggacgttccgtcggggtacccgaaccgggtaacccgttcggttacccaccggttcctcccgtacccg

SEQ ID NO: 260348 - DNA, 595 bp, Homo sapiens
  misc_feature: GYAE6OF01B1AZD.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctggaggtgaagaagcctggggcctcagtgaaggtttcctgcaaggcttcaggatacaccttcactaggtatgctatacattgggtgcgccacggccccggacaaaggcttggagtggatggggatggatcgaacgctggcaatggtaaacaacaaaaaattcaacagaagttccgagggacagagtcacctttaccagggacacatccgcgaggtattacttatatggagctgagcgagccgtgagataccggaacgacgacggctgttatattttttgtgaccgtacctcgttaggtggtaggtactagtttattacggacttactaacgttttagtccgttccgtacgggggtaccccaacgggggtaccccgttacgggtaccgtaccccgttccgtcccctacccgg

SEQ ID NO: 260349 - DNA, 676 bp, Homo sapiens
  misc_feature: GYAE6OF01DVRO7.1.5.A05.1.454.CMB.1.raw
  modified_base (223)..(223): a, c, t, g, unknown or other
  misc_feature (223)..(223): n is a, c, g, or t
  modified_base (631)..(631): a, c, t, g, unknown or other
  misc_feature (631)..(631): n is a, c, g, or t
tcagacgagtgcgtcacgaccggtgctcgatttagatagatagacagggacccaacaaccacatccctcctcagaagcccccagagcacaaccgccccaccatggactggacctggaggatcctcttttggtggcagcagccacaggtgcccactcccaggtccagcttgtgcagtctggggctgaggtgaagagccgtggggcctcgagtgaacggtttccngcgaaggtcttcgaggatacctaccttcacttaggtatcgactatactagttgggtcgccgtcccgaccggaccccggaacgaaacggtcttggaggtggagtgggatggagtcgaacgtcgtaggactaagtacggtaaaactaaacgtaaaaaacttcgaacgtaagtaacggttaccgaagggactaacggtacgtacctaacccgtttaccgaagggtaccaacacgtaccgacggtaaggtacgttaacgttaatagttagggagtcgtagacgacaacggtccgtagaagacgtaccgaagaccgtacggtcttaggttactttagttttcggacgtaccgtactacggttaggtggtagttacgtaagttactacgtcttcggttatttagccgttccggngggtaccacggtacctaacccggtgtaccctccggttcctacccg

SEQ ID NO: 260350 - DNA, 688 bp, Homo sapiens
  misc_feature: GYAE6OF01DXVEV.1.5.A05.1.454.CMB.1.raw
  modified_base (269)..(269): a, c, t, g, unknown or other
  misc_feature (269)..(269): n is a, c, g, or t
tcagacgagtgcgtcacgaccggtgctcgatttagatagatagacagggacccaacaaccacatccctcctcagaacgcccccagagcacaaccgccccaccatggactggacctggagatcctcttttggtggcagcagccacagtcgcccactcccaggtccagcttgtgcagtctgggctgaggtgaagagcctggggcctcagtgaaggtttcctgctaaggcttcaggataccaccttcactaggtatgactatacattgggtncgccgacggccccggacgaaaggcctaggacggtggagttcgggagtggactcgaacgtcgtggactaagtagggtaaaaccaacgtaaaaaattcaacgaagtaacgtttaccgagggaccaggtacgtactaaccgtttaccgaagggaccagacgtacccgagacggtactttaacgttataacgtgggtaagcctaggacgacgtacggtaccttaggaacgtaacgtaccggtaacgaacccgtacggtacttcgtttaagtttacctttttaggacgtaccgtaaccgttcgttaagttagggtacgggtttctaaagtttacgtaacgtcgtttaacgtaagttttcgaccgtttccgtacgggggtccctaacggggtacccctgggttaccctcccgttctcccgtaccg

SEQ ID NO: 260351 - DNA, 741 bp, Homo sapiens
  misc_feature: GYAE6OF01ERHSV.1.5.A05.1.454.CMB.1.raw
  modified_base (135)..(135): a, c, t, g, unknown or other
  misc_feature (135)..(135): n is a, c, g, or t
  modified_base (304)..(304): a, c, t, g, unknown or other
  misc_feature (304)..(304): n is a, c, g, or t
tcagacgagtgcgtcacgaccggtgctcgatttagatagatagacaggggacccaacaaccacatccctcctcagaacgcccccagagcacaacgccccaccatggactggacctggaggatccttctttttggnggcagcagccacaggtcgcccactcccgaggtccagcttgtgcagtcgtggggctggaggtgaagagccgtggggcctcgagtgtaaggtttcctggcaaggtcttcgaggtactaccaccttacacgttaggtatgctatacagttgggtgcgccgacggcccggaanaaggctgagtggatgggatggatcgaacgcgtggacaagtcggtaaacaaactaaaaacttcgaacaggtaaacgttccgagggaccaaggtacgtaccgaaccgttttaaccgaaggggtaaccacgtaacgtccggacggtaacggtaactttaacgttaagttaacgtacgggtactcgttaggacgaccgtaacggtcctaggaagtacgtaacccggaaggtacccgtacggtacgttacgttaacgttttagtttttcgggacgtacccgttaacgttcggttaaggttacggtacggttaccgttaagtttacgttaccgttacgttaccgttaacgttttaggacccctttccggggtacggggtaccccgtaaccgggggttaacccctcgggttaacccgtcccgggtttacctcccggttaacccg

SEQ ID NO: 260352 - DNA, 758 bp, Homo sapiens
  misc_feature: GYAE6OF01BABAZ.1.5.A05.1.454.CMB.1.raw
  modified_base (220)..(220): a, c, t, g, unknown or other
  misc_feature (220)..(220): n is a, c, g, or t
tcagacgagtgcgtcacgaccggtgctcgatttagatagatagacaggggacccaacaaccacatccctcctcagaacgcccccagagcacaacgccccaccatggactggacctggaggatcctcttttggtggcagcagccacaggtgcccactcccaggtccagcttgtgcagtcgtgggctgaggtgaagagccgtgggcctgagtgaggtttccngacgaaggtcttacgaggactaccgtaccttcacgtaggtatgacttatactagttgggtacgcgccgaccggaccccggaagtaacggtcgttaggacggtgggagtaggggattggataccgaacggcgtaggactaagtacggtaaacaaactaaaaatcaacgaaggtaacgttacgagggacagacgtacctaaccgttacgacggtaccacgacgtaccggacgtaaggtactttaacgttaagtacgtagggacgtcgtaggacgaccgtaggtacccgtaggacgtacgtaacccggaacgtaccgacggttacgttaggtttaagtttacgttttagggtaccggtaccgttaacccgtttcggttaagggtacgggtaacgttaccgttacgtttaaccggtacccgtacgtttacgttaaacgtttcccggtaaccgttcccggggttaccggggtaaccccggtaaaccggggttaccccgttacggggttaccccttacccggttacccgttcccggtaaccccg

SEQ ID NO: 260353 - DNA, 568 bp, Homo sapiens
  misc_feature: GYAE6OF01AXL6Z.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccggacaaaggcttgagtggatggggatggatcaacgctggcaatggtaaacaacaaaaaattcaacagaagttccgaggcagagtcacctttacagggacacatccgcgaggattactatatggagctgagcagcctagagataccgaagaccacgggctcggttaattatttttggcgtccgtaccttcgttagtcgggaggtactagtttatacgcttactaatttcgacttccgtggggaccctacggggtaacccttgggtacccgtacccgttcgtcccgtaccg

SEQ ID NO: 260354 - DNA, 647 bp, Homo sapiens
  misc_feature: GYAE6OF01ARZ7B.1.5.A05.1.454.CMB.1.raw
  modified_base (225)..(225): a, c, t, g, unknown or other
  misc_feature (225)..(225): n is a, c, g, or t
  modified_base (287)..(287): a, c, t, g, unknown or other
  misc_feature (287)..(287): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtcgtggggctggaggtgaagaagccgtggggcctcagtgaaggtttccngcaggcttcaggataccaccttcactaggtatgctatacattgggtgcgccaggcccccganaaacggcttggagtggagtgggatggatcgaacgctggcaagtggtaaacaacaaaaaattcaagaacgaagttccgaagggcagacgtcctaccgtttaccgagggacacgatccgcgacggtaatttactatagtggtagcgtagacgcacgcctaggaacgacgtacccgaaaggaccgacggcttaggttatttagtttttacggtcgtacgtaccgttcgttaaggttcgggacggttctaagtttacgttaccgtaccttacgttaacgttttgacccgttccggtaccgggggtacccgtaacggggtaaccccgtttcgggtacccgtacccgttccgttcccttaacccgg

SEQ ID NO: 260355 - DNA, 641 bp, Homo sapiens
  misc_feature: GYAE6OF01D1ZOH.1.5.A05.1.454.CMB.1.raw
  modified_base (222)..(222): a, c, t, g, unknown or other
  misc_feature (222)..(222): n is a, c, g, or t
tcagacgagtgcgtcacgaccggtgctcgatttagatagatagacaggggacccaacaaccacatccctcctcagaagcccccagagcacaaccgccccaccatggactggacctggaggatcctcttttggtggcagcagccacaggtgcccactccccaggtccagcttgtgcagtctggggctgaggtgaagagcctggggcctcagtgaaggtttccngcaaggtcttcaggatacaccttcactaggtatgctatactattgggtgcgccacggcccctgacaaggcttgagtggagtgggatggatcgaacgcgtggacaagtaggtaaacaaacaaaaaacttcaacgaagtaacgttccgaagggtcaagacgtacctaaccgtttaccgagggacctacacgtaccggacggtacggtatttaacgttataagtggagtactagacgcgacgtcctaggacgacgtaccggtaacgaccgacggtacttgttaatttacgttttcgtacgtcccgtaccttcgttaggtaggtacggttcttaagttacgttacgtcttactaatttcggaccgttcccggtaggggtaccccgtacggggtaacccctggtaccctcccgttcctaccccg

SEQ ID NO: 260356 - DNA, 683 bp, Homo sapiens
  misc_feature: GYAE6OF01C4F2M.1.5.A05.1.454.CMB.1.raw
tcagacgagtgcgtcacgaccggtgctcgatttagatagatagacagggacccaacaaccacatccctcctcagaagcccccagagcacaacgccccaccatggactggacctggaggatccttcttttggtggcagcagccacaggtgcccactcccaggtccagcttgtgcagtctggggctgaggtgaagaagcctggggcctcagtgtaaggtttcctgcaaggtcttcgaggataccgacctttcacgtaggtatgactatactagttgggtcgccgtcccgacgggacccccggaacaaacggtcttaggacggtggagtgggagtggactcgaacggcgttaggactaaagtacgggtaaaaccaaacgtaaaaaattcaacgtaagtaacgttaccgaagggacgaacgtacgtaccgtaacccgtttaacgaacgggactacgtacgtccgacggtaaggttacttaacgttagtagtgggtaacgtacgtaggtacgtacgacgtccgtagaacggtactaccgaacgacgacggtcttagttatttagttttgtcgtaccgtacttcgtagttaggtggttactaacgtttataaccgtcttaacgtagtttacgacttaccgggcgggtacccaggggtacccctaggtacccgtaccgtcgtccgtaccg

SEQ ID NO: 260357 - DNA, 645 bp, Homo sapiens
  misc_feature: GYAE6OF01A66L4.1.5.A05.1.454.CMB.1.raw
  modified_base (209)..(209): a, c, t, g, unknown or other
  misc_feature (209)..(209): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtctggggctgaggtgaagagccgtggggcctnagtgaaggtttcctgcaaggcttcgaggtataccaccttcactaggtatgctatactagttggtgcgccgacggccccgacgaacggcttgagtggagtagggagtaggatcgaacgtcgtgggacaagtaggtaaacaaacgtaaaaaattcaacgaagtaacgttaccgaagggacagacgtacctaacccgtttaacgacgggacacgacgtaccgacgtaggtattacgttatagtggagcgtagagtcgagccgtaggacgtaacgaccggaaagaccgtaacggtacttagttaactttaggtttttagcgtaccgtaccttagttaggtaggtagttactaagttactttacgacgttacgtagtttagaccgttcggtacgggtaccctacgggtacccgttcgtacccgtccgttcctccgtacccg

SEQ ID NO: 260358 - DNA, 686 bp, Homo sapiens
  misc_feature: GYAE6OF01A76O9.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatccttcttttggtggcagcagccacgaggtgcccactcccaggtccagcttgtgcagtctgggctgaggtgaagagcctggggcctcagtgaaggtttcctgcaaggcttacgaggtactacaccgttcacgttaggtactgactatactagttggtgcgcacggcccggacaaaggcttggagtggagtgggagtggactcgacgcgtggacaagtaggtaaacgaacaaaaattacgaacgagaaacgttaccgaagggtacagtacgtacctaacgtttaaccgaacggaccacgtacgttacccggacggtacggtaactttaaccgtttaattacgttagggtacgtacgttagaagtacgtacggacgtaggacgtaacggtaccgaaacgaccgtaacggttactagttaacgtttagtttttcgtcgtaccgtaccgttacgttacggtaggtacggtaccttaagttaccgtacgttactcgttaaacgtttcgtaccgttcgtacggggtacccgacggtaccgttacggttacccgtaccgtccgtcctaacccg

SEQ ID NO: 260359 - DNA, 929 bp, Homo sapiens
  misc_feature: GYAE6OF01DE7DG.1.5.A05.1.454.CMB.1.raw
  modified_base (135)..(135): a, c, t, g, unknown or other
  misc_feature (135)..(135): n is a, c, g, or t
  modified_base (230)..(230): a, c, t, g, unknown or other
  misc_feature (230)..(230): n is a, c, g, or t
tcagacgagtgcgtcacgaccggtgctcgatttagatagatagacagggacccaacaaccacatccctcctcagaacgcccccagagcacaaccgccccaccatggactggacctggagattccttctttttggnggcagcagccacaggtcgcccactcccaggtccagtcttgtgcagtcgtgggctggaggtagaagacgccgtggggcctgagtgtaacgtttccngacaaggtcttacgaggtactaccgtaccttcaacgtaggtatacgtaccttattaacgtggtttcggggcgacccggacccggaacccgggacccccggaaagtaaacgggtccgttaggaggttaggaacggttagggtagtacggaactaccgaaccggtcgtacggaacgttaaaacggttaacggtaaaacctaaaaacgtaaaaaacgtttccaaaacgtaacggtaaaccggttaccggaacgggtacaaacggttacgttaaccctaaccggtttaaccggaacggactaaccggtacgtaccggacgggttaacgttaactttaacgttaagtacggtcggaactcgtaggtacgaccgtaaggtaccgaggtaaccgtaaccggtaacccgaaaggtaacccgttacgggttacctttaggttttaacgttttttacggtttacgggtacccggttacccggttaacccgttttagggtttacgggttaacgggtttaccggttaaccgttttaaacgttttaacgttaccccggttaacgttttaaaccgtttaacggtttacccgggttaccccgggtttacccggggttaacccggggggaaacccccgtttaaccgggggttaacccccgttccgggtttacccccgttaaaccccggtttccccgttaacccccggtaacccgg

SEQ ID NO: 260360 - DNA, 179 bp, Homo sapiens; identical to SEQ ID NO: 259999
  misc_feature: GYAE6OF01AFPSJ.1.5.A05.1.454.CMB.1.raw
  modified_base (178)..(179): a, c, t, g, unknown or other
  misc_feature (178)..(179): n is a, c, g, or t

SEQ ID NO: 260361 - DNA, 257 bp, Homo sapiens
  misc_feature: GYAE6OF01AJ994.1.5.A05.1.454.CMB.1.raw
  modified_base (95)..(95): a, c, t, g, unknown or other
  misc_feature (95)..(95): n is a, c, g, or t
  modified_base (249)..(257): a, c, t, g, unknown or other
  misc_feature (249)..(257): n is a, c, g, or t
tcagacgagtgcgtcacgaccggtgctcgatttagatagatagacaggggcagttccagatttcaactgctcatcagcagcctgcagtctgaagnttttgcagtttattactgtcagcagtataatactggcctcgacgttcggccaaggaccaaggtgaaatcaaacgactgtggctgcaccatctgtcttcatcctcccgcatctgatcgtactgcgtctgagcgggctggctaaggccgcataggnnnnnnnnn

SEQ ID NO: 260362 - DNA, 540 bp, Homo sapiens
  misc_feature: GYAE6OF01AWD96.1.5.A05.1.454.CMB.1.raw
  modified_base (246)..(246): a, c, t, g, unknown or other
  misc_feature (246)..(246): n is a, c, g, or t
  modified_base (453)..(453): a, c, t, g, unknown or other
  misc_feature (453)..(453): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacacctttnactaggtatgctatacattgggtgcgccaggcccccggacaaaggcttgagtggatgggatggatcaacgctggcaatggtaaacacaaaaaattcaacagaagttccagggcagagtcacctttacagggtacacatccgcgaggattacttatatggagctgagcagcctagagtatccgaagacacggctgttatagtttttgngcgtacctgtagtggagtcattatacgtctctaagtttgaccttcgtaggggccctaggggaccctggtacccaccgtctccctccg

SEQ ID NO: 260363 - DNA, 644 bp, Homo sapiens
  misc_feature: GYAE6OF01BC7QK.1.5.A05.1.454.CMB.1.raw
  modified_base (289)..(289): a, c, t, g, unknown or other
  misc_feature (289)..(289): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagacacaggtgcccactcccaggtccagcttgtgcagtctggggctgaggtgaagaagccgtggggcctcagtgaaggtttcctgcaaggcttcaggatacaccttcactaggtatgctatactagttgggtgcgccgacggccccggaanaaacggcttagaggtggagtgggagtggatacgaacgcgtggacaagtacggtaaacaaactaaaaaattcaacagtaaacgttccgaggacaagtacgttaaccgttacgaaggacacgactccgagtaaggtattacttatagtggaagcgtaggacgacgacgtaccgtaggaacgtacgtaccggaaacgaccgaaccggtcgtttagttaagttttagttttcggtacgtaccgtaccgttacgttagggtacggtagttactaagtttacgtacgtcttactaagttcgtacttccggtcgggaccacggggtaccctcggtaccctacccgttcctcccgtctacccg

SEQ ID NO: 260364 - DNA, 616 bp, Homo sapiens
  misc_feature: GYAE6OF01DWDQL.1.5.A05.1.454.CMB.1.raw
  modified_base (133)..(133): a, c, t, g, unknown or other
  misc_feature (133)..(133): n is a, c, g, or t
  modified_base (222)..(222): a, c, t, g, unknown or other
  misc_feature (222)..(222): n is a, c, g, or t
  modified_base (247)..(247): a, c, t, g, unknown or other
  misc_feature (247)..(247): n is a, c, g, or t
  modified_base (350)..(350): a, c, t, g, unknown or other
  misc_feature (350)..(350): n is a, c, g, or t
tcagacgagtgcgtcacgaccggtgctcgatttagatagatagacaggggacccaacaaccacatccctcctcagacgcccccagagcacaacgccccaccatggactggacctggaggatcctctttttggnggcagcagccacaggtgcccactccccaggtccagcttgtgcagtcgtggggctgaggtgaagagcctgggcctcagtgaaggtttccngcaaggcttcaggactaccaccttnacgtaggtatgctatacagttgggtgcgccgacggcccgacaaaggctgagtggagtggagtggatcgacgctggcaataggtaaacaactaaaaaattcaanaagtaacgttccgagggacaaggcgttacctaaccgtttaccgaggaccaacactacccggacgaaggtactttaacttaacgtagttaggagtacgttgaggtacgagccgtaggagtacgtacgaaacgcgacgtacttagttagtttagttttcgagtccgtacttgtaggtggagttctagttattcgaccttacgtaatttcgaccgttccggtacgggccgaacgggtacccttggtaccctaccgtcgtccgtaacccg

SEQ ID NO: 260365 - DNA, 798 bp, Homo sapiens
  misc_feature: GYAE6OF01EDUKE.1.5.A05.1.454.CMB.1.raw
  modified_base (225)..(225): a, c, t, g, unknown or other
  misc_feature (225)..(225): n is a, c, g, or t
tcagacgagtgcgtcacgaccggtgctcgatttagatagatagacaggggacccaacaaccacatccctcctcagaagcccccagagcacaaccgccccaccatggactggacctggaggatcctctttttggtggcagcagccacaggtgcccactcccaggtccagcttgtgcagtcgtggggctgaggtgaagagccgtggggcctgagtgaacggtttccngacaaggtcttcgaggactaccaccttcgactaggtatgactatacagttgggtgccgccgaccggaccccggaacgaaacggtcgtaggacggtggaggtgggtagtagggaacgtacgaacggtcgtacgggactaaacgtaacgggtaaaccaaaactaaaaaaacgttcaaacgaaaggtaacgttaccgaagggtacaaggacgttaccgtaaccgtttaaccgaacgggtaaccaacgtacgtacccggacggaacggttaactttaacgttaagttagtagggtacgtacgttagaacgtacctacgtacccgtaggtaacgtaacgtacccggaaacgtaccgtaccgtacgtttagtttaacgttttaacgtttttcggtaccggttacccgtaccgtttacggttaagggttacgggtacgttaacgttaacgtttaacgttaccgtacgtttacgttaaacgttttccggtacccggtttcccgggtaacccggggtacccgtaaaccggggttaccccgttaccggttacccgtaccccgtttcccgttccccgtaaccgg

SEQ ID NO: 260366 - DNA, 844 bp, Homo sapiens
  misc_feature: GYAE6OF01B7V7H.1.5.A05.1.454.CMB.1.raw
  modified_base (206)..(206): a, c, t, g, unknown or other
  misc_feature (206)..(206): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctgggcctnagtgagtttcctgcaggctcaggatactaccttcacgtaggtatgactatacagttagggtgcgcccgacgggccccggaagaaacggtcctttaggagtggagtcggggagtggacttcgaacgtcgttgggacctaaagtacgggttaaaaccaaaacgtaaaaaaacgtttccaaacgaacggtaaacgtttacccgaaggggtacaaggaacgttacccgtaacccgtttaaccgaacggggtaacccacgtaacgttcccgggacgtaacgggttaactttaaccttaagttaagttacggggacgtacgttacggaacggtacgtaaggtacccggttaggaacggtaaaccgtaacccgggtaaacggtaacccgtaaaccggggttcctttaacgggttttaaattttaacggttttttttacgggaccggttaacccggtttacccgttaaccggtttagggtttacggggtaacggtttaccgttaacggttttaaacgtttaccggtaccgtttaacgtaaacgtttttacggaacccggtttccggtacccgggggtacccgtaaacggggtaccccggtttacgggttaccccgtaccccggttcccggttccccgtaaccccgg

SEQ ID NO: 260367 - DNA, 253 bp, Homo sapiens
  misc_feature: GYAE6OF01AYH1D.1.5.A05.1.454.CMB.1.raw
  modified_base (250)..(253): a, c, t, g, unknown or other
  misc_feature (250)..(253): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgactgtggctgcaccatctgtcttcatcttcccgctatctgaacgcactcgtctgagcgggctggcaaggcgcatagnnnn

SEQ ID NO: 260368 - DNA, 703 bp, Homo sapiens
  misc_feature: GYAE6OF01CR9XK.1.5.A05.1.454.CMB.1.raw
  modified_base (136)..(136): a, c, t, g, unknown or other
  misc_feature (136)..(136): n is a, c, g, or t
  modified_base (306)..(306): a, c, t, g, unknown or other
  misc_feature (306)..(306): n is a, c, g, or t
  modified_base (330)..(330): a, c, t, g, unknown or other
  misc_feature (330)..(330): n is a, c, g, or t
  modified_base (640)..(640): a, c, t, g, unknown or other
  misc_feature (640)..(640): n is a, c, g, or t
  modified_base (695)..(695): a, c, t, g, unknown or other
  misc_feature (695)..(695): n is a, c, g, or t
tcagacgagtgcgtcacgaccggtgctcgatttagatagatagacaggggacccaacaaccacactcccctcctcagaacgcccccagagcacaaccgccccaccatggactggacctggagatccttcttttggngcagcagccacgaggtcgcccactcccgaggtccagtcttgtgctagtcgtggggctggaggtagaagagccgtgggcctcgaggtagtacggtttccagacgtaacggtcttacgaggtactacctaccttcaacgtaggtatcgtacttagtaacgtaggttcggtcncggaccgaccgggaccccggtaanaacggtctaggacgtggacgtggaagtcgtactacgaacggtcgtacgtaactaaagtaacggtaaaacctaaaactaaaaacgttcaaacgtaacggtaaaccgttacggaacggtactaacgttaacgttacccgtaaccgttacggaacgtaaccacgtacgtaccggagttaacgtattagtacgtaggtacgagttacgagacgtaacgtcggacgtacgaaccggtaacgacgaccacggtacttgttagtttacgtttgtttaccggcacggttctagtggttcgaattcgtatacgtacctntaaacgttcgtagtcgtcggaccggtacgtaccgtacggtctaccgtccgttccncgtacccg

SEQ ID NO: 260369 - DNA, 254 bp, Homo sapiens
  misc_feature: GYAE6OF01A3IG9.1.5.A05.1.454.CMB.1.raw
  modified_base (215)..(215): a, c, t, g, unknown or other
  misc_feature (215)..(215): n is a, c, g, or t
  modified_base (250)..(254): a, c, t, g, unknown or other
  misc_feature (250)..(254): n is a, c, g, or t
tcagacgagtgcgtcacgaccggtgctcgatttagatagatagacagggcagttccagatttcaactgctcatcagcagcctgcagtctgaagattttgctagttttattactgtcagcagtataataactggcttccgacgttcggccaagggaccaaggtgaaatcaaacgactgtggctgcaccatctgtcttcatcctcccgcatctgagngtgcgtctcgtgagcgggctggcaaggcgcatagnnnnn

SEQ ID NO: 260370 - DNA, 186 bp, Homo sapiens
  misc_feature: GYAE6OF01DFVLM.1.5.A05.1.454.CMB.1.raw
  modified_base (179)..(186): a, c, t, g, unknown or other
  misc_feature (179)..(186): n is a, c, g, or t
tcagacgagtgcgtcacgaccggtgctcgatttagatagatagacagggcaccaagggcccatcggtcttccacctggcaccctcctccaagagcacctctggggcacagcggccctgggctgcctggtcaaggactacttccacgcactcgtctgagcgggctggcaaggcgcatagnnnnnnnn

SEQ ID NO: 260371 - DNA, 729 bp, Homo sapiens
  misc_feature: GYAE6OF01A6HG9.1.5.A05.1.454.CMB.1.raw
  modified_base (287)..(287): a, c, t, g, unknown or other
  misc_feature (287)..(287): n is a, c, g, or t
  modified_base (411)..(411): a, c, t, g, unknown or other
  misc_feature (411)..(411): n is a, c, g, or t
tcagacgagtgcgtcacgaccggtgctcgatttagatagatagacaggggacccaacaaccacatccctcctcagaagcccccagagcaccaacgccccaccatggactggacctggaggatcctcttttcggtggcagcagccgacaggtgcccactcccaggtccagcttgtgcagtctgggctgaggtgaagagcctggggcctcagtcgaaggtttcctgcaaggcttcgaggactacaccttcactaggtatgctatacattggtgcgcacggaccccgganaaacggcttgagtggatgggataggatacgaacgctggactaagtcggtaaacactaaaaatcaacaagtaacgttccgagggcacggacgtacaccgtttaccgagggaccacgactcccggngtaacggtacttaacttagtaacgtcggaagtcttacggacgtcgaacgtaccgtaggaacgtacgttacccggaaacggtcctaacgggtccttaagggtttagttaaccgttttttaggtaccggtaccgttacccgttacgttaacggggttacgggtaacgtttacgttaaacgttttacgttaaccggtaccgttaaccgtttaacgtttaccggaacccgttccccgggttacggggtaaccccgtaaccggggtaaccccgtttacgggttaaaccccgtacccgggtttcccttccccggttaaccccgg

SEQ ID NO: 260372 - DNA, 804 bp, Homo sapiens
  misc_feature: GYAE6OF01BYPSK.1.5.A05.1.454.CMB.1.raw
tcagacgagtgcgtcacgaccggtgctcgatttagatagatagacaggggacccaacaaccacatccctcctcagaacgcccccagagcacaacgccccaccatggactggacctggagatcctcttttggtggcagcagccacaggtgcccactcccaggtccagcttgtgcagtcgtggggctggaggtgaagagccgtggggcctcgagtgtaaggtttcctgacaaggtcttcgaggtactactaccttcacgttaggtatgtactatactagttgggtcgtccgccgacgggcccccggaagaaacggtccttaggaggtggtagtggggatgggactcgaacggtcgtagggactaagtacgggtaaaacctaaacgtaaaaaaactttccaaacgtaaacggtaaacgttacccggaagggacctaaggacgttacccgtaaacccttttaaccggaacggggaacctaaccgtacgttaccccggacggtaagggttaacttttaaccgttaagtttaacggtaggggtaacggtacgttaggaacggtaccgtaacggtcccgttagggaacgtaaccgttaccgggaaacgacccggtaacggtacgtttagtttaacgttttagttttttacggtaccggtaacccgttaccgttacgttacgggttagggtaccggttattaaacgtttacgttaccgtacgttactaacgtttcggtacccttaccgggtcgggtaccgtaaccgggtacccgttacggtacccgtacccggttccgttcccgtaacccgg

SEQ ID NO: 260373 - DNA, 553 bp, Homo sapiens
  misc_feature: GYAE6OF01CAYGQ.1.5.A05.1.454.CMB.1.raw
  modified_base (207)..(207): a, c, t, g, unknown or other
  misc_feature (207)..(207): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctnagtgaaggtttcctgcaaggcttcaggataccaccttcactaggtatgctatacattgggtgcgccaggcccccggacaaaggcttggagtggatgggatggatcaacgctggacaagtggtaaacaacaaaaaatttcacaagaagttccagggcagagtcacctttacgagggacacatccgacgaggattactatagtggagctgagcgacgcctgacgataccgaagaccgacggctagtaatttagttttagtcgtacgtacctctaggtggaggttctagttatacgctactattgacttccgtcgggaccacggaccctgtccgaccgtctccgtaccg

SEQ ID NO: 260374 - DNA, 757 bp, Homo sapiens
  misc_feature: GYAE6OF01BLHDM.1.5.A05.1.454.CMB.1.raw
  modified_base (285)..(285): a, c, t, g, unknown or other
  misc_feature (285)..(285): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaggtttcctgcaaggcttcaggatacaccttcactaggtatgctatacagttgggtgcgccacggccccgganaaaggcttgacgtggatgggatggatcgaacgctggacaagtaggtaaacaaactaaaaaaattcgaacaagtaaaggttaccgaaggggtacaaggaacgtacctaaccccgttttaaccgaacggggtaaccaacgtaacgtccccggacggtaaggtaacgtttacctttaagttaagttacgggagtacgttaggaacgacgaaggtcccgttagggaacggtaacgttaacccgggaaaggtaacccggtaacgggtacctttagggtttaaactttaggtttttttacggtaggttacccggttaacccgtttaccgttagggttaccgggtaaggttaccttaagttttaaccgtttaccgtacgtttaccgttaagttttacgaaccggtttcccgggtacggggtacccggtacggggtaaacccccgttggtaccctacccggttcccgtccgtaaccccgg

SEQ ID NO: 260375 - DNA, 256 bp, Homo sapiens
  misc_feature: GYAE6OF01DLTII.1.5.A05.1.454.CMB.1.raw
  modified_base (251)..(256): a, c, t, g, unknown or other
  misc_feature (251)..(256): n is a, c, g, or t
tcagacgagtgcgtcacgaccggtgctcgatttagatagatagacagggcagttccagatttcaactgctcatcagcagcctgcagtctgaagattttgcagttttattactgtcagcagtataataactggcctcgacgttcgccaagggaccaaggtggaaatcaaacgaactgtggctgcaccatctgtctcactcttcccgcatctgatcgtactgcgctgacgcgggctggacaaggcgtcatagnnnnnn

SEQ ID NO: 260376 - DNA, 735 bp, Homo sapiens
  misc_feature: GYAE6OF01BSEOT.1.5.A05.1.454.CMB.1.raw
  modified_base (221)..(221): a, c, t, g, unknown or other
  misc_feature (221)..(221): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagccgtggggcctcagtgaagtttccngcaaggcttcaggatacaccttcacgtaggtatgctatacattgggtgcgccaggccccggacaaaggcttgagtggatggggatgggatcgaacgcgtggcaagtggtaaacaacaaaaaattacaacaagaacgttaccgaagggcaaggagtaccaaccgttttaccgaaggggacacgactacccggacggtaacggtaactttaacgttaagttaacgtaggggaagtacgttggaagccgtaacggcccgttaggaacggtaacgtacccggtaaacggaacccggtaacggggtactttaggttaacgttttaagttttttcggttacggtacccgttacccgttacgttaacggttcggggtaggttaccgttaacgtttaatttaaccggtaccgtttcgttaaacgtttttagacccggtttcccggttacgggggtaccccgtaacgggggtaaaccccctttcgggttacccgaccccgtttccgtccccgttaaccccggg

SEQ ID NO: 260377 - DNA, 574 bp, Homo sapiens
  misc_feature: GYAE6OF01EF1RW.1.5.A05.1.454.CMB.1.raw
  modified_base (284)..(284): a, c, t, g, unknown or other
  misc_feature (284)..(284): n is a, c, g, or t
  modified_base (461)..(461): a, c, t, g, unknown or other
  misc_feature (461)..(461): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccgganaaaggcttgagtggatgggatggatcaacgctggcaagtgtaacaacgaaaaattcacagaagttccagggcagagtacacctttacagggacacatccgcgaggtattactaatataggagctagtagcgagccctaggagaactccgaagacgaacgtctagtacttattttggngtccgtaacttcgtagtggaggttctattagttacgacttacgtagtttagacttccggtacggggtaccaacggggtaaccctacgggtacctacccggtcctccgtaaccg

SEQ ID NO: 260378 - DNA, 713 bp, Homo sapiens
  misc_feature: GYAE6OF01APFTA.1.5.A05.1.454.CMB.1.raw
  modified_base (529)..(529): a, c, t, g, unknown or other
  misc_feature (529)..(529): n is a, c, g, or t
tcagacgagtgcgtcacgaccggtgctcgatttagatagatagacaggggacccaacaaccacatccctcctcagaagcccccagagcacaaccgccccaccatggactggacctggaggatcctctttttggtggcagcagccacaggtgcccactcccaggtccagcttgtgcagtctggggctgaggtgaagaagccgtggggcctcgagtgaaggtttcctgcaaggcttcaggatacacctttcactaggtatgctatacagttgggtgtcgccgacggcccccggacaaaggcttacggagtggacgtgggattgggattcgaacggctggactaagtacggtaaacaactaaaaaattcgaactaaggaaacgtttccgaaggggcaggtaacgtccgtaaccctttaacgaacggggtacaaccgtacgtccggaccggtaaggtactttacgttaagtagtggaagtcgtagaacgcgaacggtcctaggaacgtacggtaccgtaagaccgtacgggtnttacggttatttaggtttttacgcggtaccgttaacccgttgttaacggtacgggtacggttacttaagtttacgttaaccgtccgttacgtaacgttttcgaaccgtttcccggacggggttaccccggtaaccggggttacccctacgggttaccgtaccccgttcccgtccgttaccccgg

SEQ ID NO: 260379 - DNA, 271 bp, Homo sapiens
  misc_feature: GYAE6OF01ESAIY.1.5.A05.1.454.CMB.1.raw
  modified_base (262)..(262): a, c, t, g, unknown or other
  misc_feature (262)..(262): n is a, c, g, or t
  modified_base (264)..(271): a, c, t, g, unknown or other
  misc_feature (264)..(271): n is a, c, g, or t
tcagacgagtgcgtcacgaccggtgctcgatttagatagatagacaggggcagttccagatttcaactgctcatcagcagcctgcagtctgaagattttgctagttttattactgtcagcagtataataactggcctcgacgttcggccaagggaccaaggtgaaatacaaacgactgtggctgcaccatctgtcttcatcctcccgcatctgatcgtactgcgtctggacggcgggtactcggacaagggccgctataggnannnnnnnn

SEQ ID NO: 260380 - DNA, 593 bp, Homo sapiens
  misc_feature: GYAE6OF01BM58G.1.5.A05.1.454.CMB.1.raw
  modified_base (329)..(329): a, c, t, g, unknown or other
  misc_feature (329)..(329): n is a, c, g, or t
  modified_base (470)..(470): a, c, t, g, unknown or other
  misc_feature (470)..(470): n is a, c, g, or t
tcagacgagtgcgtcacgaccggtgctcgatttagatagatagacaggggacccaacaaccacatccctcctcagaacgcccccagagcacaaccgccccaccatggactggacctggaggatcctctttttggtggcagcagccacaggtgcccactcccaggtccagcttgtgcagtctggggctgaggtgaagaagccgtggggcctcgagtgaaggtttcctgcaaggtcttcgagatacaccttcacttaggtatgactatacagttgggtgcgtccacggccccggacgaaaggcttgacgtggatgggatggatcgaacgcngcaatggtaaacactaaaaaattcaacagaagttaccagggcagagtactactttaccgaggacacatccgacgagtattacttatatcggagcttgagcagtcccgagagactaccgaacgacgacggtacttagtattnttttaggcgtacgtaccttcgtaaggttgtacggttactagttacttacgtacgttcgtaaagtttcgtacgtccgttaccgggccgtacggtacccgtcggtcctaacccgtctccgtaccg

SEQ ID NO: 260381 - DNA, 690 bp, Homo sapiens
  misc_feature: GYAE6OF01DPRVV.1.5.A05.1.454.CMB.1.raw
  modified_base (132)..(132): a, c, t, g, unknown or other
  misc_feature (132)..(132): n is a, c, g, or t
  modified_base (221)..(221): a, c, t, g, unknown or other
  misc_feature (221)..(221): n is a, c, g, or t
  modified_base (332)..(332): a, c, t, g, unknown or other
  misc_feature (332)..(332): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggnggcagcagccacaggtgcccactcccaggtccagcttgtgcagtctggggctggaggtgaagagcctggggcctcagtgaaggtttccngcaaggcttcaggatacaccttcactaggtatgactatacagttgggtgcgccacggcccccggacaaaggcttgagtggatgggatggatcaacgctggcaataggtaanaacaaaaaattcaacagaagtttccaagggacagagtacctaaccgtttaccgaacgggacaccaacgtacccgtacgaagggtactttaaccgtttataagttagggagtccgtagtagacgaacgcccttagggaacgtacgttacccggaaagtaacccggtaacggacccttaggtttaatttaacgttttttggtacggtcccggttaccttcgttacgtagggtacgggttcttaacggtttacttaccgtacgttaccgtaaacttttacggacctttacccggtacggggtaccccgaaccggggttacccctacggggtacccttaacccggttcctcccgttacccgg

SEQ ID NO: 260382 - DNA, 729 bp, Homo sapiens
  misc_feature: GYAE6OF01C7T22.1.5.A05.1.454.CMB.1.raw
  modified_base (134)..(134): a, c, t, g, unknown or other
  misc_feature (134)..(134): n is a, c, g, or t
  modified_base (224)..(224): a, c, t, g, unknown or other
  misc_feature (224)..(224): n is a, c, g, or t
tcagacgagtgcgtcacgaccggtgctcgatttagatagatagacaggggacccaacaaccacatccctcctcagaacgcccccagagcacaacgccccaccatggactggacctggaggatccttcttttggnggcagcagccacaggtcgcccactcccaggtccagctgtgcagtcgtgggctgaggtgaagagccgtggggcctcgagtgaaggtttccngcaggcttcgaggatacaccttcacgtaggtatgactatactagttgggtcgcgaccgacggaccccggagaaaggccttgagtggagtggagtggatacgaacgcgtggacaagtggtaaacaactaaaaacttcaactaacgtaacgttaccgaggggacaaggtacgtacctaaccgtttaccgacgggaactacgtaacgtcccggagtacggttaacttacgttaagtacgtagggacgtcgtagtaacgcgtaacgtccgttagaacggaccgttaaccggaaacgaccgtacggggtactttacgttaagtttaagttttcgggacgttacccgtacccgtttgttaaggttaccgggtaggttaaccgttagtttaacgtacccgttagttaaccgttaaagttttaccggtaccgttacccgggttccggggttaacccgaaacccgggttacccggttaccggtaccgttaccccgtcccgttcgtaacccccgg

SEQ ID NO: 260383 - DNA, 559 bp, Homo sapiens
  misc_feature: GYAE6OF01A71G3.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccgacggccccggacaaaggcttggagtggatggggatggatcaacgctggcaatggtaacacaaaaattcacagaagttcgaggcagagtcaccttacaggacacatccgcgaggtattacttatagtgagtctagagcagctgagacgtaccgaagacacggtctagttattagttttgcgtaccgtaccttataggtggtagtctatttacttacgtcttacgtatttgaccttccggtcggggacctacgggtaaccctgggtaccgtaccgttcctcccgtaccg

SEQ ID NO: 260384 - DNA, 691 bp, Homo sapiens
  misc_feature: GYAE6OF01A7STC.1.5.A05.1.454.CMB.1.raw
  modified_base (393)..(393): a, c, t, g, unknown or other
  misc_feature (393)..(393): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggataccaccttcactaggtatgctatacattgggtgcgccaggccccggacaaacggcttgagtggatgggatggatcaacgctggacaataggtaacaacaaaaattcaacaagaagttccagggcagacgtacacctttacaagggtacacatccgngacggtattacttatatggagctagagtacacgccgtagagtacgtacgaaacgaccgacgggtctacggttaatttacgttttttaggtacgtaccggttacccgttaccgttaggttacggggtacggtttaccgtaagttttacgtttaaccggttaccttaaccgtttaaacgtttttacgggtaacccgtttccccgggttacggggggtacccccgttaaaccggggggttaaacccccgtttccgggggttaacccctacccccgggtttcccgttccccgttaaccccgg

SEQ ID NO: 260385 - DNA, 735 bp, Homo sapiens
  misc_feature: GYAE6OF01CSYO1.1.5.A05.1.454.CMB.1.raw
  modified_base (309)..(309): a, c, t, g, unknown or other
  misc_feature (309)..(309): n is a, c, g, or t
tcagacgagtgcgtcacgaccggtgctcgatttagatagatagacaggggacccaacaaccacatccctcctcagaacgcccccagagcacaaccgccccaccatggactggacctggaggatccttctttttggtggcagcagccacaggtcgcccactcccaggtccagcttgtgcagtcgtgggctgaggtgaagaacgccgtggggcctcgagtgtaaggtttcctgacgaaggtcttacgaggatacctaccttctactaggtatgactatactagttgggtcgcgccgaccggcccccggaanaaaggtcttggagtggagtgggagtggatcgaacgcgtggactaagtacggtaaacaaactaaaaacttccaacgaaggtaaacggttccgaagggtaaccaacggtacgttacccgtaacccgtttaaccggaagggaacctaaccgtaacgtcccggacggtaacggtaatttaaccgtttaagtaggttaggggacgtccgttaggacgtccgtaacggtcccttagggaacgtaaccgaccgaaacgaccggtacggtcgttagtttaacgttttagttttcggcgtaccgttacgtcgttaggttacggtagttacgtagttagttacccgtagtagttaacgttacggtaccgttcccggtaggggtaccccgtacgggtaacccgttcggtaccctttacccgtccgttccctacccgg

SEQ ID NO: 260386 - DNA, 702 bp, Homo sapiens
  misc_feature: GYAE6OF01AIH7K.1.5.A05.1.454.CMB.1.raw
  modified_base (133)..(133): a, c, t, g, unknown or other
  misc_feature (133)..(133): n is a, c, g, or t
  modified_base (222)..(222): a, c, t, g, unknown or other
  misc_feature (222)..(222): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggnggcagcagccacaggtgcccactcccaggtccagcttgtgcagtctggggctgaggtgaagagccgtggggcctgagtgaaggtttccngcaaggtcttaggatacaccttcactaggtatgctatacagttgggtgcgccgacggcccccggaacaaacggtcttggaggtggagtgggagtcggatacgacgcgtggacaagtaggtaaaccaactaaaaaagttcaacgtaagtaacgttaccgagggtacaggtacgtacaacccgttttaaccgagggaacctacgtacgtacccgacggtacggtactttaacgttagtagttaggacgtcgtacgtagtacgacggtaccgtacggacggtaacgtaccggaaacgacgtaccgggtactttaggttaacttttacgtttttcggtacgtacccggtaccgttacggtaaggttcgggtacggttactaacgtttacgtaccgtacttacgttaacgtttcgtaacgttccggtcgggtacccgtacgggtaacccgttcggtccgtacccgttcctcccgtacgtaccccg

SEQ ID NO: 260387 - DNA, 601 bp, Homo sapiens
  misc_feature: GYAE6OF01B7VFZ.1.5.A05.1.454.CMB.1.raw
  modified_base (498)..(498): a, c, t, g, unknown or other
  misc_feature (498)..(498): n is a, c, g, or t
tcagacgagtgcgtcacgaccggtgctcgatttagatagatagacagggacccaacaaccacatccctcctcagaagcccccagagcacaacgccccaccatggactggacctggagatcctcttttggtggcagcagccacaggtgcccactcccaggtccagcttgtgcagtctgggctgaggtgaagaagcctggggcctcagtgaaggtttcctgcaaggcttcaggatacaccttcactaggtatgctatacagttgggtgcgccacggccccggacaaaggcttgagtggagtgggatggatcgaacgcgtggacaagtaggtaaacaacaaaaaattcaacaagtaagttaccgagggacaacgtagtacacctttaacgaggacacatccgcgtaggtacttaacttagtataggtagtctagagcacgtcctagagacgtaccgaagaccgacggtcttagttatttagtttttagtacgtcgtacctnttaggtggtacgtcgtattacgttacgtcttacgtactttgtaccgttccgtcgggtaccgacgggtacccgttcggtaccgtacccgttccgtcccgtaccg

SEQ ID NO: 260388 - DNA, 853 bp, Homo sapiens
  misc_feature: GYAE6OF01CMA44.1.5.A05.1.454.CMB.1.raw
  modified_base (223)..(223): a, c, t, g, unknown or other
  misc_feature (223)..(223): n is a, c, g, or t
  modified_base (233)..(233): a, c, t, g, unknown or other
  misc_feature (233)..(233): n is a, c, g, or t
  modified_base (237)..(237): a, c, t, g, unknown or other
  misc_feature (237)..(237): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactccaggtccagcttgtgcagtctggggctggaggtgaagaagccgtggggcctcgagtgaagtttccngcaaggcttnaggntacacttcactaggtatgctatactattggtgcgccgacggccccggacaaaggcttgaggtggagtgggagtggatcaacgctggacaataggtaacaacgaaaaaattacaacaagaacgttaccgaaggggacgaagtaaggtaccaaccgtttaaccgaacggggtaacaacgtactaccggtaccggaagggtaacgtttaaccttaagtttaagttacggggtaacggtacgtttagggtaacgtacccgtaaaggcccttaagggaaccggttaacggtaacccgggtaaaacgggtaacccgaaacgggggttaacttaacggttttaaccgttttaaagttttttttcgttaccgggttaacccggttaacccggtttaacccggtttaacggggtttaaggggtaaacggggtttaacccgtaaaaggtttttaacccggttaaaccgggttttccttttaaacgtaaaccggtttttaccggtaaccttttaccccggggtaccggggggttaaccccccggttaaaccgggggttaaaacccccccggtttaggggtaaccccccgtttaacccggttcccccgtttacccgttaacccccggg

SEQ ID NO: 260389 - DNA, 623 bp, Homo sapiens
  misc_feature: GYAE6OF01BKSRJ.1.5.A05.1.454.CMB.1.raw
  modified_base (483)..(483): a, c, t, g, unknown or other
  misc_feature (483)..(483): n is a, c, g, or t
  modified_base (528)..(528): a, c, t, g, unknown or other
  misc_feature (528)..(528): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggtcttcgaggattaccacctttcactaggtatgactatacagttgggtgcgccacggccccggacaaaggccttggagtggatggggatgggatcgaacgcgtggacaagtaggtaaacaacgtaaaaaattcaacaagaaacgttccgaaggcaagagtacctaaccgtttaacacgggtacactacgtaccgacgaggactttaacttacgtagttggagcgtagagacagcctagagacgtacgaagacgacgnttagtagttaagttttgacgtcgtaccttacgttagtggacgttntagttacgttacgtcttacgtaacttttggacctttcggcggggtaccgaaccgggtaacccttggtacccgtaacccgttccttcccgtacccg

SEQ ID NO: 260390 - DNA, 189 bp, Homo sapiens
  misc_feature: GYAE6OF01EGROV.1.5.A05.1.454.CMB.1.raw
  modified_base (178)..(189): a, c, t, g, unknown or other
  misc_feature (178)..(189): n is a, c, g, or t
tcagacgagtgcgtcacgaccggtgctcgatttagatagatagacagggcaccaagggcccatcggtcttccccctggcaccctcctccaagagcacctctggggcacagcggccctgggctgcctggtcaaggctacttccagtactctatctgagcgggctggcaaggcgcatagnnnnnnnnnnnn

SEQ ID NO: 260391 - DNA, 882 bp, Homo sapiens
  misc_feature: GYAE6OF01ANWPR.1.5.A05.1.454.CMB.1.raw
  modified_base (251)..(251): a, c, t, g, unknown or other
  misc_feature (251)..(251): n is a, c, g, or t
  modified_base (772)..(772): a, c, t, g, unknown or other
  misc_feature (772)..(772): n is a, c, g, or t
tcagacgagtgcgtcacgaccggtgctcgatttagatagatagacagggacccaacaaccacatccctcctcagaacgcccccagacgcaccaaccgccccaccatggactggacctggacggatccttctttttgggtggcaggcagccacgaggtcgcccactcccacggtccagccttgtgcagtcgtggggactggaggtagaaggaacgtcccgtggggcccttcgagttaggtaacggttttccngacgaaggtcttaccgaggactaccacctttcgaacgtttagggtatcgaccttagttaccgtagtttggggtcgccgtaccggtaccgggaccccggtaaccgaaacgggtccgttaggtacgggttgggtaacggttggggaacgttacgggtaacgttaccgaacgggtaccggtacggtacggtaaacgttacggggtaaacctaaaaccgtaaaaacttacgtaacgaaacggtaaaccggtttaccgaaggggtaacccgtaagtaacggtaccgtttaaccccgtttaacggaacgggtaaccgtaccgaaaccggtttccggaacggtaacggtttaacgtttaacgtttaacgttaacggttacgggtaacgttacttgggtaaaccctacgggtaacgtaccgtagggtaacttacggaaccgtaacgacgtacgggtactttaagggttactttaggttttacgtaccggtacgttaccgttacggttaggtacggtcggttaacgtttntacggtttaccgtagtacgtttaacttaccggtacgttccgggtacccgggtaacgtacccggggttaccgttaccggttaccccgtacggttcccctttacggaccccg

SEQ ID NO: 260392 - DNA, 608 bp, Homo sapiens
  misc_feature: GYAE6OF01AR6OA.1.5.A05.1.454.CMB.1.raw
  modified_base (206)..(206): a, c, t, g, unknown or other
  misc_feature (206)..(206): n is a, c, g, or t
  modified_base (220)..(220): a, c, t, g, unknown or other
  misc_feature (220)..(220): n is a, c, g, or t
  modified_base (284)..(284): a, c, t, g, unknown or other
  misc_feature (284)..(284): n is a, c, g, or t
  modified_base (394)..(394): a, c, t, g, unknown or other
  misc_feature (394)..(394): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctnagtgaaggtttccngcaaggcttcaggatacaccttcactaggtatgctatacattgggtgcgccacggcccccgganaaaggcttgagtggatgggatggatcgaacgctggacaagtggtaaacaacaaaaaattcaacagaagttccgagggcagagtccacctttaccgagggacacagtccgngaggtattactatagtggagctagacgcacgtcccgtagaagacgtacccggaaagaccgacggtctaggttaatttacgtttttaggcgtccgttacctcggttaggttggtaggttacatttacgttaacgccttacgtaactttcggaccttccggtaggggaccccgtagggtaccccttgggtacccctaccggtccttcccgtacccg

SEQ ID NO: 260393 - DNA, 215 bp, Homo sapiens
  misc_feature: GYAE6OF01ASYC5.1.5.A05.1.454.CMB.1.raw
  modified_base (103)..(103): a, c, t, g, unknown or other
  misc_feature (103)..(103): n is a, c, g, or t
  modified_base (190)..(215): a, c, t, g, unknown or other
  misc_feature (190)..(215): n is a, c, g, or t
tcagacgagtgcgtcacgaccggtgctcgattttagatagatagacagggcaccaagggcccatcggtcttccccctggcacccctcctccaagagcacctcnggggcacagcggccctgggctgccctggtcaaaggactactttcctcgtctcgactctggagcgggctggaccaaggccgcagtagnnnnnnnnnnnnnnnnnnnnnnnnnn

SEQ ID NO: 260394 - DNA, 704 bp, Homo sapiens
  misc_feature: GYAE6OF01D9DD6.1.5.A05.1.454.CMB.1.raw
  modified_base (137)..(137): a, c, t, g, unknown or other
  misc_feature (137)..(137): n is a, c, g, or t
  modified_base (155)..(155): a, c, t, g, unknown or other
  misc_feature (155)..(155): n is a, c, g, or t
tcagacgagtgcgtcacgaccggtgctcgatttagatagatagacaggggacccaacaaccacatcccctcctcagaacgcccccagagcacaaccgccccaccatggactggacctggaggatccttctttttggnggcagcagccacaggtcncccactcccaggtccagcttgtgcagtctggggctggaggtgaagagccgtggggcctcgagtgtaaggtttccaggacaaggtcttacgaaggtactaccgtacctttacgacgttaaggtatgactaatactagttgggtcgcgccgacggacccggaataagtcgtagagtggagtgggagtaggatacgaacgcgtaggactaagtaacggtaaaacaaacgtaaaaacgttcaacgaaaggtaacgttaccgaacgggactaacggtacgttaccgtaaacccgtttaacggaacgggaacaaccgtacgtaccggacggtaaaggtatttaaacgttaatagtaggacgacgtaggacacgacgtccgtagtacgtactaaccggaagtaccgacggttacgttagtttatttacgtttttggacgttaccgtaccgttacgttaggtaggtacggttactaagtttactcgtacttacgttaacttcgtaccgtcggccggtacgtaaccggtaccgtaggtaccctacgtccgtctacccg

SEQ ID NO: 260395 - DNA, 775 bp, Homo sapiens
  misc_feature: GYAE6OF01EI8PA.1.5.A05.1.454.CMB.1.raw
  modified_base (274)..(274): a, c, t, g, unknown or other
  misc_feature (274)..(274): n is a, c, g, or t
tcagacgagtgcgtcacgaccggtgctcgatttagatagatagacaggggacccaacaaccacatccctcctcagaacgcccccagagcacaaccgccccaccatggactggacctggagatccttctttttggtggcagcagccacaggtgcccactcccaggtccagtcttgtgcagtcgtggggctgaggtgaagacgccgtggggcctcgaggtgtaggtttcctgacgaaggtcttacgaaggataaccgtacctttcaacgttaggtntgacttatacgtagttgggtgccgtaccgaccgggaccccggaacgaacggtcgttaggtaggtacgggtagtggggagttacgggacttaccgaaccgtcgtaggtaccgtaaagttaacggtaaacctaaaacgtaaaaaacttacgaacgtaagtaacgttaccgaggacgtacgtacgtacccttaaccgtttaccggaacggtaccacgtaactcccggacgtacggtagtttacttaagtagtacggtagtccgtagacgacgacgtaccgttaggagtaaccgtacgaacgtacggtacgttacgttacgtttaagtttagtttttcggtacgtacccggttaccgttagttacggtaagggttacggttacttaagtttaccgttacgtaccttacgttaacgttttacgtacggttcccggttacggggaaacccgttaccggggtaacccggtttaccggtaaccgttccccggttcgtcccgtaaccccg

SEQ ID NO: 260396 - DNA, 183 bp, Homo sapiens
  misc_feature: GYAE6OF01COC8Y.1.5.A05.1.454.CMB.1.raw
  modified_base (178)..(183): a, c, t, g, unknown or other
  misc_feature (178)..(183): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctctctcgactctgagcgggctggcaaggcgcatagnnnnnn

SEQ ID NO: 260397 - DNA, 570 bp, Homo sapiens
  misc_feature: GYAE6OF01BCGT9.1.5.A05.1.454.CMB.1.raw
  modified_base (458)..(458): a, c, t, g, unknown or other
  misc_feature (458)..(458): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgacgtggagtgggatggatcgaacgctggcaatggtaacaacaaaaattcacagaagtccagggcagagtcacctttacgagggacacactccgcgaggattactatagtggagctgagcagcctagagactaccgaagaccgacggtctagttattatttttagngtccgtaccttcgtagttggacgttacgatttacgttaccgcttataacgtttgaccttccggtcggggtaccacggggtacccctggtaccctaccgtctcccgtacccgg

SEQ ID NO: 260398 - DNA, 293 bp, Homo sapiens
  misc_feature: GYAE6OF01EKKID.1.5.A05.1.454.CMB.1.raw
  modified_base (200)..(200): a, c, t, g, unknown or other
  misc_feature (200)..(200): n is a, c, g, or t
  modified_base (223)..(223): a, c, t, g, unknown or other
  misc_feature (223)..(223): n is a, c, g, or t
  modified_base (232)..(232): a, c, t, g, unknown or other
  misc_feature (232)..(232): n is a, c, g, or t
  modified_base (263)..(264): a, c, t, g, unknown or other
  misc_feature (263)..(264): n is a, c, g, or t
  modified_base (266)..(293): a, c, t, g, unknown or other
  misc_feature (266)..(293): n is a, c, g, or t
tcagacgagtgcgtcacgaccggtgctcgatttagatagatagacagggggcagttccagatttcaactgctcatcagcagcctgcagtctgaagattttgctagttttatactgtcagcagtataataacgtggcctccgacgtttcggccaagggaccaaggtgaaatcaaacgatgtggctgcaccgatctgtcttnacttccttcccgctatcgtgagngtgcctctntggagcgggctaggcaaaggcgcaatacggnngnnnnnnnnnnnnnnnnnnnnnnnnnnnn

SEQ ID NO: 260399 - DNA, 264 bp, Homo sapiens
  misc_feature: GYAE6OF01D4P19.1.5.A05.1.454.CMB.1.raw
  modified_base (259)..(264): a, c, t, g, unknown or other
  misc_feature (259)..(264): n is a, c, g, or t
tcagacgagtgcgtcacgaccggtgctcgatttagatagatagacaggggcagttccagatttcaactgctcatcagcagcctgcagtctgaagattttgctagtttattactgtcagcagtataataactggcctccgacgttcggccaagggaccaaggtggaaatcaaacgaactgtggctgcaccatctgtcttcatccttcccgctatctagagagtcgccgtactctggagcgggctgggcaaggcgcatagnnnnnn

SEQ ID NO: 260400 - DNA, 190 bp, Homo sapiens
  misc_feature: GYAE6OF01B47R9.1.5.A05.1.454.CMB.1.raw
  modified_base (177)..(190): a, c, t, g, unknown or other
  misc_feature (177)..(190): n is a, c, g, or t
tcagacgagtgcgtcacgaccggtgctcgatttagatagatagacagggcaccaagggccatcgatcttcccctggcaccctcctccaagagcacctctggggcacagcggccctgggctgcctggtcaaggactacttcctgtcgagcgtctgagcgggctggcaaggcgcatagnnnnnnnnnnnnnn

SEQ ID NO: 260401 - DNA, 777 bp, Homo sapiens
  misc_feature: GYAE6OF01AOI8N.1.5.A05.1.454.CMB.1.raw
tcagacgagtgcgtcacgaccggtgctcgatttagatagatagacaggggacccaacaaccacatccctcctcagaacgcccccagagcacaaccgccccaccatggactggacctggaggatcctcttttggtggcagcagccacaggtgcccactcccaggtccagcttgtgcagtcgtggggctggaggtgaagaagccgtggggcctcgagtgaaggtttcctggcaaggtcttcaggataccgtaccttcactaggtatgtctatactagttgggtcgccgccgaccggccccggaacgaaacggtcgttgaggtcggagtgggatggacgtacgaacggcgtaggactaagtacggtaaacaaactaaaaacttcgaacgtaaggtaaacggttccgaagggtacgaacggtacgtaacccgtaacccgtttaacccgacggggtaaacctaccgtaaacggtcccggacggtaaacgggttaactttaactttaacggtaagttacgggtacgtacggttacgaaggtaccgacgtaccgtaggacgtaaccgtacggaaacgtacccgtacggtattacggttaagtttgttttacggtacgtacggtaccgttacggttaggttacgggtacgggttaactacgttttaaacgtccgttacgttaacgtttaccgtttacggtaccggtttcccgggttagggaaccccggttaaccgggtaaccccggttgggttaacccctcccggttaccgtccccggtaccccg

SEQ ID NO: 260402 - DNA, 533 bp, Homo sapiens
  misc_feature: GYAE6OF01C63B9.1.5.A05.1.454.CMB.1.raw
  modified_base (221)..(221): a, c, t, g, unknown or other
  misc_feature (221)..(221): n is a, c, g, or t
  modified_base (252)..(252): a, c, t, g, unknown or other
  misc_feature (252)..(252): n is a, c, g, or t
  modified_base (283)..(283): a, c, t, g, unknown or other
  misc_feature (283)..(283): n is a, c, g, or t
  modified_base (404)..(404): a, c, t, g, unknown or other
  misc_feature (404)..(404): n is a, c, g, or t
  modified_base (488)..(488): a, c, t, g, unknown or other
  misc_feature (488)..(488): n is a, c, g, or t
  modified_base (494)..(494): a, c, t, g, unknown or other
  misc_feature (494)..(494): n is a, c, g, or t
tcagacgagtgcgtcacgaccggtgctcgatttagatagatagacaggggacccaacaaccacatcccctcctcagaagcccccagagcacaacgccccaccatggactggacctggagatcctcttttggtggcagcagccacaggtgcccactcccaggtccagcttgtgcagtctggggctgaggtgaagaagcctggggcctcagtgaaggtttccngcaaggcttcaggatacaccttcactaggtntgctatacattgggtgcgccaggccccgganaaaggcttgagtggatgggatggatcaacgctggcaatggtaaacaacaaaaaattcaacagaagttccagggcagagtcaccttacagggacacatccgcgaggtattacttatatgganctgagcaagcctgagataccgaagacacggtctgttattagttttgtgcgtactcgtagtggagtcattatacgctcaagtttnacttcncggggccacgggtacccttggaccacccgtctcctaccg

SEQ ID NO: 260403 - DNA, 826 bp, Homo sapiens
  misc_feature: GYAE6OF01BP7OZ.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtcgtggggctgaggtgaagagccgtggggcctcgagtgaaggtttcctgcgaaggtcttcgaggataccaccttcactaggtatgctatacagttgggtgcgccgacggccccgacgaaaggcgttagaggtggagtggggatggactcgaacggcgtggactaagtacggtaaaaccaaacgtaaaaaacttcgaacgtaacggtaacgttaccgaagggacgaacggtacgtacctaaacccgtttaaccgaacgggtaaccaacgtaacgtacccggacggtaacgggttaactttaacgtttaacgttaaggttacggggtaacgtacggttaggaacgtaccgtaacggtacccgttagggtaacgtaacgtaacccgggaaacggtaacccggtaaccgggtaccgtttaacggtttaacgttttaacggttttttacggtaccggtacccgttaacccgtttacggttaacggggttacgggtaacggttacttaacgttttaaacgttacccggtacctttaaccgttaacggtttttacggaacccggtttcccgggtaaccgggggtaccccgtaaaccgggggttaaccccgttaccgggttaaccccgtaccccgtttcccgttccccgttaacccggg

SEQ ID NO: 260404 - DNA, 356 bp, Homo sapiens
  misc_feature: GYAE6OF01DQLO5.1.5.A05.1.454.CMB.1.raw
  modified_base (96)..(96): a, c, t, g, unknown or other
  misc_feature (96)..(96): n is a, c, g, or t
  modified_base (221)..(221): a, c, t, g, unknown or other
  misc_feature (221)..(221): n is a, c, g, or t
  modified_base (285)..(285): a, c, t, g, unknown or other
  misc_feature (285)..(285): n is a, c, g, or t
  modified_base (292)..(300): a, c, t, g, unknown or other
  misc_feature (292)..(300): n is a, c, g, or t
  modified_base (302)..(356): a, c, t, g, unknown or other
  misc_feature (302)..(356): n is a, c, g, or t
tcagacgagtgcgtcacgaccggtgctcgatttagatagatagacaggggcagttccagatttcaactgctcatcagcagcctgcagtctgaagtnttttgctagttttattactgtacagcagtataaatacgtcggcctcgtacgtcggacgaacgggaccaagggtagaaatcaaaacgatggtgactgcaccatctgtctactacttccgttcccgntacttcgtagtacttcgtacgcggcgtgtggcgggacggcgtaggacggaacggcgtacaagtnagctgannnnnnnnnannnnnnnnnnnnnnnnnnnnnnnnnnnnnnnnnnnnnnnnnnnnnnnnnnnnnnn

SEQ ID NO: 260405 - DNA, 872 bp, Homo sapiens
  misc_feature: GYAE6OF01ESOJB.1.5.A05.1.454.CMB.1.raw
  modified_base (298)..(298): a, c, t, g, unknown or other
  misc_feature (298)..(298): n is a, c, g, or t
tcagacgagtgcgtcacgaccggtgctcgattttagatagatagacagggggacccaacaaccacatccctcctcagaagcccccagagcacaacgccccaccatggactggacctggaggatcctctttttggtggcagcagccactagggtgcccactcccaggtcccagtcttgtgcagtctggggctgaggtgaagagccgtggggcctcgagtgaaggtttcctgcaaggcttcgaggactacgaccttcactaggtatgctatacattgggtgcgtccacggcccccggaanaaaacgggtccttagacggtgggagtagggggagtcgggatccgaaacggcgttagggaccgaaagttgggtaaaacgaacgtaaaaaaacttcgtaaacgaaggtaaaacggtttaccgaagggtacgtaaggtaacggttaccgtaaacccgttttaacccgaacgggggtaacccaaccgtaacgtacccggacggtaacgggtaacgttttaaccgtttaacttaacgtaggggtaacggacgtttaggaacggtctaaggtaccccgtttaaggaaacggtaacgtttacccgggaaaacgtaccggaaccgggttaccgttaggttaaacgtttaacgtttttttacgggtaccggtacccggtaaaccccgttttacgggttaaacgggttaccggggtaagggtttacccggttaagttttaacggtttaaccgttaccgtttaacgttaaacggtttttacggtaacccggttaccggttacgggggggtaacccctaaacggggggtaaacccccgttggggttaacccgtaccccgggttaacccgtcccggtttaaccccgg

SEQ ID NO: 260406 - DNA, 769 bp, Homo sapiens
  misc_feature: GYAE6OF01ENZTK.1.5.A05.1.454.CMB.1.raw
  modified_base (210)..(210): a, c, t, g, unknown or other
  misc_feature (210)..(210): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtcgtggggctggaggtgaagagccgtggggcctnagtgtaaggtttcctgcaaggtcttcgaggactacctaccttcgacgttaggtatgacttatacagttgggtgccgccgacggccccggaagaaacggtccttggaggtggagtgggagtaggatacgaacgcgtggacaagtaggtaaacaacgtaaaaaattaccaacaagtaacgttaccgaagggacaagagtacctaaccgtttaaccgaagggaaccacgtaacgtacccggacggtaacggtaactttaacgttaagttaacgttagggtacgtaccgttaggaacgtacgtaaccggtcccgtagggtaacggtaacgtacccggaaacgaaccggtaaccgggtacttacggtttaagttttaacgttttttagggtacgtacccgttacccgttacgttacgggttagggtaacgggtttacgtaagttttaacgttaccgtacctttagtaaacgttttacggaaccgtttcccgggacgggggtacccgtaaaccggggtaccccgttcgggttaacctaccccggttccgttccccgttaacccgg

SEQ ID NO: 260407 - DNA, 842 bp, Homo sapiens
  misc_feature: GYAE6OF01DNOQP.1.5.A05.1.454.CMB.1.raw
  modified_base (137)..(137): a, c, t, g, unknown or other
  misc_feature (137)..(137): n is a, c, g, or t
  modified_base (149)..(149): a, c, t, g, unknown or other
  misc_feature (149)..(149): n is a, c, g, or t
  modified_base (230)..(230): a, c, t, g, unknown or other
  misc_feature (230)..(230): n is a, c, g, or t
  modified_base (369)..(369): a, c, t, g, unknown or other
  misc_feature (369)..(369): n is a, c, g, or t
tcagacgagtgcgtcacgaccggtgctcgatttagatagatagacaggggacccaacaaccacatccctcctcagaacgcccccagagcaacaaccgccccaccatggactggacctggagattccttctttttggnggcagcagccanaggtgcccactcccaggtccagcttgtgcagtcgtggggctggaggtgaagagccgtggggcctgagtggtaaggtttccngacaaggtcttgaggtactacctaccttacgactaggtatcgacttaatacgtagttcgggcgaccgacccgaccggggaccccggtaagaaacgggtcttaggacggttagggacgttagggggaacttcgggtaacnccgaaacggtcgtagggtacctaaaaggtttacggaaaaacaaaaaccttaaaaaacgttccgaaaacgtaacggtaaacggtttaccggaagggtacgtaacgtaacggtacccttaaccgtttacggaacggaccgtaaccacggtccggagtaacggttactttaacgttaatacggtaaggggtacgtcgtagtacgacgtacgtccgtagaacgtaccggtaccggaacgaccggtacggtactttggttttaatttacggtttttcggacggttacccgttaaccgtttcggttaacgggttaggggttacgttaacggttaacgtttaacgttaccggttaccttttaaacggttaccgttttacgggttaacccggttccggggttaccgggtaaccccggggttaacccggtaaccccggttcgggtaaccccttccccggttcccgttccccgttaacccggg

SEQ ID NO: 260408 - DNA, 815 bp, Homo sapiens
  misc_feature: GYAE6OF01CSZ69.1.5.A05.1.454.CMB.1.raw
  modified_base (226)..(226): a, c, t, g, unknown or other
  misc_feature (226)..(226): n is a, c, g, or t
tcagacgagtgcgtcacgaccggtgctcgatttagatagatagacaggggacccaacaaccacatccctcctcagaacgcccccagagcacaacgccccaccatggactggacctggaggatccttctttttggtggcagcagccacaggtgcccactcccaggtccagcttgtgcagtctggggctgaggtgaagaagccgtggggcctcagtgtaaggtttccngcaaggtcttcgaggtactactaccttctacgtaggtatcgctactacgtagttcgggtgccgacccgacggaccccggaacgaaggtcgttaggaggtggagtgggagttggactacgacgtacgtggactaaagtacggtaaaacaaacgtaaaaatccaagaacgtaacgttaccgaacgggacgaaggtacgttacctaaaccgtttaccggaacgggtaaccaacgtaacgtacccggacggtaaacgttaacttttaacgttaacggttagtacggggtaacgttaccgttagggaacgtacggtaaaccggtccgttaacgggaacggtaaacccgttaacccgggaaaacgtccgggttaaaccgttacggtttaacgttttaagttttaacgtttttacggcgtaacccgttaccgtttacgggtagggttcgggtacgttacttaacggtttaacgttacccgtacttaacgttttaacgtttaggacccgtttaccgggttacggggaaccccggtacggggttaaaccccccgttacgggtaccccgtttaacccgttccgttcccccgtaccccgg

SEQ ID NO: 260409 - DNA, 802 bp, Homo sapiens
  misc_feature: GYAE6OF01BZJ7P.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcgagtgaaggtttcctgacaaggtcttcaggtactaccaccttcacgtaggtatgctatactagttgggtcgcggccgacgggcccccggacaaacggcttggagtgggagtgggatggatacgacgcgtggactaagtacggttaaacaactaaaaaacttcgaacgtaacggtaacgtttaccgagggacgaagtaacgtccgtaaccctttaaccggaagggacccaagtaccgtacccgggacgtaagggtactttaacgtttaattagtacgggtagtacggttaggaacggtcgtaaccggtaccgtacgggaacgtaccggttaacccggaaacggtaacccgaacgggttacgttttcggtttaaagtttttacggttttttacggtaccgggtacccgttaccggtttaaccggttagggttacgggtacggttacgttaacgttttaacggtttaccgtaccgtttaaacgttacgttttaacggtaacccggtttcccggttacgggggacccccggttaaaccggggttacccggtaccgggtttaccccgtaaccccggttcccgtttaccccgttaccccgg

SEQ ID NO: 260410 - DNA, 818 bp, Homo sapiens
  misc_feature: GYAE6OF01DZNY5.1.5.A05.1.454.CMB.1.raw
  modified_base (135)..(135): a, c, t, g, unknown or other
  misc_feature (135)..(135): n is a, c, g, or t
  modified_base (227)..(227): a, c, t, g, unknown or other
  misc_feature (227)..(227): n is a, c, g, or t
tcagacgagtgcgtcacgaccggtgctcgatttagatagatagacaggggacccaacaaccacatccctcctcagaacgcccccagagcacaaccgccccaccatggactggacctggagatccttctttttggnggcagcagccacaggtcgcccactcccaggtccagcttgtgcagtcgtgggctggaggtgaagagccgtggggcctgagtgtaacgtttccngcgaaggtcttcgaaggataacctaccttcacgtaggtatgtctatactagttggtcgcggtacccgaccgggacccccgaagaacggtcgttaggaggtagggacggtggggtagtaggtactacgaacggtcgtaggactaacgttaacggtaaaactaaaactaaaaacgtaccgtaacgaaacgttaaccggttaccggagggtacgaacggttacgtaaccccgttaaacccggtttaccgaacggggtaacccacggtaaccgtaccggaacggtaacggttaactttacgttaagtacgttagggacttacggtaggtaccgaggtaccggtaccgtaacggtaacgaacggtaacccggaacggtaccgaccggtttattacggtttaagtttcggttttaggaccggtaacgttacccggtttacgttaaggtacgggttaccgtttacgttaacgtttaccgttacgtaacctttagtttaacggtttacgacccgggttccggtaccggggttaacccgtaacccggggtttaccggttacccggttacccgttacccggttccgttacccctacccggg

SEQ ID NO: 260411 - DNA, 725 bp, Homo sapiens
  misc_feature: GYAE6OF01BA26D.1.5.A05.1.454.CMB.1.raw
tcagacgagtgcgtcacgaccggtgctcgatttagatagatagacaggggacccaacaaccacatccctcctcagaacgcccccagagcacaacgccccaccatggactggacctggagatcctcttttggtggcagcagccacaggtcgcccactcccaggtccagcttgtgcagtcgtgggctgaggtgaagacgccgtgggcctcgaggtgtaacggtttcctgcgaaggtcttcgaggactaccaccttcaacgtaggtatgacttatacgtagttgggtcgccggaccgaccgggaccccggaagaaacggtcgttaggaggtggtaggtagggtataggactaccggaacgtcgtaggacgtaagtaacggtaaaactaaacgtaaaaacttacaaccggtaagtaaccggtacggagggacgtaacgtaaccgttaccgtaacccgtttaacgaacgggtaaccaccggtacgtaccggtacgtaacggttaacttacgttaacgtagtacggagtcggtacgacggactacgtacgaagtacgtaccgaaccggaacgtaccgtggttaactttagtttacgtttaagttccggtacggtaccgttacgttaggtacgttaggtacgttattacgttactacgttactaacgttcgttacggaccggttcggaccggaccggtaacgttccgtacgtaccctcgtccgcgtaccccg

SEQ ID NO: 260412 - DNA, 815 bp, Homo sapiens
  misc_feature: GYAE6OF01CER3T.1.5.A05.1.454.CMB.1.raw
  modified_base (229)..(229): a, c, t, g, unknown or other
  misc_feature (229)..(229): n is a, c, g, or t
tcagacgagtgcgtcacgaccggtgctcgatttagatagatagacaggggacccaacaaccacatccctcctcagaacgcccccagagcacaaccgccccaccatggactggacctggaggatccttcttttggtggcagcagccacaggtgcccactcccaggtccagcttgtgcagtcgtggggctgaggtgaagacggccgtggggcctgaggtgtaaggtttccngcgaaggtcttacgaggtaatacctaccttcacgttaggtatgactactactagttgggtcgccgtaccgaccggaccccggagaaacggtccttaggaggtaggacggtgggagttgggactacgaacgtcgtaggactaagtacggtaaacaaacgtaaaaattccgaactaacggtaacgttaccgaacgggacaacggtacgtacctaaccgtttaaccggaaggtacaaccgtagtacccggagggtaacgggttaactttaaccgtttaagttacgtaggggtaacgtcgttaacggacggtacctagggttacccgtaaggtaacgtaaccggtaacggaaacggtaccgtaacggttaccgttaagtttagtttaacgttttacggttaccgtaccggttacctttaacggtagggtttaaccgggtacgttattaaccggttaattccgtaaccgtttacgttaaacgttttcccgaccggttttacccggggtacgggggtaacccccggttaacggggttaacccccgttaccggtaccggttaaccccctttcccgggtacccgttaccccggg

SEQ ID NO: 260413 - DNA, 782 bp, Homo sapiens
  misc_feature: GYAE6OF01CUI0X.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagccgtggggcctcagtgaaggtttcctgcaaggcttcgaggatacaccttcactaggtatgctatacattgggtgcgccacggccccggacaaaggcttgagtggagtgggatggatcgaacgcgtggactaagtggtaaacaactaaaaattcaacgaagtaacgttaccgaagggacaaggtacgtactaacccgtttaaccgaacggggaccaaccgacgttacccggacggtaagggtaactttaaccgtttaagttacgtagggtaacgtacgttaggaacggtaccgtaacggcccgttaggaacggtaaccgttacccggaaacggtaaccgaaccgggtacctttagggtttaacttttaaggttttttacggtacggttaccggtacccgtttacgtttaacggttacggggtacggttaccgttaaacgttttagtttaacccggttaccgtttaaccgtttaaacgttttacgggttaacccgtttccccgggttacggggggtaccccgtaacccgggggttaaaccccgttacgggttaccccgttaaccccggttccgttccccgttaccccgg

SEQ ID NO: 260414 - DNA, 264 bp, Homo sapiens
  misc_feature: GYAE6OF01A9PJO.1.5.A05.1.454.CMB.1.raw
  modified_base (259)..(264): a, c, t, g, unknown or other
  misc_feature (259)..(264): n is a, c, g, or t
tcagacgagtgcgtcacgaccggtgctcgatttagatagatagacaggggcagttccagatttcaactgctcatcagcagcctgcagtctgaagattttgctagtttattactgtcagcagtataataactggcctccgacgttcggaccaagggaccaaggtggaaatcaaacgactgtggctgcaccatctgtcttcatcttcccgcatctgatcgtactgcgctggacggcgggctggacaagggccgacataggnnnnnn

SEQ ID NO: 260415 - DNA, 823 bp, Homo sapiens
  misc_feature: GYAE6OF01CYA1V.1.5.A05.1.454.CMB.1.raw
  modified_base (272)..(272): a, c, t, g, unknown or other
  misc_feature (272)..(272): n is a, c, g, or t
  modified_base (288)..(288): a, c, t, g, unknown or other
  misc_feature (288)..(288): n is a, c, g, or t
tcagacgagtgcgtcacgaccggtgctcgatttagatagatagacaggggacccaacaaccacatccctcctcagaacgcccccagagcacaacgccccaccatggactggacctggaggatcctcttttggtggcagcagccacaggtcgcccactcccaggtccagcttgtgcagtctggggctgaggtgaagagccgtggggcctcagtgaaggtttcctgcaaggcttcaggataccaccttcacgtaggtatgctatacagttgggncgccacggccccgganaaacggcttggagtggagtgggatggatcgaacggcgtaggactaagtaggtaaaacaaactaaaaaaacttccaaactaacggtaacgtttaccgaagggtacaaggtacgttaccttaacccgtttaaccggaaacggggacctaacgtaccgttacccggaacggtacgggttaacttttaaccgttaagttacggttaagggtaacgtacgttaacggaaggtaccaacgggtcccgttaagggaaccggttaacgttaaccccggaaagtacccgaacgggttacccgttaagggtttaacgttttaagttttttcgggtacgttaccccgggttaacctttccggttaaggggttacgggtacgggtttactttaaacgtttacggttttaacccggtacctttaccgttaaaaggttttccggtaccccggttaacccggggttacccggggggaaaccccggttaacgggggttaaccccccttaggggttaacccccttcccggttacccgttccccgttacccgg

SEQ ID NO: 260416 - DNA, 772 bp, Homo sapiens
  misc_feature: GYAE6OF01EX4O5.1.5.A05.1.454.CMB.1.raw
tcagacgagtgcgtcacgaccggtgctcgatttagatagatagacaggggacccaacaaccacatccctcctcagaagcccccagagcacaaccgccccaccatggactggacctggaggatccttctttttggtggcagcagccacaggtcgcccactcccaggtccagcttgtgcagtcgtggggctggaggtgaagagccgtggggcctcgaggtagtaaggtttccctggcaaggtcttacgaggtactaccaccttcacgtaggtatgactatactagttgggtgcgccgacggaccccgagaaacggtcttgaggtggagtgggataggactcgaacggcgtaggactaagtacggtaaaactaaactaaaaaacttacgaaactaacggtaaacggtttacccgaaggggacaacggaacgttacccgtaacccgtttaaccggaacgggtaaccaaccgtaacgtcccggacggtaacggtactttaacttagttaagtcggagtcgtagacgcgacgtccgtagaacgaacgtacccgaaggtaccgacgggtaccttaggtttaacttttacgtttttcggtacggtaccgtaaccgtttaccggttaaggttacgggtaacgttaccttaaggttttacgtttaacccgtaccttacgtttaacgttttaccggtaccggttcccgggttaccggggaacccgttaccggggtaaaccccgttcgggtaacccttaccccggtttccctcccggttacccg

SEQ ID NO: 260417 - DNA, 764 bp, Homo sapiens
  misc_feature: GYAE6OF01DYB96.1.5.A05.1.454.CMB.1.raw
  modified_base (136)..(136): a, c, t, g, unknown or other
  misc_feature (136)..(136): n is a, c, g, or t
  modified_base (187)..(187): a, c, t, g, unknown or other
  misc_feature (187)..(187): n is a, c, g, or t
  modified_base (232)..(232): a, c, t, g, unknown or other
  misc_feature (232)..(232): n is a, c, g, or t
  modified_base (265)..(265): a, c, t, g, unknown or other
  misc_feature (265)..(265): n is a, c, g, or t
tcagacgagtgcgtcacgaccggtgctcgatttagatagatagacaggggacccaacaaccacatccctcctcagaacgcccccagagcacaaccgccccacatggactggacctggagattccttcgtttttggnggcagcagccacgaggtcgcccactcccgaggtccagtcttgtgcagtcgnggggctggaggtagaagacgcgtcgggcctgagtgtacgtttccngacgaaggtcttacgaaggactacctaccttanaacgttaggttactgtacgtaactacgtaggttgggtcgccgacccgaccgggaaccccggaagtaaacggtcgttaggaggttagggagtgggacgtaggtacgtacgaacggcgtacggaactaaaggtaacgtaaaacaaaactaaaaaacgttccaaagtaaacggtaacgtcggaagggactaacggtacgttacctaaaccgttacggaaggacctaacgtacgtacgacgtagttaacttatacgagtggagtcgtagacgacgtacgacgtaagactaccgtaaaccggaacgtaacggtcggtaactttacgttaagtttacgtttttacggaccggttaccgttaaccgttggtttacggtacgggtacgtttaactacgtttaacgtacgttaacttacgtttaacggttaccggttaccgccggggtttacgggaacccgttaacccgtaaccggttccggtaaccttcccgttcctcccgtacccg

SEQ ID NO: 260418 - DNA, 192 bp, Homo sapiens
  misc_feature: GYAE6OF01EUWFJ.1.5.A05.1.454.CMB.1.raw
  modified_base (179)..(192): a, c, t, g, unknown or other
  misc_feature (179)..(192): n is a, c, g, or t
tcagacgagtgcgtcacgaccggtgctcgatttagatagatagacagggcaccaagggcccatcggtcttcccctggcaccctcctccaagagcacctcgtggggcacaggcggcctgggctgcctggtcaaggactacttccagtactctatctgagcgggctggcaaggcgcatagnnnnnnnnnnnnnn

SEQ ID NO: 260419 - DNA, 788 bp, Homo sapiens
  misc_feature: GYAE6OF01DETAP.1.5.A05.1.454.CMB.1.raw
tcagacgagtgcgtcacgaccggtgctcgatttagatagatagacaggggacccaacaaccacatccctcctcagaacgcccccagagcacaaccgccccaccatggactggacctggagatccttctttttggtggcagcagccacaggtcgcccactccccaggtccagtcttgtgcagtcgtggggctggaggtgaagagccgtggggcctcagtgtaacggtttcctgacaaggtcttacgaggtatacctacctttcacgttaggtatgactatactagttggtgccgccgacggcccgaacgaagcgttgaggtggagtggtagtggatcgaacgcgtgggacctaaagtacggtaaaacgtaactaaaaaaactttcaacgtaagtaaacgtttaccggaagggacaaggtacgtaccttaaccgttaccgtaacgggactaacgacgttaccgacggtaggttaactttaacgttaagtacgttagggacgtacgttggacgacgtaccggtaccttagggaacggtaacctaacccggaaacggtaaccggtaccggtacgtttacgtttttaagtttaacggtttttttacggacggttaccggttaaccgtttaccgttacggggttaagggttaacggttacgttaaacgttttacgttaccggttacctttacgttaaacgtttacggttaccccggtaccggttaccggggaacccgttaacggggttaaccccttacgggtaccccgttaccgttccgttccccgttaacccg

SEQ ID NO: 260420 - DNA, 955 bp, Homo sapiens
  misc_feature: GYAE6OF01ERE5B.1.5.A05.1.454.CMB.1.raw
tcagacgagtgcgtcacgaccggtgctcgatttagatagatagacaggggacccaacaaccacatccctcctcagaacgcccccagagcacaaccgccccaccatggactggacctggaggatccttctttttggtggcagcagccacaggtcgcccactcccaggtccagcttgtgcagtcgtggggctggaggtgaaagacgtccgtggggcctacgaggttagtaaggttttccctgacgaacgggtctttacgaaggtactaacctacctttcgaacgttagggttaatggtaccttattaacgaggttttcgggtacggtccgacccggaccgggtaaccccccggaaacgaaaacgggttcctttaggagggttagggacgttgggggtattcgggaacttccggaaaccgtccggttacgggaactaaaggttaacggttaaaaccaaaactaaaaaaacgtttaccgaaacgtaaacggtaaacgtttacccggaacgggtacgtaaacggacgttaaccccttaaacccgtttaaccggaaacggggaccctaaccgtaaccgtacccgggaaccggtaacggttaacttttaaccttaaggtttacggtaacgggacgttaccgtaggtaacggtaccgacggtacccgttaagggaccgttaaaccgtaacccggggaaacgtaacccggtaaccggtacggttttacgtttaacggttttttacgtttttagggacccgggttaccgttaaccccggtttttacgggttaaggttaccgggggttaacgtttcgttaagttttaacgttacccggttacgtttaaacgtttaacggtttacggtaccccggtttccggggtaacccggggtaacccggttaaacccggggttacccggttacggttacccccggttaacccgttttccggaccccttacccgg

SEQ ID NO: 260421 - DNA, 265 bp, Homo sapiens
  misc_feature: GYAE6OF01BGL7T.1.5.A05.1.454.CMB.1.raw
  modified_base (219)..(219): a, c, t, g, unknown or other
  misc_feature (219)..(219): n is a, c, g, or t
  modified_base (222)..(222): a, c, t, g, unknown or other
  misc_feature (222)..(222): n is a, c, g, or t
  modified_base (251)..(265): a, c, t, g, unknown or other
  misc_feature (251)..(265): n is a, c, g, or t
tcagacgagtgcgtcacgaccggtgctcgatttagatagatagacaggggcagttccagatttcaactgctcatcagcagcctgcagtctgaagattttgctagttttattactgtcagcagtataataactggcctccgacgttcggccaagggaccaaggtgaaatcaaacgaactgtggctgcacatctgtcttcatctccgcatctgatcgtacngcnctgacgcgggctggcaaggcgacagtagnnnnnnnnnnnnnnn

SEQ ID NO: 260422 - DNA, 766 bp, Homo sapiens
  misc_feature: GYAE6OF01B1K6O.1.5.A05.1.454.CMB.1.raw
  modified_base (152)..(152): a, c, t, g, unknown or other
  misc_feature (152)..(152): n is a, c, g, or t
  modified_base (215)..(215): a, c, t, g, unknown or other
  misc_feature (215)..(215): n is a, c, g, or t
  modified_base (229)..(229): a, c, t, g, unknown or other
  misc_feature (229)..(229): n is a, c, g, or t
  modified_base (261)..(261): a, c, t, g, unknown or other
  misc_feature (261)..(261): n is a, c, g, or t
  modified_base (581)..(581): a, c, t, g, unknown or other
  misc_feature (581)..(581): n is a, c, g, or t
tcagacgagtgcgtcacgaccggtgctcgatttagatagatagacagggacccaacaaccacatccctcctcagaacgcccccagagcacaaccgccccaccatggactggacctggaggatccttcttttggtggcagcagccacaggtcncccactcccaggtccagcttgtcgctaggtcgtggggctggaggtagaagagccgtgggcctnaggtgtagtttccngacgaggcttcgagactacacttcattaggtntgctatactagttgggtgcggccgaccggaccccggaacgaaacggtcgttaggaggtaggtaggtgggtagttcggactacgaaccggtcgtacggactaaggtaacggtaaaactaaaacgtaaaaagtaaccaacgtaacgtaacggttaccggaacgggtacgaaacggtacgtaaccgtaacccgttttaaacggaacgggtaacctaaccgtaaccgtacccggtaccggaaggtttaacgtttaacttaacgttagtacgggttagccgtaggacgacgaacgtcgtagagttaccgacgaagaccgtacggngttaacgttagtttagtttcgtacggtaccgtaccgttacgtagggtaggttacggtactttagtttacccgttacgttattaccgttaagtttaccggttacccgttcgggtacccgggtaaacccgggaaccggtaccccggttacccgtacccgaacccggtttaccctccggttaaccccg

SEQ ID NO: 260423 - DNA, 713 bp, Homo sapiens
  misc_feature: GYAE6OF01B62Z6.1.5.A05.1.454.CMB.1.raw
  modified_base (206)..(206): a, c, t, g, unknown or other
  misc_feature (206)..(206): n is a, c, g, or t
  modified_base (285)..(285): a, c, t, g, unknown or other
  misc_feature (285)..(285): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctgggctgaggtgaagagcctggggcctnagtgaaggtttcctgcaaggcttcaggatacaccttcacgtaggtatgctatacgattgggtgcgccacggccccgganaaaggcttgagtggagtggatgatcaacgctaggctaagtcggtaaacaactaaaaaacttcaacaagtaacgttacccgaagggacaacggtacgttaccgtaacccgtttaaccggaaggggaaccaaccgtaacgtacccgggacggtaacgggtaacttttaaccgttaagttaggtacgggacgtacgttaggacggtacacggtaccgtagaacggaacgtaaccggaaacgtaccgacggtacgttagttaagtttacgtttttagtcggtaccgtaccgttaccgttaaggttacgggtaggttacttacgtttagttaccgtccgtttacgttaaagttttccgacggttcccggtacggggtacccgaacgggggtaccccttcgggttaccctacccggtccgttccccgtacccgg

SEQ ID NO: 260424 - DNA, 889 bp, Homo sapiens
  misc_feature: GYAE6OF01EGONE.1.5.A05.1.454.CMB.1.raw
  modified_base (137)..(137): a, c, t, g, unknown or other
  misc_feature (137)..(137): n is a, c, g, or t
  modified_base (240)..(240): a, c, t, g, unknown or other
  misc_feature (240)..(240): n is a, c, g, or t
tcagacgagtgcgtcacgaccggtgctcgatttagatagatagacaggggacccaacaaccacatccctcctcagaacgcccccagagcacaaccgccccaccatggactggacctggaggactccttctttttggnggcagcagccacaggtcgcccactcccaggtccagtcttgtgctagtcgtggggctggaggtagaagacggccgtggggcctcgaggtcggtaacggtttccnggacgaacgggtcttacggaaggtacttaccgtacctttacgtaacgttaagggttactcggtacttaacgtaccgttaggtttcggggtccggacccggacccggtaacccggggaccccccggtaaaggaaacgggtccgtttaggacgggttagggtaggtacggggtagtacgggtactaccggtaaccggtcgtagggaactaaaggttaaccggtaaaaacctaaaacctaaaaaacgttcgaaaaccggtaaggtaaaccggttaaccgaagggggtaactaaacgggttaccgttaacccgttaacccggtttaacggaacgggtacctaaccgtaccggtacccggtacggtaacggttaactttaacgttaagttaggtacgggtacgtacgtggaacgacgtacggtaccgtaggacgtaacgaccggtaacgaccgtcggtaacttggttaacgttttacgttttcggacgttaccgttaccgttaggttaacggtcgggttaacgtacgtttaagtttacccgttaccgttagttaaccgtttcggttacgtacccggttccggggttacgggaaccccgttaaccggggtacccgttcgggtaccccgttccccgtttccgaacccgttacccgg

SEQ ID NO: 260425 - DNA, 753 bp, Homo sapiens
  misc_feature: GYAE6OF01C11XT.1.5.A05.1.454.CMB.1.raw
  modified_base (225)..(225): a, c, t, g, unknown or other
  misc_feature (225)..(225): n is a, c, g, or t
tcagacgagtgcgtcacgaccggtgctcgatttagatagatagacaggggacccaacaaccacatccctcctcagaagcccccagagcacaaccgccccaccatggactggacctggagatccttctttttggtggcagcagccacaggtcgcccactcccaggtccagcttgtgcagtcgtggggctgaggtgaagagcctggggcctcagtgtaaggtttccngcaaggcttcaggataccaccttcactaggtatcgctatactagtttgggcgcggaccacgggccccggaacaaacggtcttggaggtggaagtgggatggatacgaacggtctagggacaagtaaggtaaacaaaacaaaaaaacgttcaacgaagtaacgtttaccaagggtacaaggtacggttaaccctaaccgttttaaccggaacgggtacctaacgaccgttaccggaccgtaagggttaatttaaccgttaagttaacgttagggaacgtccgttaggaacgacgaccgtacccgtagacggtaacgtaccgaaagaccgaacggtcttagggttaacttttaagttttggtaccggtacgtacccttacgtaaggttcgggacgtttactaagtttaacgttaccgtaccttagttaaaacgttttcggtaccgttacccgggttaccgggggacccgttaaacggggtaaccccctttaggggtaccccttacccgggttccctccccggttaacccg

SEQ ID NO: 260426 - DNA, 189 bp, Homo sapiens
  misc_feature: GYAE6OF01ETI6V.1.5.A05.1.454.CMB.1.raw
  modified_base (178)..(189): a, c, t, g, unknown or other
  misc_feature (178)..(189): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctcgtactgcgctgagcgggctggcaaggcgcatagnnnnnnnnnnnn

SEQ ID NO: 260427 - DNA, 736 bp, Homo sapiens
  misc_feature: GYAE6OF01E0R7Q.1.5.A05.1.454.CMB.1.raw
  modified_base (225)..(225): a, c, t, g, unknown or other
  misc_feature (225)..(225): n is a, c, g, or t
  modified_base (254)..(254): a, c, t, g, unknown or other
  misc_feature (254)..(254): n is a, c, g, or t
  modified_base (292)..(292): a, c, t, g, unknown or other
  misc_feature (292)..(292): n is a, c, g, or t
tcagacgagtgcgtcacgaccggtgctcgatttagatagatagacaggggacccaacaaccacatccctcctcagaacgccccagagcacaaccgccccaccatggactggacctggatgatccttctttttggtggcagcagccacgaggtcgcccactcccaggtccagtcttgtgcagtcgtggggctggaggtgaagagccgtgggcctgagtgacgttcngcgagctgaggataccacctcacgtagtntgactagtactgttggtcgcgccgaccggaccccgaanaacggtctggaggtggagtagggatggactcgaacgcgtacggactaagtaacggtaaacaaaactaaaaacttccgaacgtaaacgtaacgttaaccggaggggaacctaggaacgtttacccgtaacccgtttaacggacgggtaaccaacgtccgtacggaacgtaacgggttaactttaacgttaagtaccggttaggacgttacggtagacgactaacggtcgtagaacggtaagtaccggaaccgtacggaaccgtcgtttaaggttactttacggtttttggacccgtacgttaaccgttaggttacggtagggttacgttaacgtttaagtttaaacgtccccgttattttacccgtaagtttaccgggtaccgttccgggttaccgggaccccgtaacggggtacccgttacgttcccggtacccttcgtacccg

SEQ ID NO: 260428 - DNA, 767 bp, Homo sapiens
  misc_feature: GYAE6OF01CYSK3.1.5.A05.1.454.CMB.1.raw
  modified_base (139)..(139): a, c, t, g, unknown or other
  misc_feature (139)..(139): n is a, c, g, or t
  modified_base (363)..(363): a, c, t, g, unknown or other
  misc_feature (363)..(363): n is a, c, g, or t
tcagacgagtgcgtcacgaccggtgctcgatttagatagatagacgaggggacccaacaaccacatccctcctcagaacgcccccagagcacaaccgccccacatggactggacctggagtacttccttcgtttttggnggcagcacgccacaggtcgccctactcccgaggtccagtcttgtcgcagtcgtgggctggaggtagaagacgccgtgggcctgtaggtagtaacggtttcgacgacgtaacggtccttacgacggtaactacctaccttacgacgtaggtatgtacttagtacgtagttgggactccggaccgtaccggaccccgaagaacggtcgttaggaggtacggtaggngggtaagtcggataccgtaaccgtgtacggaacgttaagtaacggtaaactaaacgtaaaaagttccaagtaaacgtacgttacggacgggtaactacggaccgttaaccgttacccttaacggaacggtacctaaacgtaccgtaccggaacgtacggttaactttacgttaagtacggtagtacggtacgtcggaacgtacgtacgacgtagaaccgttacgacgtaacgtacccgtaggtacttacgtttaagtttaccgttttggaccgttcgtaaccgttcggtagttcgtacgttataacggtttactcgttacgttaacgtcgttcggttaaccgtcgggtaccggtaccggtaaaccggttccgttaccgtaccgtacccgtccgttcccgaccgg

SEQ ID NO: 260429 - DNA, 640 bp, Homo sapiens
  misc_feature: GYAE6OF01B4E09.1.5.A05.1.454.CMB.1.raw
  modified_base (208)..(208): a, c, t, g, unknown or other
  misc_feature (208)..(208): n is a, c, g, or t
  modified_base (219)..(219): a, c, t, g, unknown or other
  misc_feature (219)..(219): n is a, c, g, or t
  modified_base (263)..(263): a, c, t, g, unknown or other
  misc_feature (263)..(263): n is a, c, g, or t
  modified_base (424)..(424): a, c, t, g, unknown or other
  misc_feature (424)..(424): n is a, c, g, or t
  modified_base (632)..(632): a, c, t, g, unknown or other
  misc_feature (632)..(632): n is a, c, g, or t
tcagacgagtgcgtcacgaccggtgctcgatttagatagatagacaggggacccaacaaccacactccctcctcagaacgcccccagagcacaaccgccccaccatggactggacctggaggatccttctttttggtggcagcagccacaggtgcccactcccaggtccagcttgtgcagtcgtgggctgagtgagagccgtgggctnagtgaagttcngcagctcagatacacctcacgtagtatgatatactagttgggcncgaccgtacggaccccggtaagaaacggtcttaggaggtggagtgggatcggactacgaacgcgtggaccaagtacggtaaacaaacgtaaaaattccgaagacgtaacgttcgaagggtcaagtacgtacctaaccgttacgacgactacgactaccggngtaacgtactttaacttagtagttacggacgtctaggtaccagaccgttcgagacgtaacgtacgaacgacgtaccgtattacgttatttaagtttttcgacgtacgttaccgtacgttggacgttagtactaagtttactacggtactatttcggttacgacgttcggaccggccggtaacgtaccggtttacgacttcccggttcncccgtacg

SEQ ID NO: 260430 - DNA, 668 bp, Homo sapiens
  misc_feature: GYAE6OF01CE2F1.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtctggggctgaggtgaagaagccgtggggcctcagtgaaggtttcctgcaaggcttcaggatacaccttcacgtaggtatgactatacattgggtgcgccgacggccccggacaaacggcttgaggtggagtgggagtggatcgaacgcgtggacaagtaggtaaacaactaaaaaattcaacaagaacgttaccgagggacaaggagtacctaaccgttaaccgaagggacacactccgacgtaggacttactatagtggtagctgtaacgcagcctagaacgtagaaccggtaagaccgaacggtcttagtaagttttgttttacggtcgtccgttaacccgttacgttacgggtacggttacggtaccgtaatttaacgttaccgtaccttaagttaacgtttagtacccgttcccggacgggggttacccgaacgggtaaccccggttcggtaaccccgttccccggtacccgtcccgttaaccccg

SEQ ID NO: 260431 - DNA, 815 bp, Homo sapiens
  misc_feature: GYAE6OF01D7GKY.1.5.A05.1.454.CMB.1.raw
  modified_base (135)..(135): a, c, t, g, unknown or other
  misc_feature (135)..(135): n is a, c, g, or t
  modified_base (231)..(231): a, c, t, g, unknown or other
  misc_feature (231)..(231): n is a, c, g, or t
tcagacgagtgcgtcacgaccggtgctcgatttagatagatagacaggggacccaacaaccacatccctcctcagaacgcccccagagcacaaccgccccaccatggactggacctggaggatccttcttttggnggcagcagccacgaggtcgcccactcccaggtccagcttgtgcagtcgtggggctgaggtgaagagccgtggggcctcgagtagtaacggtttccngacgtaaggcttcgaggtactaccaccttcacgttaggtatgtaccttatacgtagttgggtcgccgaccgaccgggaccccggtaagaaacgggtccttagggaggttacgggaggtagggtatgggaactaccgtaacgtcgtacggtactaaagtaacggtaaaacctaaaacgtaaaaaacgttcgaaacgtaacggtaaaccgttaccggaagggtaacgtaacggtaccgtaacccgttaacccggttaaaccggaacggtaaccaaccgtaacggtcccgaaggtaacggttaacttttaacgttaacgttagtacgggtaacgtcgttaagaacgtacgtaccggtaccgtaacggtaacggtaccttaaacccgggaagaacccggtaaccggtacgtttaagttttacgttacggtttttcgaccgtaccggttactttcggttacggtacggtacgttaacgttacttacgttaccttacgttaccgttaagtttccgaccggttccgggacggggtaaaccccgttaccgggtacccgttccggtaacccgttcccgtcctccgtaaccccg

SEQ ID NO: 260432 - DNA, 776 bp, Homo sapiens
  misc_feature: GYAE6OF01DTO0R.1.5.A05.1.454.CMB.1.raw
  modified_base (145)..(145): a, c, t, g, unknown or other
  misc_feature (145)..(145): n is a, c, g, or t
  modified_base (191)..(191): a, c, t, g, unknown or other
  misc_feature (191)..(191): n is a, c, g, or t
  modified_base (246)..(246): a, c, t, g, unknown or other
  misc_feature (246)..(246): n is a, c, g, or t
tcagacgagtgcgtcacgaccggtgctcgatttagatagatagacgaggggacccaacaaccacatccctcctcagaacgcccccagagcacaaccgccccaccatggactggaccgtggaggtacttccctttcgtttttgggnggcagcacgccacgaggtcgccccactcccgaggtccagtctttgngctagtcgtgggctggaggtagaagacgccgtggggcctgaggtgtacgtttccngacgaggtcttgaggtactacctccttacacgttaggtatcgattatacttaggttcgggtcgccgtacccggaccgggaccccggaagtaaacggtcgttaggaggtgggtaaggtcggggtagttcggactacgacggtcgtacggaataacggtaacgtaaaactaaaactaaaaattcaaacgaagttaacggttaccgaagggtacgaaggtaccgtaccttaaccgttaacgaacgggaacctaacgaccgtaccggtacggttaacgggttaactttaacgttagttaacggtcggtaagtccgtaagacgtcgtacgtcggtaggtaacgtacgaccggaataccgtaggttacttagtttattttagttttcgacggtaccttacgttcgtaggttcgggtacttcgttagtttacgttacgtcttacgtttagttccggtaccgtcccgggtacgggtaacccgtaccggggttaccctaccgggttaccccgtaacccgttcccgtaccgttaccccgg

SEQ ID NO: 260433 - DNA, 829 bp, Homo sapiens
  misc_feature: GYAE6OF01EH8B1.1.5.A05.1.454.CMB.1.raw
  modified_base (133)..(133): a, c, t, g, unknown or other
  misc_feature (133)..(133): n is a, c, g, or t
tcagacgagtgcgtcacgaccggtgctcgatttagatagatagacaggggacccaacaaccacatccctcctcagaacgcccccagagcacaacgccccaccatggactggacctggaggatcctcttttggnggcagcagccacaggtgcccactcccaggtccagcttgtgcagtctggggctgaggtgaagagccgtggggcctgagtgtaaggtttcctgcaaggtcttcgaggtataccaccttcacgttaggtatcgacttatacagttgggtcgtccgccgacgggcccccggaagaaacggtccgttaggacggttgggaagtcggggagtgggacttacgaacggccgtagggacctaagtacggtaaacaaactaaaaaatccgaacgaacggtaaacgttccgaagggactaacggtacgtacctaacccgtttaccggaacgggtaccacgtaccgtacccggacggtaacggttaactttaccgttaagtacgtacggggtacgtacggttaggacgtaccgtacgtacccgtaggtacgtaaccgtaccggaaaccgtaccggtacggttaccttagggtttaacgttttacgtttttacgggtacgtacccggttaacccgttacggttaacgggttacgggttacggtttaccttaaggttttaaacccgtttaccgtacggtttaccgtttaaacggttttacggtaccccggtttcccgggtaaccgggggttaccccggtaaaccggggtaaccccgggttaccggttaaccccggttaaccccgggttcccttaccccggtaaccccgg

SEQ ID NO: 260434 - DNA, 1062 bp, Homo sapiens
  misc_feature: GYAE6OF01AJQ32.1.5.A05.1.454.CMB.1.raw
  modified_base (135)..(135): a, c, t, g, unknown or other
  misc_feature (135)..(135): n is a, c, g, or t
  modified_base (226)..(226): a, c, t, g, unknown or other
  misc_feature (226)..(226): n is a, c, g, or t
tcagacgagtgcgtcacgaccggtgctcgatttagatagatagacaggggacccaacaaccacatccctcctcagaacgcccccagagcacaaccgccccaccatggactggacctggaggatcctctttttggnggcagcagccacaggtgcccactcccaggtccagcttgtgcagtctggggctgaggtgaagagcctggggcctcaggtgtaacggtttccngacgaacggtcttcgaggatacctaccttcacgtaggtatcgtctatactagttgggtgcgccgacggccccggacgaaacggtccttgaggttcggagtggggatggtactcgaacggcgtacggctaaagtacgggtaaaccaaactaaaaacgtttccaaacgtaacgtaaacggttacccgaaggggtcccaaagggtaccgttacccgtaacccgttttaacccggaaagggtaacccgaaacgtaaccggtccccggtaacgggttaaaccggtaacgttttaacccgtttaaggttaagttacggggtaacggtaccgttacgggaacggtaaccgtaaccgggtacccgttacgggtaaaccgggttaacccgtaaaccccgggtaaaacgggtaacccccgggttaaacccggggttacccgttttaaacggggttttaaaccggtttttttaaggtttttttttaacccggggtaacccggggttttaaacccccgggttaaacccccgggttttttacccgggtttaaacggggggttttaaaccccgggggggttttaaaccggggttttacccgtttaaaagggttttttaaccccggttttaaacccgggtaaccccgtttttaaaccgggttttaaaaacccggtttttccggggttaaaccccccgggttttaccccggggtttacccggggggggttaaaaccccccggttaaaccccgggggggtttaaacccccccggttttaaccccgggggtttaaccccccggtttaacccccccgggttttcccccgttaacccccggtttaacccccccggg

SEQ ID NO: 260435 - DNA, 699 bp, Homo sapiens
  misc_feature: GYAE6OF01C9JFP.1.5.A05.1.454.CMB.1.raw
  modified_base (285)..(285): a, c, t, g, unknown or other
  misc_feature (285)..(285): n is a, c, g, or t
  modified_base (396)..(396): a, c, t, g, unknown or other
  misc_feature (396)..(396): n is a, c, g, or t
tcagacgagtgcgtcacgaccggtgctcgatttagatagatagacaggggacccgaacaaccacatccctcctcagaagcccccagagcacaaccgccccaccatggactggacctggagatcctcttttggtggcagcagccacaggtgcccactcccaggtccagcttgtgcagtctggggctgaggtgaagagcctggggcctcagtgaaggtttcctgcaaggtcttcaggatacaccttcactaggtatgctatacattggtgcgccacgggccccgganaaaggcttgagtggagtgggagtggactacaacggctggcaagttaggtaaacaacaaaaattcacgtaagagttaccgaggtacagacgtctaaccttacgaggtacacnctccgacgagtacttacttatagtaggacgtcgtgagcgaacgtccgtacgacggtaacgtaccggaacgtaaccggtaccggacgttagttaagttttagttttttacggtaccggtaccgttaacccgttcggtttaaacggttacggggttacggtacccttaagttttaaccgttaaccgtcgtttaaccgtaacgtttttcggtaaacccgtttccgggtaccgggggtacccgtacggggttaacccccggtttaggttaccccgtaccccgggttaccccgttcccgtaaccccgg

SEQ ID NO: 260436 - DNA, 724 bp, Homo sapiens
  misc_feature: GYAE6OF01ATKRC.1.5.A05.1.454.CMB.1.raw
  modified_base (220)..(220): a, c, t, g, unknown or other
  misc_feature (220)..(220): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgagagcctggggcctcagtgaaggtttccngcaaggcttcaggatacaccttcactaggtatgactatacattgggtgcgccacggccccggacaacggcttggagtcggagtggggatggactacgaacgcgtggacaagtgggtaaaccaacgaaaaacttcaacagtaagttaccgaagggtcaaggagtaccgaacccgtttaccgaacggggaccacgtaacgtcccggacggtagggtaactttaacgtttaacgttagttcggggaacgtacgtacggtaacgtaccggaacgtcccgtaggtaaccgaacgttacccgggaaagtacccgaacgggtctagtttaacgtttagttttttacggtcgtaccgttaacccgttcgttaacgggttagggtacggttaccgtattttacgttacggtaccttacgttaacgtttagtacccgttccggtaccgggggtacccgtaaccggggtacccccttaggggttaccccgtaccggttcccgttcccgttacccg

SEQ ID NO: 260437 - DNA, 294 bp, Homo sapiens
  misc_feature: GYAE6OF01AUS1V.1.5.A05.1.454.CMB.1.raw
  modified_base (213)..(213): a, c, t, g, unknown or other
  misc_feature (213)..(213): n is a, c, g, or t
  modified_base (255)..(294): a, c, t, g, unknown or other
  misc_feature (255)..(294): n is a, c, g, or t
tcagacgagtgcgtcacgaccggtgctcgatttagatagatagacaggggcagttccagatttcaactgctcatcagcagcctgcagtctgaagattttgcagttttattactgtcagcagtataataactggcctccgacgttcggccaagggaccaaggtgaaatcaaaacgaactgtggctgcaccatctgtcttcatcttcccgcatcngatcgtactgcgtcgtgagcggctggacaaaggcgcaatagnnnnnnnnnnnnnnnnnnnnnnnnnnnnnnnnnnnnnnnn

SEQ ID NO: 260438 - DNA, 840 bp, Homo sapiens
  misc_feature: GYAE6OF01AWDNU.1.5.A05.1.454.CMB.1.raw
tcagacgagtgcgtcacgaccggtgctcgatttagatagatagacaggggacccaacaaccacatccctcctcagaacgccccagagcacaacgccccaccatggactggacctggaggatccttctttttggtggcagcagccacaggtcgcccactcccaggtccagcttgtgcagtcgtggggctgaggtgaagagcgtggggcctgagtgtaaggtttcctgacaagggtcttcgaaggataccaccttcacgtaggtatgtacctaatactagttagggtcgccgaccgaccgggacccccggaagtaaaacgggtccgtttaggaaggtaggaacgtggggataggactacgaacggcgtaggactaagtacggttaaaacaaaactaaaaaacgttccgaaacgtaagtaaacggttaccggaacggggtaccgtaagtaacggttacccttaaacccgtttaaccggaacgggtaacctaaacgtaaccgtaccgggacggtaacgttaacgtttaacgttaattacggtaagggtaacgtcgttacggaacgtacgaaccggtacgtaggaacgtacgtaacccggaaacgtaaccggtacggtacgttagtttaacgtttaggtttttacgaccgggtccttaacgttaccggttacggttaacggggacgtttacgtaacgtttttaccggtaaaccgttaccgtttaaaccgtttaacgttttaccggaacccggtttccgggttaaccggggtaacccggtaacccgggggttaaccccgtttcggggtacccgtttaccccggttcccgttacccgtaaccccggg

SEQ ID NO: 260439 - DNA, 658 bp, Homo sapiens
  misc_feature: GYAE6OF01BGQAG.1.5.A05.1.454.CMB.1.raw
  modified_base (573)..(573): a, c, t, g, unknown or other
  misc_feature (573)..(573): n is a, c, g, or t
tcagacgagtgcgtcacgaccggtgctcgatttagatagatagacaggggacccaacaaccacatcccctcctcagaagcccccagagcacaacgccccaccatggactggacctggaggatccttctttttggtggcagcagccacaggtgcccactcccaggtccagcttgtgcagtcgtggggctggaggtgaagaagccgtggggcctcgagtgtaacggtttcctgcaaggcttcaggtataccaccttcactaggtatgctatactagttgggtgcgccgacggccccggaagaaaggtcttagaggtggagtgggatggatcgaacgcgtggacaagtaggtaaacaaactaaaaaattccaacaaggtaacgttaccgagggacaagtagtacctaaccgtttaaccgaacgggaccaactacgtacccgacggtaaggtactttaacttaagtaacgtgggagtacgtagagcgagtccgagagactacggaacgacgacgtctagttatttagttttgacgtacgtaccttgttaggtgtaggtactaatttacgttaccgtnttacgtaatttacgtaccgttccggtacgggtacccgaaccgggtacccttcgggtacccgtacccgttcccgtcccgtaacccg

SEQ ID NO: 260440 - DNA, 749 bp, Homo sapiens
  misc_feature: GYAE6OF01CUPE8.1.5.A05.1.454.CMB.1.raw
  modified_base (209)..(209): a, c, t, g, unknown or other
  misc_feature (209)..(209): n is a, c, g, or t
  modified_base (223)..(223): a, c, t, g, unknown or other
  misc_feature (223)..(223): n is a, c, g, or t
  modified_base (271)..(271): a, c, t, g, unknown or other
  misc_feature (271)..(271): n is a, c, g, or t
  modified_base (285)..(285): a, c, t, g, unknown or other
  misc_feature (285)..(285): n is a, c, g, or t
tcagacgagtgcgtcacgaccggtgctcgatttagatagatagacaggggacccaacaaccacatcccctcctcagaagcccccagagcacaacgccccaccatggactggacctggaggatccttcttttggtggcagcagccacaggtcgcccactcccaggtccagcttgtgcagtctggggctgaggtgaagagcctggggcctnagtgaaggtttccngacaaggcttcaggatacaccttcactaggtatgctatacattgggtncgcacggccccganaaggctgagtggatgggatggatcgaacgcgtaggactaagtaggtaaacaaactaaaaaacttcaacgtaagtaacgttacccgaagggtacaaggacgttactaaccgtttaccgaagggacctaacgacgtaccggacggtaaggtacttttaacgtttagtaacgttagggaacgtaccgttaggaacgtctaacggcccgttaggaaccggtaacgtaccggaaacggtaacccgtaccgggtacttaggtttaagttttaacgtttttggtaccggtaccggttaacccgttcggttaagggtacgggttaggtttacctaaaggtttttacgtaaccgttacgttaaccgttaaacgttttcggtaacccggttcccgggttacggggacccgttaaacccggggtaaccccgtttaccgggtacccttaaccccggttccgttccccgttacccgg

SEQ ID NO: 260441 - DNA, 190 bp, Homo sapiens
  misc_feature: GYAE6OF01CL63K.1.5.A05.1.454.CMB.1.raw
  modified_base (181)..(190): a, c, t, g, unknown or other
  misc_feature (181)..(190): n is a, c, g, or t
tcagacgagtgcgtcacgaccggtgctcgatttagatagatagacagggcaccaagggcccatcgatcttcccctggcaccctcctccaagagcacctctgggggcacagcggccctgggctgcctggtcaaggactacttcctgtcgagcgtctggagcgggctgggcaaggcgcatagnnnnnnnnnn

SEQ ID NO: 260442 - DNA, 566 bp, Homo sapiens
  misc_feature: GYAE6OF01E265B.1.5.A05.1.454.CMB.1.raw
  modified_base (172)..(172): a, c, t, g, unknown or other
  misc_feature (172)..(172): n is a, c, g, or t
  modified_base (309)..(309): a, c, t, g, unknown or other
  misc_feature (309)..(309): n is a, c, g, or t
  modified_base (384)..(384): a, c, t, g, unknown or other
  misc_feature (384)..(384): n is a, c, g, or t
  modified_base (404)..(404): a, c, t, g, unknown or other
  misc_feature (404)..(404): n is a, c, g, or t
  modified_base (416)..(416): a, c, t, g, unknown or other
  misc_feature (416)..(416): n is a, c, g, or t
  modified_base (452)..(452): a, c, t, g, unknown or other
  misc_feature (452)..(452): n is a, c, g, or t
  modified_base (489)..(489): a, c, t, g, unknown or other
  misc_feature (489)..(489): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcaggcagccacaggtgcccactcccaggtccagcttgngcagtctggggctgaggtgaagagcctggggcctcagtgaaggttcctgcaaggcttcaggatacaccttcactaggtatgctatacattgggtgtcgccaggccccggacaaaggcttgagtggatgggatggatnaacgctggacaagtggtaacacgaaaaattcaacagaacgtccagggcagagtcaccttacagggacacatccgngaggtattactatactgganctgacgcagccngagctccggaagacacggacctgtacttagttttgngtaccgtacctcgtagtggtaggtctattagtaccgngtacgtaactttcgaaccgttccggtggggtacccgacgggtaacccgtacgggtacctaccggtcctccgtacccg

SEQ ID NO: 260443 - DNA, 182 bp, Homo sapiens; identical to SEQ ID NO: 259848
  misc_feature: GYAE6OF01EK2FF.1.5.A05.1.454.CMB.1.raw
  modified_base (178)..(182): a, c, t, g, unknown or other
  misc_feature (178)..(182): n is a, c, g, or t

SEQ ID NO: 260444 - DNA, 814 bp, Homo sapiens
  misc_feature: GYAE6OF01DC9QU.1.5.A05.1.454.CMB.1.raw
tcagacgagtgcgtcacgaccggtgctcgatttagatagatagacaggggacccaacaaccacatccctcctcagaacgcccccagagcacaaccgccccaccatggactggacctggaggatcccttctttttggtggcagcagccacaggtcgcccactcccaggtccagcttgtgctagtcgtggggctggaggtgaagacgccgtggggcctcgaggtgtaacggtttcctgacgaggtcttacgaggactactaccttcacgtaggtatagtacttaatacgtagttgggtcgccgaccgaccggaccccggaagaaacggtcgtaggaggtaggtaggtgggagtcggacgtaccgacggtcgtacggacgtaaagtacggtaaaaccaaaactaaaaaacgttccgaaacgtaaggtaaacgttacccggaaggggtaacgtaacggtaaccgttaaccgttaaacccggttaaccggtaacgggaaccctaaccgtaacggttacccgggaacggtaaacggttaacgtttaaccgtttaaggttacggttagggtaacgtacgttacggtacggtaccgtacggtccgtaaggacgtaaccgtaaccggaagtacccggacggttactttagggtttacttttaagttttcggacggtcccgtacgttacggttaggagggttacgttacgttaatttacgtaccgttacttaaccgttgttaaccgtacggttcccgggtacgggaacccggtaccggttaacccggttccggtacccgttaccggttcccgttccctacccgg

SEQ ID NO: 260445 - DNA, 680 bp, Homo sapiens
  misc_feature: GYAE6OF01EWHCG.1.5.A05.1.454.CMB.1.raw
  modified_base (210)..(210): a, c, t, g, unknown or other
  misc_feature (210)..(210): n is a, c, g, or t
  modified_base (226)..(226): a, c, t, g, unknown or other
  misc_feature (226)..(226): n is a, c, g, or t
  modified_base (298)..(298): a, c, t, g, unknown or other
  misc_feature (298)..(298): n is a, c, g, or t
  modified_base (484)..(484): a, c, t, g, unknown or other
  misc_feature (484)..(484): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtctggggctgaggtgaagaagccgtggggcctnaggtgtaaggtttccnggcaaggcttcgaggataccaccttcacgtaggtatgactatactagttggtgcgccgacggaccccggaanaaggtcgttagaggtggagtgggagtagggatacgaacggtctaggactaagtaggtaaacaaactaaaaaagttacaaacgtaaggtaaacgttaccgaagggcaagtaacgtacctaaccctttaacgaacgggtaacacctagtccgacgtaggtactttaactataagtggaagtctagganacgtagacccgtagaacgtacgtaaccggaacgaccgtacggacgtttgttaacgtttgttttcggacgttaccgtacgttacgttaggtcggtagttacttacgttaacgttaccgatttacgtagtttacgacccgttcgggtacgggacccgtaacgggtacccgtcggttaccacccgttcgcccgtaaccg

SEQ ID NO: 260446 - DNA, 689 bp, Homo sapiens
  misc_feature: GYAE6OF01BKU4M.1.5.A05.1.454.CMB.1.raw
  modified_base (225)..(225): a, c, t, g, unknown or other
  misc_feature (225)..(225): n is a, c, g, or t
  modified_base (275)..(275): a, c, t, g, unknown or other
  misc_feature (275)..(275): n is a, c, g, or t
  modified_base (291)..(291): a, c, t, g, unknown or other
  misc_feature (291)..(291): n is a, c, g, or t
  modified_base (445)..(445): a, c, t, g, unknown or other
  misc_feature (445)..(445): n is a, c, g, or t
tcagacgagtgcgtcacgaccggtgctcgatttagatagatagacaggggacccaacaaccacatccctcctcagaagcccccagagcacaaccgccccaccatggactggacctggaggatccttctttttggtggcagcagccacaggtgcccactcccaggtccagcttgtgcagtcgtggggctggaggtgaagagccgtgggcctgagtgtaagtttccngcaaggcttcaggataccaccttcactaggtatgactatacagttgggtnccgccacggccccganaaggctgagtggagtgggatggatcgaacgctaggactaagtacggtaaacaaactaaaaaattcaacgtaaggtaacgttaccgaagggtacaagacgtacctaaccgtttacgaggacacacgtccgagagtattactatagtggatctgancgagccgtagagtacgtacgaagaccgacggtactagttaactttagttttcgacggtaccgtaacccgttcggttaacgggttagggtaacgttacgttaacgtttaacggtttacccggtaactttaccgttaaacggttttacgaacccggtttcccgggaccgggggttacccgtaaaccggggttaaccccccgttaggttaacccccggtacccgttccccgttacccgtacccccgg

SEQ ID NO: 260447 - DNA, 584 bp, Homo sapiens
  misc_feature: GYAE6OF01BFWY2.1.5.A05.1.454.CMB.1.raw
  modified_base (220)..(220): a, c, t, g, unknown or other
  misc_feature (220)..(220): n is a, c, g, or t
  modified_base (428)..(428): a, c, t, g, unknown or other
  misc_feature (428)..(428): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttccngcaaggcttcaggataccaccttcactaggtatgctatacatttgggtgcgccgacggccccgacaaaggcttgacggtggagtgggatggatcgaacgctaggctaagtaggtaacaacaaaaattacaacacgtaagttaccgagggacagacgtactacctttaccgagggacacgataccgacgagattactagtagtggagtntgagcacgcctgacgactacgaagacgacggtctgtattagtttttagcgtacgtaccgtcgttagtggtagttactagttacgttacgtcttacgtatttgacgttccgtacgggtaccgaacgggtaccctcggtaccaccgtctcccgtaccg

SEQ ID NO: 260448 - DNA, 775 bp, Homo sapiens
  misc_feature: GYAE6OF01B80M6.1.5.A05.1.454.CMB.1.raw
  modified_base (235)..(235): a, c, t, g, unknown or other
  misc_feature (235)..(235): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtcgtggggctggaggtgaagaagccgtggggcctcagtgtaagtttcctgcaaggcttnaggataccaccttcacgtaggtatgctatactagttgggtgcgccgacgggccccggaagaaaggtcttggaggtggagtgggagtggatcgaacgtcgtggactaagtaggtaaacaaactaaaaaacttcaacgtaaggtaaacgtttaccgaagggtacaacggtacgtacctaaacccgtttaaccggaacggggtaaccaaccgtacgttacccggacggtaacgggttaactttaaccgtttaagtaacggttacgggaacgtcgttacggaacgccgtaacgtacccgtaggtaacgtaacgttacccgggaaacggacccgtaacggtacgtttagtttaagttttacgtttttaggtaccgtccgttacccgtttagttaacggttagggtaacggttaccttaagtttaaccgttaacgtcccgtttaacgttaacgttttacgtaccggttcccgggtacggggtaacccggtacccggggttaacccttacgggttacccgtaccccggttcccgtcccgttacccgg

SEQ ID NO: 260449 - DNA, 740 bp, Homo sapiens
  misc_feature: GYAE6OF01CYKJS.1.5.A05.1.454.CMB.1.raw
  modified_base (285)..(285): a, c, t, g, unknown or other
  misc_feature (285)..(285): n is a, c, g, or t
tcagacgagtgcgtcacgaccggtgctcgatttagatagatagacaggggacccaacaaccacatcccctcctcagaagccccccagagcacaaccgccccaccatggactggacctggagatccttctttttggtggcagcagcccacaggtcgcccactccccaggtccagcttgtgcagtcgtggggctgaggtgaagagccgtgggcctcagtgtaaggttcctgacaaggtcttcaggtatacctaccttcactaggtatgacttaatacagtttcgggngccgtccgaccggacccccgaagaaacggtcttggagtggaggtgggattggataccgaacggcgtacggaccaaaggttacggtaaaacccaaacgtaaaaaacttccaagtaagtaacgttccgagggacagacgtactaccgttacgaacggactacgtacgtccgacgtacggttaacttaacgtttaagtacgtaggggactaccgttaggacgtacggaaacggtcccgtaaggacggtaaccgttacccgggaaacgtaccgtaaccgggtacctttaaggttacgtttttaagttttcggtacggttacccgtaccgttcgttaacgggttaggtacggttaacttagttttaacgtaccggttactaacgtttacttccggtacgtcccggtacgggtacccgaacggtccccggttagtacccgtaacccgtccctcgtaccccg

SEQ ID NO: 260450 - DNA, 840 bp, Homo sapiens
  misc_feature: GYAE6OF01EP368.1.5.A05.1.454.CMB.1.raw
  modified_base (223)..(223): a, c, t, g, unknown or other
  misc_feature (223)..(223): n is a, c, g, or t
tcagacgagtgcgtcacgaccggtgctcgatttagatagatagacaggggacccaaccaaccacatccctcctcagaagcccccagagcacaacgccccaccatggactggacctggaggatcctcttttggtggcagcagccacaggtgcccactcccaggtccagcttgtgcagtctggggctgaggtgaagagccgtggggcctgagtgtaaggtttccngcaggcttagaggataccaccttcacgttaggtatgtctatacagttgggttcgcgccacgggccccggaagaaaggtccgttggagtggagtggggatgggactcgaacggtctggactaacgtcggtaaacaaacgtaaaaactttccgaacgtaacgtaacggttaccgaagggaccgtaaggtaaccggtacgtaaaccccgttttaaacccggaaggggttaacccaaccgtacgtaccccggtaacgggtaacggttaactttaaccgtttaagttaacgtaggggtaacgtccgttagggaacgaccgtaacggtacccgtagggtaacggtacgttaaccccggaaacggtacccgtaccgggttacgttagggtttaactttacggttttttacgggtaccgttacccggttaaccccgtttacggttaacgggttacgggttaaccgggtttcttaaagttttaaccggttacccggttacctttaaccgttaacggttttaccggtacccggtttacccgggttacccgggggaacccggttaacccgggttaacccccggttacgggttaccccgttacccggttcccgttcccgttaacccggg

SEQ ID NO: 260451 - DNA, 888 bp, Homo sapiens
  misc_feature: GYAE6OF01ELJOY.1.5.A05.1.454.CMB.1.raw
  modified_base (132)..(132): a, c, t, g, unknown or other
  misc_feature (132)..(132): n is a, c, g, or t
  modified_base (230)..(230): a, c, t, g, unknown or other
  misc_feature (230)..(230): n is a, c, g, or t
tcagacgagtgcgtcacgaccggtgctcgatttagatagatagacaggggacccaacaaccacatccctcctcagaacgccccagagcacaaccgccccacatggactggacctggagatccttcttttggnggcagcagccacgaggtcgcccactcccaggtccagtcttgtgcagtcgtggggctggaggtgaagacgccgtgggcctcgaggtgtaacggtttccngactaaggtcttacgaggtactaccaccttacacgtaggttatcgtacttaatacgtagttcgggtcgccgtacccggaccgggacccccgtaagaaacggtccttaggacggtggagtggggatggactaccgaacggtcgtaggaactaaagttaaacggtaaaaaactaaaacttccgaaagtaacggtaacggttacggaggtacaaggtaccgtaccgttaaccgttaaccggaacggactaaccgtcgtccggaacggttacgtaactttaacgttaagtacggtggtaacgtcgttaggacgtacgtaccggtacggtaagtaccgggtaacgtaacccgggtaacgacccggttagggtaccgttttaacggtttaacgtttttacggttttccggtacgggtacccccgtttaaccgttacgggtttaaagggtacgggtttaaaccgtttacgttaaccgttttaaccggtttaaccgggtaccttttaaaccggtttaaacggttttccccgggttacccggttacccgggggttaacccgggggtaccccggttaaaacccggggttaccccccggtttccgggttaaccccccgtaacccccggtttttccccggtaaccccgttcccggttaaacccccccggg

SEQ ID NO: 260452 - DNA, 678 bp, Homo sapiens
  misc_feature: GYAE6OF01BLZ27.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggataccaccttcactaggtatgctatactattgggtgcgccaggccccggacgaaaggctggagtggagtgggatggatcgaacgctggactaagtaggtaaacaacaaaaaattcaactagaaagttcgagggacagtagtactaccttacagggtacacactccgagtagtattacttaagtagtggacgtcgtggaagtcagtcctaggaagtacgtaccgtaaacggaccgaacggtcgttagttaacgtttagttttttcggagtaccggtaaccgttacgttacgggtttagggacgttaaccgttaagttttaacgtttaccggtaaccttacgttaaacgtttttacggaacccggtttcccgggttacgggggaccccgtaacggggtaacccccgttcgggttacccgtaccccgttcgttccccgttaacccgg

SEQ ID NO: 260453 - DNA, 556 bp, Homo sapiens
  misc_feature: GYAE6OF01AQFNL.1.5.A05.1.454.CMB.1.raw
  modified_base (427)..(427): a, c, t, g, unknown or other
  misc_feature (427)..(427): n is a, c, g, or t
  modified_base (505)..(505): a, c, t, g, unknown or other
  misc_feature (505)..(505): n is a, c, g, or t
  modified_base (544)..(544): a, c, t, g, unknown or other
  misc_feature (544)..(544): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggctcaggatacaccttcactaggtatgctatacattgggtgcgccaggccccggacgaaaggcttagagtggatgggatggatcaacgctggacaagtggaaacaacaaaaattcaacagaaacgttccgaagggcagtacgtactacctttacgagggacacacgtccgacgaggtattacttatagtggagctagacgnacgctgtagactacgaagtacgacggtctagttattagttttagtgtcgtacctcgtagtggtacgtctattatacgntacgtattgctcggtcgggaccacgggtacctggtaccnccgtctccgtcg

SEQ ID NO: 260454 - DNA, 613 bp, Homo sapiens
  misc_feature: GYAE6OF01BK1EL.1.5.A05.1.454.CMB.1.raw
  modified_base (438)..(438): a, c, t, g, unknown or other
  misc_feature (438)..(438): n is a, c, g, or t
  modified_base (508)..(508): a, c, t, g, unknown or other
  misc_feature (508)..(508): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagccgtggggcctcagtgaaggtttcctgcaaggcttcaggataccaccttcactaggtatgctatacagttgggtgcgccgacggccccggacaaacggcttggagtggacgtgggatggatcgaacgctggcaagtacggtaaactaacgaaaaaacttcaacgaagaacgttccgaagggcagagtactaccttacgacgggacacgactccgacgagtactttactagtacgtggacgtntagagtacagcctagagtacgtaccgaagacgacggcttagtatttagttttagtacgtcgtacccgttntaggtggtacggttactagttagttacgtcttacgtaagtttcaccgttccggtcgggtacccgtacgggtaccccgttaggccctacccgttcgtccgtacccg

SEQ ID NO: 260455 - DNA, 549 bp, Homo sapiens
  misc_feature: GYAE6OF01E267D.1.5.A05.1.454.CMB.1.raw
  modified_base (437)..(437): a, c, t, g, unknown or other
  misc_feature (437)..(437): n is a, c, g, or t
  modified_base (450)..(450): a, c, t, g, unknown or other
  misc_feature (450)..(450): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctgaggtgaaggtttcctgcaaggcttcaggatacaccttcactaggtatgctatacattgggtgcgccaggccccggacaaaggcttgagtggatgggatggatcgaacgctggcaagtggtaacaacaaaaaatcaacagaacgttccagggcagagtcacctttaccgaggacacatccgcgaggattactatagtgagctgagcagcctgagataccgaagacgacgntgtaatgttttgngtcgtaccttcgtagtggacgtcagttattacgcttacgtaatttgacgtccggtgggacccgacgggtaccctgggtacctcccgttctcccgtaccg

SEQ ID NO: 260456 - DNA, 847 bp, Homo sapiens
  misc_feature: GYAE6OF01COW3R.1.5.A05.1.454.CMB.1.raw
tcagacgagtgcgtcacgaccggtgctcgatttagatagatagacaggggacccaacaaccacatccctcctcagaacgcccccagagcacaaccgccccaccatggactggacctggaggatccttcttttggtggcagcagccacgaggtcgcccactcccaggtccagcttgtgcagtcgtgggctggaggtagaagagccgtggggcctcgagtgaagtactttccgtggacgaaggtccttacgaggactacctaccttacacgtaggttatgtaccttaatacgtaggtttgggtcgtccggacccgtaccggggaccccccggaacgaaacgggtccgttagggaggtcgggtaaggtcggggtagtagggtacgtaccgaacggtcgtacgggtactaaaggtaacggtaaaactaaaccgtaaaaaacttcgaaacgtaagtaacggttaccggaagggtaccgtaagacgttaccgtaacccgttaaccggaggaaccaccgtaccgtaccggacggtaacggtaactttaacgttaagtaggtacgggacgtacgtagggaacgtcgtacggtaccgtaaggaaccggtaaccgtaccggaaacggtaccgtaccgggtactttaaggtttaacttttaggttttcggaccgttaccggtaaccgtttacggttaagggttaccgggtaacgtttcttaacgtttaaccggttccgttaaccgtttaacgtttaacggtttaccgtaccggtttacccgggggtacgggttacccgttaaacccggggttaccccgttaccgggtttacccctacccggggtttcctaccccccgg

SEQ ID NO: 260457 - DNA, 746 bp, Homo sapiens
  misc_feature: GYAE6OF01C5A6I.1.5.A05.1.454.CMB.1.raw
  modified_base (224)..(224): a, c, t, g, unknown or other
  misc_feature (224)..(224): n is a, c, g, or t
tcagacgagtgcgtcacgaccggtgctcgatttagatagatagacagggacccaacaaccacatcccctcctcagaagcccccagagcacaaccgccccaccatggactggacctggagatccttcttttggtggcagcagccacaggtcgcccactcccaggtccagcttgtgcagtcgtgggctgaggtgaagagccgtgggcctcgagtagtaggtttccngacgaaggtccttagaggactacctaccttcaacgtagtatgacttaatactagttgggtagcccgacccgaccgggacccccggaacgaaacggtccttaggacggtgggaaggtggtaagtggtagtaccgaacgcgtaggactaagtacgaaacaaactaaaaagttccaacgtaagtaacgttacgaagggtacaagtacgtacctaaccgttaaccggaacggactaacgtacgtacccggtacggtaaggttactttaacgtttaagtacgttagggaacgttcgtaaggtaccgacgtaacggtcccgtaaggtacggtaacccgtaaccggaaacggtaacccggaccggttacgtttagtttaacgttttaagtttttccggacgttaccgttaccgtacggttaggtggtacgtacttagtttaacgtctacttacgttaacgtcgtaccgttcggtaccgggacctaccgggtaaccgtttcggacccttaacccgtcccgttcgtacccg

SEQ ID NO: 260458 - DNA, 630 bp, Homo sapiens
  misc_feature: GYAE6OF01A4F49.1.5.A05.1.454.CMB.1.raw
  modified_base (221)..(221): a, c, t, g, unknown or other
  misc_feature (221)..(221): n is a, c, g, or t
tcagacgagtgcgtcacgaccggtgctcgatttagatagatagacaggggacccaacaaccacatccctcctcagaagcccccagagcacaacgccccaccatggactggacctggatgatcctctttttggtggcagcagccacaggtgcccactcccaggtccagcttgtgcagtctggggctgaggtgagaagcctggggcctcagtgaaggtttccngcaaggcttcaggatacaccttcactaggtatgctatacattgggtgcgccaggcccccggacaaaggctgagtggagtgggatggatcgaacgctggcaagtggtaaacaactaaaaaagttcaacgaagaacgttaccaggggacaggacgtccaccgtttaaccgagggacaacgactccgacgaggtattactatagtggagtctaggagtcagtccgtaggacgagtcccgaagacacggcttagtattattttagtgacgtaccttgtacgtaggtaggtacctagtttattaaccggtcgttaacgtaatttttacggacccgttacccggttacgggggtacccgtaacgggggtaaaccccttcgggttacccgtaccccgggtttccccttaaccccgg

SEQ ID NO: 260459 - DNA, 181 bp, Homo sapiens
  misc_feature: GYAE6OF01C7WU0.1.5.A05.1.454.CMB.1.raw
  modified_base (179)..(181): a, c, t, g, unknown or other
  misc_feature (179)..(181): n is a, c, g, or t
tcagacgagtgcgtcacgaccggtgctcgatttagatagatagacagggcaccaagggcccatcggtcttcccctggcaccctcctccaagagcacctcgtggggcacagcggccctgggctgcctggtcaaggactacttcctctctcgactctgagcgggctggcaaggcgcatagnnn

SEQ ID NO: 260460 - DNA, 727 bp, Homo sapiens
  misc_feature: GYAE6OF01BQ4U1.1.5.A05.1.454.CMB.1.raw
  modified_base (229)..(229): a, c, t, g, unknown or other
  misc_feature (229)..(229): n is a, c, g, or t
  modified_base (287)..(287): a, c, t, g, unknown or other
  misc_feature (287)..(287): n is a, c, g, or t
  modified_base (305)..(305): a, c, t, g, unknown or other
  misc_feature (305)..(305): n is a, c, g, or t
tcagacgagtgcgtcacgaccggtgctcgatttagatagatagacaggggacccaacaaccacatccctcctcagaacgccccagagcacaaccgccccaccatggactggacctggaggactccttctttttggtggcagcagccacaggtgcccactcccgaggtccagcttgtcgcagtctggggctggaggtgaagagccgtggggcctcagtgaacggtttccngccgaggcttcgaggtactacacctttcaacttaggtatcgactataacagttgggtnccgtccacggccccgganaaaggcttacgagtggacgtgggatggatcgaacgcgttggacaagtacggtaaaccaaacgtaaaaacttcgaacgagtaacgttaccgagggacctagaacgtacctaacccgtttaaccgacggggaacctaccgtacgtacccgtacggaacggtactttaaccgttagtaacgttcggggaactcgttggaacgcgtaacgtacccggtgaaacggtacgacccggtaaaggaaccccgtaacggggtcttacgggttagttttaccgtttttgggacggtacccgtacccgttaggtaaggttcgggtagtacgttactttagttaccgtaccttagtaacgtttcgacccggttccggtacgggggccctaacgggtacccctgggttacccctcccggttctcccgttaacccg

SEQ ID NO: 260461 - DNA, 804 bp, Homo sapiens
  misc_feature: GYAE6OF01CHKXB.1.5.A05.1.454.CMB.1.raw
  modified_base (236)..(236): a, c, t, g, unknown or other
  misc_feature (236)..(236): n is a, c, g, or t
tcagacgagtgcgtcacgaccggtgctcgatttagatagatagacaggggacccaacaaccacatccctcctcagaacgcccccagagcacaaccgccccaccatggactggacctggaggatccttcttttggtggcagcagccacgaggtcgcccactccccaggtcccagattgtcgctagtcgtggggctggaggtgaagacgccgtgggcctcgaggtgtaacggtttccngacgaggtccttgaacggtactaccgtaccttacgaacgttaggtatcgtacctaataaccgtaagtttcggggtcgtccggaccccgtaccgggaccccccgggaaacgaaaacgggtccgttaggtaggtagggtaggtaggggtagtggtaacgttacgaaccggtcgtaggacctaaagttaacggtaaaacctaaaacgtaaaaaaacttcaaaacgtaacggtaaacgtacccgaaagggaccgaaggtaacgttaccgtaaacccgtttaacgaacgggtaactaaccgaacgtccggacggtaacggttaactttaacgttaagtaacgttaggtacgtacgtaggaacgcgtacggacgtacggaacgaaccgtaaccggaaacgtaaccggacggtaccttagttaactttaacggtttttcgtacggtaccgttaccgttggtacggtacgggttactacgtaagtttacgtacctgtaactttaacgttccgacgttccggacgggtacccgtaacgggtacccgtacggtacccctaccgtcccgtccgtacccg

SEQ ID NO: 260462 - DNA, 583 bp, Homo sapiens
  misc_feature: GYAE6OF01CZV2A.1.5.A05.1.454.CMB.1.raw
  modified_base (289)..(289): a, c, t, g, unknown or other
  misc_feature (289)..(289): n is a, c, g, or t
  modified_base (349)..(349): a, c, t, g, unknown or other
  misc_feature (349)..(349): n is a, c, g, or t
  modified_base (454)..(454): a, c, t, g, unknown or other
  misc_feature (454)..(454): n is a, c, g, or t
tcagacgagtgcgtcacgaccggtgctcgatttagatagatagacaggggacccaacaaccacatccctcctcagaagcccccagagcacaaccgccccaccatggactggacctggagatccttctttttggtggcagcagccacaggtgcccactcccaggtccagcttgtgcagtctggggctgaggtgaagagcctggggcctcagtgtaaggtttcctgcaaggtcttcaggatacaccttacactaggtatgactaatacattgggtgcgccacggccccganaaaggcttgagtggagtggatggatcaatgctgcaagtaggtaaacaacaaaaattcaanagtaagttaccgagggacagtacgtacaaccgtttaccgaggtacactactccgacgagtattaaccttagtatggagtctagagcgagctagagtactacgaanacgcgacgttagtattattttgtagtcctacttacgtagtcggtagtcttacgttattaccgtcttactagtttcgacgttccggtagggaccgtaaccgggtacccttggacccgtcgtccttacccg

SEQ ID NO: 260463 - DNA, 778 bp, Homo sapiens
  misc_feature: GYAE6OF01BJNVO.1.5.A05.1.454.CMB.1.raw
  modified_base (229)..(229): a, c, t, g, unknown or other
  misc_feature (229)..(229): n is a, c, g, or t
tcagacgagtgcgtcacgaccggtgctcgatttagatagatagacaggggacccaacaaccacatccctcctcagaacgcccccagagcacaaccgccccaccatggactggacctggaggatccttctttttggtggcagcagccacgaggtcgcccactcccaggtccagcttgtgcagtcgtggggctggaggtgaagagccgtggggcctgagtgtacgtttccngcaggcttcgagatacacctcagtagtatcgactatacagttgggtgcgccgacggcccggaacgaaggtcttgagtggagtgggatggatacgaacggcgtgacaagtacggtaaacaaactaaaaacttcaacgtaagtaacgttaccgagggtacaaggtacgtaccgtaacctttaccggaacgggaccacgtacgtcccggacggtaacggtaacgttttaaccgttaagttaacgtacgggaacggttacgttaggaccggtaacgtacggtacccgtaggtaacgttaaccgtacccggaaagtacccgggtaacgggtacgtttaaccgttttaagttttaagttttttacggtaccggtaccggttaacccgtttacgggttaagggttacggggtacggttacgttaaacgttttacgttaaccgttaccgttaacgttaacgttttaccggacccgtttcccgggtacggggtaccccgtaaccggggttacccggttaccggttacccgtcccggttacccttccggttacccccgg

SEQ ID NO: 260464 - DNA, 597 bp, Homo sapiens
  misc_feature: GYAE6OF01E2USR.1.5.A05.1.454.CMB.1.raw
  modified_base (290)..(290): a, c, t, g, unknown or other
  misc_feature (290)..(290): n is a, c, g, or t
  modified_base (483)..(483): a, c, t, g, unknown or other
  misc_feature (483)..(483): n is a, c, g, or t
tcagacgagtgcgtcacgaccggtgctcgatttagatagatagacaggggacccaacaaccacatccctcctcagaacgcccccagagcacaacgccccaccatggactggacctggaggatcctctttttggtggcagcagccacaggtgcccactcccaggtccagcttgtgcagtctggggctgaggtgaagaagccgtggggcctcagtgaaggtttcctgcaaggcttcaggatacaccttcactaggtatgctatacagttgggtgcgccgaggcccccggaanaaaggcttgagtggatggggatggatcgaacgcgtaggcaagtaggtaaacaaactaaaaaattcaacagaaagttccgaagggcagtagtactaaccgtttacgaaggacacgatccgagaggtatttactatagtggagctgagcgagtcctgacgataccgaagacgacggtcttagtatttagttttgngtccgtaccttgtaggtaggtagtactattacgttacgcttatactttacgacttcccggtggggacccgacggggtaaccccttggtaccctacccggttcctcccgtacccg

SEQ ID NO: 260465 - DNA, 634 bp, Homo sapiens
  misc_feature: GYAE6OF01AQ3OJ.1.5.A05.1.454.CMB.1.raw
  modified_base (335)..(335): a, c, t, g, unknown or other
  misc_feature (335)..(335): n is a, c, g, or t
tcagacgagtgcgtcacgaccggtgctcgatttagatagatagacaggggacccaacaaccacatccctcctcagaagcccccagagcacaacgccccaccatggactggacctggatgatcctctttttggtggcagcagccacaggtgcccactcccaggtccagcttgtgcagtctggggctgaggtgaagaagcctggggcctcgagtgaaggtttcctgcaaggcttcaggatacaccttcactaggtatgctatacattgggtgcgccacggcccccggacaaaggcttgagtggagtgggatggatcaacgctggcaagtggaacaanaaaaaacttcaacaagaacgttccgagggacagagtcacctttaccagggaccagactccgacgaggtattacttatagtcggagtcgtgagcgacgtcctggaagactaccgaacgacgacggcgtagttactttaagtttttggtaccgtacgttacccttacgtacgggtacggtaacggttctaacgttttacttaccggtacttacgtaattttaggaccgtttcccggtacgggggtacccgtaaccgggggtaaccccttacgggtacccttccccggtccgttacccccgg

SEQ ID NO: 260466 - DNA, 1009 bp, Homo sapiens
  misc_feature: GYAE6OF01C29OK.1.5.A05.1.454.CMB.1.raw
  modified_base (210)..(210): a, c, t, g, unknown or other
  misc_feature (210)..(210): n is a, c, g, or t
  modified_base (222)..(222): a, c, t, g, unknown or other
  misc_feature (222)..(222): n is a, c, g, or t
tcagacgagtgcgtcacgaccggtgctcgatttagatagatagacaggggacccaacaaccacatccctcctcagaacgcccccagagcacaaccgccccaccatggactggacctggaggatccttcttttggtggcagcagccacaggtcgcccactcccaggtccagcttgtgcagtcgtgggctgaggtgaagagccgtgggcctnagtgaggtttcngcaggcttgagataccacttcacgtaggtatgctatacagttgggtcgcgccgaccggccccgagaaacggccgttgacggtggagtggacgtggagtacgacgcgtggacaagttacggtaaacaaacgaaaaacttaccgaagtaacgtaacgtttaccgaacgggtactaacggaacgtttaccgtaaccccgttttaacggaacggggtaacctaacccgtaaccggttacccggtaacgggtaacgggtttaaacgttttaacccgttttaaaggttaacggtttaaccgggggtaacggttaccggtttaaacgggaaacggttacccggaaaaccgggtttaccccggttaacggggtaaaaccggttaaacccgggtttaaccccccgggaaaaacggggaaccccggtttaaaccccgggggtttaacccgtttaaggggttttttaaaccttttttttaacgggtttttttaaccggggtttacccggttacccccggggttttaaaccccgtttaccgggtttaaggggtttaccgggggtttaacgggtttaacgtttaaccgtttttacggttaaaacccggggtttaccttaaaccgggttttttaaaacgtttttaccccgggttaaccccggttttaccccggggtttaccccgggggggtaaacccccggtttaaccccgggggtttaaacccccgggtttacccggggttaacccccggtttaaccccccgggttttaccccgtttccccccggggttaaaccccccgg

SEQ ID NO: 260467 - DNA, 733 bp, Homo sapiens
  misc_feature: GYAE6OF01BV945.1.5.A05.1.454.CMB.1.raw
  modified_base (290)..(290): a, c, t, g, unknown or other
  misc_feature (290)..(290): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctgggctgaggtgaagagcctggggcctcgagtgaaggtttcctgcaaggctcaggatacaccttcactaggtatgactatactagttgggtgccgccgacgggcccccggaanaaacggtcttggaggtggacgtggggatggactaccgaacgcgtaggactaagtaggtaaacaaactaaaaaattcaaacgaagtaaacggttacccgaaggggacaaggtaacgtccctaaccgtttaacccggaagggtaaccaaccgtaacgtaccccgacggtaacggtaacgtttaaccgttaagtaagtacgggtaacgtaccggtaggaacggacaacgggaccttaggacgtaaccgtaccggaaaggacccgtaacggtccttaggttaatttaacgtttttggacgttacccgtaccgttacgttaggtagggtacggttacctaagttaacgttaccgtcttaacgttaacgtttgaccgtttccgggacggggtcccgtaacgggtacccgttacggttaccccgtaccgttcccgtcccgttaaccccgg

SEQ ID NO: 260468 - DNA, 819 bp, Homo sapiens
  misc_feature: GYAE6OF01BZVJ6.1.5.A05.1.454.CMB.1.raw
  modified_base (229)..(229): a, c, t, g, unknown or other
  misc_feature (229)..(229): n is a, c, g, or t
tcagacgagtgcgtcacgaccggtgctcgatttagatagatagacaggggacccaacaaccacatccctcctcagaacgcccccagagcacaaccgccccaccatggactggacctggaggatccttcttttggtggcagcagccacaggtcgcccactcccaggtccagcttgtgcagtcgtggggctggaggtgaagaagccgtggggcctcagtgtaaggtttccngcaaggtcttcgaggtactacctaccttcacgtaggtatgactatacagtttgggtgcgccgacgggcccccggaacaaacggcttagaggtcggagtcggggagtcgggatcgaaccgcgtggaccaaagttacgggtaaaactaaacgtaaaaaaaatttccaaacgtaacggtaaacgtttaccgaaggggacaacggtaacgttacctaacccgttttaaccgaaggggtaacctaaccgtaacgtacccgggaaccgggtaacggttaacttttaaacgtttaacttaaggttacgggaacgttacgttacggaacgtacgaacggtcccgtaggtaaacggtaacgttacccgggaaaacggaccgtaaccgggtacttaacggtttaaattttacggtttttacggtacggttaccgttaacccgttcggttaagggttcgggtacgttaccgtaagtttaaccgttacggtaccttacgtttaaacgtttcgaccgtttcccggggtaacgggtaccggaaacccgggggttaacccgttcgggttaccccgtaacccggtttcccgttcccgtaaccccgg

SEQ ID NO: 260469 - DNA, 736 bp, Homo sapiens
  misc_feature: GYAE6OF01C0X2Y.1.5.A05.1.454.CMB.1.raw
  modified_base (230)..(230): a, c, t, g, unknown or other
  misc_feature (230)..(230): n is a, c, g, or t
tcagacgagtgcgtcacgaccggtgctcgatttagatagatagacaggggacccaacaaccacatcccctcctcagaacgcccccagagcacaaccgccccaccatggactggacctggaggatccttcttttggtggcagcagccacaggtcgcccactcccaggtccagcttgtgcagtctggggctgaggtgaagaagccgtggggcctgagtaggtaaggtttccngacgaagggtcttcgaaggtactacaccttcacgtaggtatgtactaatacgtagttgggtcgccgaccgaaccggaccccggaaagaaacggtcgttacgaggtaggaggtagggatcggacgtaccgaacgcgtaggactaaagtacggtaaaacaaacgtaaaaaagttccgaacgtaagtaacgttaccgaagggtacaagtacgtactaaaccgttacgaacggtactacgtaaccgtccggacgtaacggtaacgttaacttaagtacggtaggtacgtacgttacgacgacgtaacgccgtaggtacgtaacgtacccgaaagaccgtaacgtacgttaggtttaacttagtttttacggaccgttaccgtaccgttacgtaggtacggtagtaactaattacgttacgtacttacgtaagttagacccgttccgggacgggttaacccgtaacggggtaacccctacgggtaccctaaccggtccgttcccgtacccg

SEQ ID NO: 260470 - DNA, 743 bp, Homo sapiens
  misc_feature: GYAE6OF01CMFZP.1.5.A05.1.454.CMB.1.raw
  modified_base (277)..(277): a, c, t, g, unknown or other
  misc_feature (277)..(277): n is a, c, g, or t
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtctggggctgaggtgaagaagccgtggggcctcgagtgaaggtttcctgcaaggtcttcgaggataccacctttcacgtaggtatgctatacattgggtncgccacggcccccgganaaacggcttagngtggagtgggagtggatcgaacgcgtggacgtaataggtaaacaaacgtaaaaaattcgaacaagtaagttaccgaagggacagaacgtactaacccgtttaaccgaacgggtaccaacgtacgtacccggacgtaagggtaactttaaccgttaagttaagttagggtacgtcgtaggacgtacgaacgtaccgttaggacgtaacgtacccggaaaccgaacggtaacggttaccgttaggtttaagtttttacgttttttagggacgttacccggttaacgtttacgttacggttaacgggtaggttaccgttaagtttaacgttacccgacgttttacctaagttttccggaaccgtttcccgggttacgggacccggtaaccgggttacccccgtacgggtaccctaaccccggttcttcccgttaccccgg

SEQ ID NO: 260471 - DNA, 798 bp, Homo sapiens
  misc_feature: GYAE6OF01EKGZO.1.5.A05.1.454.CMB.1.raw
  modified_base (138)..(138): a, c, t, g, unknown or other
  misc_feature (138)..(138): n is a, c, g, or t
  modified_base (180)..(180): a, c, t, g, unknown or other
  misc_feature (180)..(180): n is a, c, g, or t
  modified_base (233)..(233): a, c, t, g, unknown or other
  misc_feature (233)..(233): n is a, c, g, or t
tcagacgagtgcgtcacgaccggtgctcgatttagatagatagacaggggacccaacaaccacactccctcctcagaacgcccccagagcacaaccgccccacagtggactggacctggagacttccttctttttggnggcagcagccacgaggtcgcccactcccgagtccagtcttgngctagtcgtgggctggaggtagaagacgcgtcgggcctgagtagtacgtttcngacgaggtctagagtactaccgtacctgacgttaggtatcgactatacgtaggtttcggcgccggacccgtaccggaccccggtaaagtaacggtcgttaggacggttagggtaggtaggggtacgtagggtacctaccggtaacggtccggtaacggtaactaaaggtaaccggttaaaaaccgaaaacgttaaaaaaccgttcgaaaccggtaaacggtaaccggttaccggaacggggtacctaaacgggttaccttaaccccgttaaccggtttaaccggaacgggtaacccaaccgtaccgttacccgggaacggtaacgtttaactttaaccgtttaagtacggtaggtaacgtccgttaggacgtacgtaccgtacgtaaggacgtacccggtaacgaacggtacccgtggtacgttagtttattacggtttgaccgtcgtaccgtttgacggttgtacgtacttacgttacgtacgtacgttacgttacgttaccgaccggttcggaccgtaccggtaaccggtcccgtacgttacccgccgttcctccgtaacccg

SEQ ID NO: 260472 - DNA, 185 bp, Homo sapiens
  misc_feature: GYAE6OF01B1H8T.1.5.A05.1.454.CMB.1.raw
  modified_base (174)..(174): a, c, t, g, unknown or other
  misc_feature (174)..(174): n is a, c, g, or t
  modified_base (179)..(185): a, c, t, g, unknown or other
  misc_feature (179)..(185): n is a, c, g, or t
tcagacgagtgcgtcacgaccggtgctcgatttagatagatagacagggcaccaagggcccatcggtcttcccctggcaccctcctccaagagcacctcgtggggcacaggccggccctgggctgcctggtcaaggctacttccagtactcatctgagcgggctggcaaggcgnatagnnnnnnn

SEQ ID NO: 260473 - DNA, 694 bp, Homo sapiens
  misc_feature: GYAE6OF01AS993.1.5.A05.1.454.CMB.1.raw
  modified_base (553)..(553): a, c, t, g, unknown or other
  misc_feature (553)..(553): n is a, c, g, or t
  modified_base (631)..(631): a, c, t, g, unknown or other
  misc_feature (631)..(631): n is a, c, g, or t
tcagacgagtgcgtcacgaccggtgctcgatttagatagatagacaggggacccaacaaccacatccctcctcagaacgcccccagagcacaaccgccccaccatggactggacctggaggatcctcttttggtggcagcagccacaggtcgcccactcccaggtccagcttgtgcagtcgtggggctggaggtgaagagccgtggggcctgagtggtaaggtttcctgacaaggtcttacgaggactaccgtaccttcacgttaggtatgacttatacagttgggtgtcgccgacggcccccggacgaaacggtcgttaggacggtgggacgtggggtagtgggatacgaacgtcgtacggtactaagtaggtaaactaaactaaaaagttacaacgtagtaaacgttaccgaagggacgaggtacgtacctaaccgtttaccgaacgggtaccaacgtacgtacccggacggtaacggtactttaacttagtagtacggagtcgtaggagaccgagtacccgtagacgacgtaccgaacggaccgacggtnttagttagtttacgttttggcgtaccgtacgtgtacgtagggtagttcgttaatttacgtacctattacgtaactttntaccggtccggtacgggaccgtaccgggtaccgtcggtacctacccgttccgtccgtacccgg

SEQ ID NO: 260474 - DNA, 183 bp, Homo sapiens
  misc_feature: GYAE6OF01BASMD.1.5.A05.1.454.CMB.1.raw
  modified_base (179)..(183): a, c, t, g, unknown or other
  misc_feature (179)..(183): n is a, c, g, or t
tcagacgagtgcgtcacgaccggtgctcgatttagatagatagacagggcaccaagggcccatcggtcttcccctggcaccctcctccaagagcacctcgtggggcacagcggccctgggctgcctggtcaaggactacttcctcgatcgcgtctgagcgggctggcaaggcgcatagnnnnn

SEQ ID NO: 260475 - DNA, 772 bp, Homo sapiens
  misc_feature: GYAE6OF01BJYHL.1.5.A05.1.454.CMB.1.raw
  modified_base (216)..(216): a, c, t, g, unknown or other
  misc_feature (216)..(216): n is a, c, g, or t
  modified_base (232)..(232): a, c, t, g, unknown or other
  misc_feature (232)..(232): n is a, c, g, or t
  modified_base (289)..(289): a, c, t, g, unknown or other
  misc_feature (289)..(289): n is a, c, g, or t
tcagacgagtgcgtcacgaccggtgctcgatttagatagatagacaggggacccaacaaccacatccctcctcagaacgcccccagagcacaaccgccccaccatggactggacctggagatccttctttttggtggcagcagccacaggtcgcccactcccaggtccagtcttgtgctagtcgtggggctggaggtagaagagccgtggggcctnagtgtaacggtttccngacaggtcttcaggactaccgtaccttcacgttagtatcgatatactagttgggtcncgccgaccggacccgaagaaggtcgttggacggtggagttgggactaggactacgacgtcgtggactaagtacggtaaacaaactaaaaagttcaacgtaaacggtaacggttaccggaacgggtacgaacgtaaccgttacccgtaaacccgtttaacgaacgggtaaacccacgtaaccgtacccggtaacggtaacggttaacttttaacgttaacgtaaggttacgggaacgttaccgtaaggtaaccggtaccgtaacggtccgtaacggtacggtaacggtaacccgtaaacggtaccgaacggttcgtttaagtttagttttaccgttttaggacgtaccgttaccgttataggggtttaggacgtttaacgttaagtttacgtaccgtaactttaacgttaaggtttccgtaccggtccgggttacgggacccgtaacggtacccgtacgtaccgttcctcccggtctaacccgg

SEQ ID NO: 260476 - DNA, 628 bp, Homo sapiens
  misc_feature: GYAE6OF01CJAGC.1.5.A05.1.454.CMB.1.raw
  modified_base (263)..(263): a, c, t, g, unknown or other
  misc_feature (263)..(263): n is a, c, g, or t
  modified_base (572)..(572): a, c, t, g, unknown or other
  misc_feature (572)..(572): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtctggggctgaggtgaagagcctgggctcagtgagttcctgcagctcagatacacttcactaggtatgactatactagttcgggtncgccacgggaccccgaagtaaacggcttgacggtggagtcgggatggactacgaacgcgtaggactaaagtacggtaaacaaactaaaaacttcgaacaagtaacgttccgagggacacggtacgtacctaaccgtttaaccgaacggggaccaaacgtacctacccgacggtaacggtaacttaactttaagtaagtcgggagtcgtaggacgtacgacgacgtgaacgtactaccgaaggacgcggtactagttacgtttagttttgcgtacctacgttgtaggtggtagtcgtatttagtaccgtntacgttagttagtcgtcggcgggtacgacggtaaccttcgacctcctctccgtacg

SEQ ID NO: 260477 - DNA, 816 bp, Homo sapiens
  misc_feature: GYAE6OF01CKG31.1.5.A05.1.454.CMB.1.raw
  modified_base (134)..(134): a, c, t, g, unknown or other
  misc_feature (134)..(134): n is a, c, g, or t
  modified_base (230)..(230): a, c, t, g, unknown or other
  misc_feature (230)..(230): n is a, c, g, or t
  modified_base (273)..(273): a, c, t, g, unknown or other
  misc_feature (273)..(273): n is a, c, g, or t
tcagacgagtgcgtcacgaccggtgctcgatttagatagatagacagggacccaacaaccacatccctcctcagaacgcccccagagcacaaccgccccaccatggactggacctggagatccttcgttttggnggcagcagccacgaggtcgcccactcccgaggtccagcttgtgcagtcgtgggctggaggtagaagacgccgtcgggcctgagtgtacggtttccngacgtaaggtcttagagtaactacctaccttacgacgtaggtntcgtacttagtacgtaggtttcgggcgtaccggacccgtaacccgggacccccggtaaaggtaacggttccgttaggaggttaggtaggtacgggtagtacggtacgttaccgaaccggtcgtaacggaaccttaaagttaacggtaaaacctaaacgtaaaaaacgttacccgaagtaacggttaacgtaccggaacggaactaacggtacgtaacccgtaacccgttaacgaacggtaacacgtacgtaccgacgtagtaactttaacgtagtaacgaggtacgtacgtagaacgtcgaacgtcgtaagacgtaaccgtacgaacgtacgtacgttagttacgttagtttacgttttccggagtacccgttacgttaccggtaggtttaccggtacgttactttaacgtttaacgtaccgttacgttaaccgttttacggaaccccggtttacggttaccccggggtacgggtaaccccggttaaccgggttaccccgggttacttacccccggtaccgtttcccgtcccgtaaccccggg

SEQ ID NO: 260478 - DNA, 748 bp, Homo sapiens
  misc_feature: GYAE6OF01DAJO3.1.5.A05.1.454.CMB.1.raw
  modified_base (137)..(137): a, c, t, g, unknown or other
  misc_feature (137)..(137): n is a, c, g, or t
  modified_base (149)..(149): a, c, t, g, unknown or other
  misc_feature (149)..(149): n is a, c, g, or t
  modified_base (155)..(155): a, c, t, g, unknown or other
  misc_feature (155)..(155): n is a, c, g, or t
  modified_base (734)..(734): a, c, t, g, unknown or other
  misc_feature (734)..(734): n is a, c, g, or t
tcagacgagtgcgtcacgaccggtgctcgatttagatagatagacaggggacccaacaaccacatccctcctcagaacgccccagagcacaaccgccccaccatggactggacctggaggcttccttcgtttttggnggcagcagccanaggtcncccactcccgaggtccagtcgttgcgcagtcgtggggctaggaggtagaaggacgccgtagggcctgaggtcgtaaggttcctggacgtaaggtcttacgagactacctacttacagttacgtatcgtactactagtaggttgggtcgtccgaccggaccggacccggaagtaacggtcgttaggacggttagggacggtaggtaggtaggactacgtacggtcgtacggtacgtaagtaacggtaaaactaaactaaaacgttacaacgtaagtaacggttaccggaaggtaccgaaggtaccgttaccgtaaccgttacggaacgtacgtaaccgcgtaccggacgtaacggttactaactttagacggttacggtcgtcgtagacgtacgacgtacgacgaagaccgtaccgaacgtaccggtcggttacttagggttttacttacggttttaccgacgttaccggtacgttacgggtaggttaacgttacggtaacttaacgttacgtaccgtactttaagttcggttaccgttcggtccggggtcgaccggttaacggtaccgtcggttacccnccgttcaccggtcc

SEQ ID NO: 260479 - DNA, 527 bp, Homo sapiens
  misc_feature: GYAE6OF01CQJ7A.1.5.A05.1.454.CMB.1.raw
  modified_base (268)..(268): a, c, t, g, unknown or other
  misc_feature (268)..(268): n is a, c, g, or t
  modified_base (385)..(385): a, c, t, g, unknown or other
  misc_feature (385)..(385): n is a, c, g, or t
  modified_base (445)..(445): a, c, t, g, unknown or other
  misc_feature (445)..(445): n is a, c, g, or t
  modified_base (455)..(455): a, c, t, g, unknown or other
  misc_feature (455)..(455): n is a, c, g, or t
  modified_base (462)..(462): a, c, t, g, unknown or other
  misc_feature (462)..(462): n is a, c, g, or t
  modified_base (477)..(477): a, c, t, g, unknown or other
  misc_feature (477)..(477): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtncgccaggcccccggacaaaggcttgagtggatgggatggatcaacgctggcaatggtaaacacaaaaaattcacagaagttccagggcagagtcacctttaccagggacacatccgngaggattacttatatggagctgagcagcctgagatccgaagcacggctgtattattttgngtcgaccttntagtggngtctattatacgctntaatttgacgttcctggggaccagggtaccctggtccaccgtctcctacg

SEQ ID NO: 260480 - DNA, 189 bp, Homo sapiens; identical to SEQ ID NO: 260426
  misc_feature: GYAE6OF01C454A.1.5.A05.1.454.CMB.1.raw
  modified_base (178)..(189): a, c, t, g, unknown or other
  misc_feature (178)..(189): n is a, c, g, or t

SEQ ID NO: 260481 - DNA, 962 bp, Homo sapiens
  misc_feature: GYAE6OF01CN4YE.1.5.A05.1.454.CMB.1.raw
  modified_base (132)..(132): a, c, t, g, unknown or other
  misc_feature (132)..(132): n is a, c, g, or t
  modified_base (150)..(150): a, c, t, g, unknown or other
  misc_feature (150)..(150): n is a, c, g, or t
  modified_base (229)..(229): a, c, t, g, unknown or other
  misc_feature (229)..(229): n is a, c, g, or t
tcagacgagtgcgtcacgaccggtgctcgatttagatagatagacaggggacccaacaaccacatccctcctcagaacgccccagagcacaaccgccccacatggactggacctggagatccttcttttggnggcagcagccacaggtcncccactcccaggtccagcttgtgcagtcgtggggatgaggtagaaggaagccgtgggcctcgaggtagtacggtttccngacaaggtcttacgacggtactacctaccgttcacgttaggtatcgtacttaagtacgtaggttcgggctaccggacccgtaacccggggaccccggaaagaaacgggttcgttgggtaacggtagggaacggtagggtagtacgggaactacccgaaccggtcggtaaggtacgtaaacggtaacggtaaaaccaaaacgttaaaaacttaccggaaactaacgggtaaccgttacggaacgggtacgaacggtacgtacccgttaaacccgttaacgaacggggtaaccctacgtaaccggtacccgacgggtttaaacggttaactttaaccgtttaagtaaccgggttacgggtaaccggttacggtacccggtaacgtacggtaacccgttaaacggtcgggtaaacgtacccggtaaaacccggtaaacgggaacccggttaaacgggtttcccgtttaaagttttaccggtttttaacgtttttaccgggtaacggtaccccgtttaacgttaacgggtttaaccgggtaagggtttaaccggttaacctttaacgggtttaaacccgttttacccggtaactttttaaacccgggtaacggtttttaacccggtaccccggggttttaacgggcccccggggggttaaacgttaaccccggggtttaccccggttaacccgggttaacccgtaaccccgttcccggtttaaacccgtcccccggg

SEQ ID NO: 260482 - DNA, 607 bp, Homo sapiens
  misc_feature: GYAE6OF01CEZC9.1.5.A05.1.454.CMB.1.raw
  modified_base (285)..(285): a, c, t, g, unknown or other
  misc_feature (285)..(285): n is a, c, g, or t
  modified_base (350)..(350): a, c, t, g, unknown or other
  misc_feature (350)..(350): n is a, c, g, or t
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
  modified_base (479)..(479): a, c, t, g, unknown or other
  misc_feature (479)..(479): n is a, c, g, or t
  modified_base (509)..(509): a, c, t, g, unknown or other
  misc_feature (509)..(509): n is a, c, g, or t
tcagacgagtgcgtcacgaccggtgctcgatttagatagatagacaggggacccaacaaccacatccctcctcagaagcccccagagcacaacgccccaccatggactggacctggagatcctctttttggtggcagcagccacaggtgcccactcccaggtccagcttgtgcagtctggggctgaggtgaagagctggggcctcagtgaggtttcctgcaaggcttacaggataccaccttcacgtaggtatgctatactattgggtgcgccacggccccgganaaacggcttgagtggagtgggatggatacaacggctaggcaatggtaacaacgaaaaattacaanaacgaagttaccagggcagacgtctaacctttaccgaagggaccacactccgacgaagtattacttataatggantagancacgtcctgaagtagtccgaagaccgtacggtctagttattaagttttntacggtactaccgttataggttgggacgtntacgtttataccgtcgttacgttaagtttcgaaccgttccggtacggggtacccaacggggtaccccttagggacccttacccggtcctaccgtcccg

SEQ ID NO: 260483 - DNA, 826 bp, Homo sapiens
  misc_feature: GYAE6OF01E35E1.1.5.A05.1.454.CMB.1.raw
  modified_base (241)..(241): a, c, t, g, unknown or other
  misc_feature (241)..(241): n is a, c, g, or t
tcagacgagtgcgtcacgaccggtgctcgatttagatagatagacaggggacccgaacaaccacatccctcctcagaacgcccccagagcacaaccgccccaccatggactggacctggaggactccttctttttggtggcagcagccacgaggtcgcccactcccaggtccagcttgtgcagtcgtggggctggaggtgaagacgccgtggggccctacgaggtaggtaacggttttccngacgaaggtcttacgaggatacctaccttcacgttaggtatgacttatactagttgggtcgccggacccgaccgggaccccgggaacgaaacgggtccgtttggaacggttgggtaaggtgggggtagtacgggacgttaccgaaccggcggtacggaactaaaggttaaccggtaaaactaaaaacctaaaaagtttaccaaacggtaacggtaaaccggttccgaaggggaccaaacggtacttaccccgtaaccgttaaccggaacgggaccaacgaccgtaccggacggtaaggttaactttaacgtaagttacggtcggaagtcggtacgaagaccgacgttccgtagaacgtacgtaaccggaacggtaaccgacggttaccgttagtttaacgttttacggtttttggaccggttacccgtaccgttacgttacgggtagggtaccgttacttaacgtttacgttacgttaccgttaacgtttacgtttacgtacccggttccgggttacggggtaacccgggtaacccgggttacccggtacggtaccccgtaccgtttccccgtaccgttaccccg

SEQ ID NO: 260484 - DNA, 693 bp, Homo sapiens
  misc_feature: GYAE6OF01C8VR2.1.5.A05.1.454.CMB.1.raw
  modified_base (178)..(178): a, c, t, g, unknown or other
  misc_feature (178)..(178): n is a, c, g, or t
  modified_base (213)..(213): a, c, t, g, unknown or other
  misc_feature (213)..(213): n is a, c, g, or t
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (243)..(243): a, c, t, g, unknown or other
  misc_feature (243)..(243): n is a, c, g, or t
tcagacgagtgcgtcacgaccggtgctcgatttagatagatagacaggggacccaacaaccacactccctcctcagaacgcccccagagaacaaccgccccaccatggactggacctggaggattccttcttttttggtggcagcagccacaggtgcccactcccaggtccagcttgngcagtcgtggggctgaggtgaagagcgtgggcctnagtgtaggtttccngcaggnttcagntacncctcacgtggtatgctatactagttggtgccgccgaccggccccggacgaaggtcgttgacgtggtagtgggatggatccgaacggctcggactaagtacggtaaacaaactaaaaagtacaacgtaacgtaacgttaccgagggtaccgaagtacgtacaaccgtttaccgaggtactaacacgtaccggacgtagtaactttaatacgttaagtggtagtcgtaggacgacgtacgtaccgagtaagtaacgaaccggaacgtaacgtaccggttactaggttttaacttggtttttcggacgttccgtaacccgtttcgtacgggttagggtacgtttacgtaggtttaatacgtaccttataacgttttcgtacgttccggacggggtaccccgtagggttaacccttccgggtacttaccccgtaccgttcccgtccgtaccccg

SEQ ID NO: 260485 - DNA, 756 bp, Homo sapiens
  misc_feature: GYAE6OF01A9NMS.1.5.A05.1.454.CMB.1.raw
  modified_base (232)..(232): a, c, t, g, unknown or other
  misc_feature (232)..(232): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttgggtggcagcagccacgaggtcgcccactcccaggtccagcttgtgcagtcgtggggctgaggtagaagagccgtggggcctcgaggtgtaacggtttccngcgtaaggtcttacgaggactacctaccttcacgttaggtatgtactaatacgtagttgggtcgccgccgaccgggacccccggagtaaaggtcgttacggaggtggacgtggggtatcgggactacgaacgtcgtggactaagtacggtaaacaaactaaaacttcaacgagtaacgtcgaggacagtactccgtaaccgttacgacgggtaccacgtaccgtaccggacggtaacggtactttaacgttaagtacggttagggaacgttcgtaaggacgtaccgtaacggtccgtaggtaacgtaccggttaacccggaaacggaccgtacgggtacttaaggtttacgtttacgtttttcggacgttaacccggtaccttacgttacgggttcggtacggttacttaagtttaccgttaccgtaccgttaagttaacgtttagaccccggttccgggtaccgggggtaccgtaacccggggtacccttcgggtacccgtacccgttcccttccgtacccgg

SEQ ID NO: 260486 - DNA, 791 bp, Homo sapiens
  misc_feature: GYAE6OF01DCX3O.1.5.A05.1.454.CMB.1.raw
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
  modified_base (236)..(236): a, c, t, g, unknown or other
  misc_feature (236)..(236): n is a, c, g, or t
  modified_base (264)..(264): a, c, t, g, unknown or other
  misc_feature (264)..(264): n is a, c, g, or t
tcagacgagtgcgtcacgaccggtgctcgatttagatagatagacaggggacccaacaaccacatccctcctcagaacgcccccagagcacaaccgccccaccatggactggacctggagatccttcttttggtggcagcagccacaggtcgcccactcccaggtccagcttgtgcagtctgggctgagtgaagagcgtggcctnagtgagttccngcaggtctnagatacacctnactaggtatgactatactagttgggtcncgacccgacgggaccccggaacgaacggtcttaggacggtgggaagtggggatcgggataccgaacggcgtggactaaagtacggttaaaacaaacctaaaaaaacgtttccaaacgtaaacggttaaacgtttaccggaacgggaacgtaaacggttaaccgttaacccgttaaaccccgttttaaccggaaacggggtaccctaaaccgtaaccggtacccggtaccgtaagggttaacctttaagtttaacgtacgttagggacgtaccgtaggtaacgtactaacggtccgtacggacgtaaccggttaacccggaaacggaccgtaaccggtcgtttattaaacggttttcgtttttagtacggtacccgtaactttccggtagttaggacgttaccgttaatttcgttaaccgttccttaacgttaacgtttcggtaccgttacccgggacgggttaccccgggtaaaccgggttacccgtacgggtttaccccgaaccccggttcccgttccccgtaccg

SEQ ID NO: 260487 - DNA, 649 bp, Homo sapiens
  misc_feature: GYAE6OF01BNOIR.1.5.A05.1.454.CMB.1.raw
  modified_base (139)..(139): a, c, t, g, unknown or other
  misc_feature (139)..(139): n is a, c, g, or t
  modified_base (488)..(488): a, c, t, g, unknown or other
  misc_feature (488)..(488): n is a, c, g, or t
tcagacgagtgcgtcacgaccggtgctcgatttagatagatagacagggacccaacaaccacatccctcctcagaagcccccagagcacaacgccccaccatggactggacctggaggatccttctttttggtggcagnagccacaggtgcccactcccaggtcccagtcttgtgcagtcgtggggctggaggtgaagagccgtggggcctcagtgtaaggtttcctgcaaggtcttcgaggatacctaccttcactaggtatgtctatactagttgggtgccgccgacgggaccccggaacgaaaggtccttaggagtgggaagtggggtagtggaataccgaacggcgtggactaaggtacggtaaaactaaactaaaaaattacaaacgaagtaacgttaccggaggacgagacgtacctaaccttaacgaggacactcgtccgcgtaggtactttacttatagtacggagtcgtaggacgacgngaccgtagacgtacgtacccggaagaccgacgtcttagttactttgttttagcgtccgtacgttgtaggtcggtagttacttaagttacttacgtacttatagtttgaccgttcgtacggtccgaccgggtaccttcggaccctcgttccctcccgtaccg

SEQ ID NO: 260488 - DNA, 868 bp, Homo sapiens
  misc_feature: GYAE6OF01E4F5H.1.5.A05.1.454.CMB.1.raw
  modified_base (137)..(137): a, c, t, g, unknown or other
  misc_feature (137)..(137): n is a, c, g, or t
  modified_base (744)..(744): a, c, t, g, unknown or other
  misc_feature (744)..(744): n is a, c, g, or t
  modified_base (794)..(794): a, c, t, g, unknown or other
  misc_feature (794)..(794): n is a, c, g, or t
  modified_base (846)..(846): a, c, t, g, unknown or other
  misc_feature (846)..(846): n is a, c, g, or t
tcagacgagtgcgtcacgaccggtgctcgatttagatagatagacaggggacccaacaaccacatccctcctcagaacgcccccagagcacaaccgccccacatggactggacctggaggtatccttcgtttttggnggcagcagccacgacggtcgccccacctcccgacggtccaggtcttggtcgcgtaggtcggtgggggtctagggaggtaggaacggacggtccggtcggggcctcggaggttacggtaacggtttcgtcgacgtaacggtcgtacgacgtaaccttacctaaccgtttacgtaaccgttaaggttacttagtaccttaagtaaccggttagggttcgggtcccggacccggtacccgggaaccccggggaacccggtaaacggtaacggttcggtaggtaaggttacggggaggttacggacgtacggtaacgtaccggtacggtacggtaacgtaacgttaaaacgggtaaaacctaaaaccgtaaaaacgttaaccgaacggtaaacggttaacgggtaaccgtacggaacggttaaccggaaccgttaccgtaaacccgttaccgggtaaacggaacgaacccgtaccgttacggtaaccggtaaacggttacgtttaaatcggtaccggtagccgtaacggttcaaaggacctcgggaattacgggacgtaactaaccgggtactaacggtacggtgtttatttacgttggttccggttaccncgtacgttgttacggagttagtacttaatcgtacgttactaggtttaccnggttccggtacggtcccgggtaacggtaccctccggtccggttacaccccgngttaaccccgtcctaaccgggg

SEQ ID NO: 260489 - DNA, 870 bp, Homo sapiens
  misc_feature: GYAE6OF01DALOB.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggagatcctcttttggtggcagcagccacaggtgcccactcccaggtccagcttgtgcagtctgggctgaggtgaagagcctgggcctcagtgaaggttcctgcgaaggcttcaggatactaccttcacgtaggtatggcttaatacctaagttgggtgtccgacccgaaccgggacccccggaacgtaaaacggtcgtttacggacggttacgggtaaggtggggtaagttacgggtaacgttaccgaaaaccggcccgttagggaacccgtaaaacgtttaacggggttaaaaaccaaaaccgttaaaaaaaaacgtttcccgaaaacggtaaacggtaaaccggtttaacccggaaacgggggtaacctaacgggtaacgtttaaccccgtaaacccggttttaacccgaaggggaaccctaacgacgttaccggacgtacgtaatttaacgttactaagtaggagtactaggagtaacgaacggtccctaggtaacggtaacgtaccggtaaacgtaaccgtaccgggtactttaaggttacgttttaacgttttttacgggacgttaacccgggttaccttacgttaacggggttaggtacggttacgtttaaacgttttaaccgttaacggtccctttaaacgtaaacggttttcgtaacccggttacccgggttacgggggtaaccccgtaaccgggttaaaccccggttacggttaccccgtaaccgtttcccgtccttaaccccggg

SEQ ID NO: 260490 - DNA, 647 bp, Homo sapiens
  misc_feature: GYAE6OF01BBQF2.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaagtttcctgcaaggcttcaggatacaccttcactaggtatgctatacagttggtgcgccacggccccggacaaaggcttgagtggatgggatggatcgaacgctggcaagtggtaacaacgaaaaattcaacagtaacgttaccgaggtacagagtctaaccgttaccgagggtacacagtccgacgtagtacttaacttatagtcggaatctggtaacgcgacggcctaggacgacgttaccggaaacgaccgtacggtaccttggttaatttagtttttcgtagtaccgtaaccgttccgtaaggttagggaggttactaagtttacttaccggtcttaacgtacgttttacgaccgtttcccggaggggtaccccgtaacggggttaccccgttcgggttacccctacccggttcccgtcccgttaaccccgg

SEQ ID NO: 260491 - DNA, 708 bp, Homo sapiens
  misc_feature: GYAE6OF01A660A.1.5.A05.1.454.CMB.1.raw
  modified_base (134)..(134): a, c, t, g, unknown or other
  misc_feature (134)..(134): n is a, c, g, or t
  modified_base (234)..(234): a, c, t, g, unknown or other
  misc_feature (234)..(234): n is a, c, g, or t
tcagacgagtgcgtcacgaccggtgctcgatttagatagatagacgaggggacccaacaaccacatccctcctcagaacgcccccagagcacaaccgccccaccatggactggacctggagatcctcttttggnggcagcagccacaggtgcccactcccaggtccagcttgtcgctagtcgtggggcctggaggtagaacgacgccgtggggcctcgaggtgaacggtttccnggacaaggtcttcgaggactaccaccttacacgtaggtatcggtacctatactagttgggtcgccgccgaccggaccccggacgaaacggtcgtaggagtggtacgtgggatggactacgacgcgtacggacaagtaggtaacaaactaaaaactacaaccgtagtaaacggttccgagggacgaggtacgtccgtaaccgttaaccgacgggacctacacgtaccgacgaggtaacttattaagtacgtagggagcgttaggacgtacacgtcccgttaggtacgtaacgttaccgggaaccgaccggacggtacgttacggtttatttacggttttggaccgttccggtaccgtttcggtaaggttcgggtacggttctaacggtttagttacccgtgtacgtacgttaccgaccggttcggtacgggacccggtacgggtacctcgggtaccctccgtcccgtccctaccg

SEQ ID NO: 260492 - DNA, 652 bp, Homo sapiens
  misc_feature: GYAE6OF01CO1RY.1.5.A05.1.454.CMB.1.raw
  modified_base (135)..(135): a, c, t, g, unknown or other
  misc_feature (135)..(135): n is a, c, g, or t
  modified_base (499)..(499): a, c, t, g, unknown or other
  misc_feature (499)..(499): n is a, c, g, or t
tcagacgagtgcgtcacgaccggtgctcgatttagatagatagacaggggacccaacaaccacatccctcctcagaacgcccccagagcacaaccgccccaccatggactggacctggagatccttctttttggnggcagcagccacaggtcgcccactcccaggtccagcttgtgcagtcgtggggctggaggtgaagagccgtgggcctgagtgtaacggtttcctgcaaggtcttacaggactaccacctttcacgtaggtatgacttatacgtagttgggtgccggccgacgggacccccggaataaaggtcttaggaggttggagtggatggatacgaacgtcgtggacaagtacgtaaacaaacgtaaaaattccaataacgtaacgttaccgaggacagactacctaccttacgaggaccatacgtccgataggtacttaactatagtgagctagacgctacgcctagacgacgtaccgaagtcgaccggtnttaggttactttagttttgcgttacgtaccttgtaggttacggagttacctagtttacgttaccgtcttacgttaacgttcgaccggttcccggtaaggggacccttaacggggtaccccttcgggtaccctaccgttccctacccgtacccg

SEQ ID NO: 260493 - DNA, 923 bp, Homo sapiens
  misc_feature: GYAE6OF01DQGTT.1.5.A05.1.454.CMB.1.raw
tcagacgagtgcgtcacgaccggtgctcgatttagatagatagacagggacccaacaaccacatccctcctcagaacgcccccagagcacaacgccccaccatggactggacctggaggatccttctttttggtggcagcagccacaggtgcccactcccaggtccagcttgtgcagtctggggctgaggtgaagagccgtggggcctcgagtgaaggtttcctgcaaggcttcaggataccaccttcacgtaggtatcgacttaactactagtttggggtagccggtcccgaccgggaccccccgggaacaaaacgggcctttggacggtggggtaatgggggtaagttgggactaccgaaaccggtcgttacggggactaaacgttacggggtaaaaccaaactaaaaaaaactttccgaaaccaaacggtaaacggtttacccgaacggggtacgaacggtacggtttaccctaacccgttttaacccgaacggggtacccaacgtacgttacccggacggtaacgggtaacttttaaccgtttaatacggttacgggaacggtcgttacggaggtaaccgacggtaccccgttagggaacgtaaaccgttacccggaaacgggaaccccgtaacgggtaccggtttaagtttaagttttttacgtttttttacggtacgggttaccttaaacccccggtttggtttaaacggggttacgggtacgggtttacgttaacgttttaaacgtttacccggtaccttttaaccggtttaaaccgttttttaggtaacccccggtttacccgggttacccgggggggtacccccgttaaaccggggggtaaaacccccccgggttttacggggtaaccccccgtttacccccgggttcccgtttaccccccggttaaacccggg

SEQ ID NO: 260494 - DNA, 782 bp, Homo sapiens
  misc_feature: GYAE6OF01B3CCK.1.5.A05.1.454.CMB.1.raw
  modified_base (133)..(133): a, c, t, g, unknown or other
  misc_feature (133)..(133): n is a, c, g, or t
  modified_base (227)..(227): a, c, t, g, unknown or other
  misc_feature (227)..(227): n is a, c, g, or t
tcagacgagtgcgtcacgaccggtgctcgatttagatagatagacaggggacccaacaaccacatccctcctcagaacgcccccagagcacaaccgccccacatggactggacctggagatccttcttttggnggcagcagccacaggtcgcccactccaggtccagcttgtagcagtcgtgggctgaggtcgaagagccgtgggcctagaggtgtaacggtttccngaccgtaaggtcttacgaggacttacacctttagacgtaggtctagactatacgtagttgggcgcggaccgaccgggaccccgaagaacgggtcttaggagtagtaggtggagtggactacgacgtgtacggacgtaagtacggtaaactaaacgtaaaaacttccaaacgtaacggtaaacgtttaccggaacgggtacccgtaaggtaaccgttacccgttaaacccggtttaccggaacggggtaacctaccgtaacggtttacccggaacgggtaacggttaaacgtttaccgttaagtaacggttacgggactaccggttagacgtacgacggtacgtcgggaactacgtacggaacgtaccggacgtcgttacgttaagtttacctttaggcggttacctaccgttaggaacggttcgtaaccgtagttaacgtttacgttaccgtacgttaacgttacgtttaccggaccgtttacccggacggggttaacccgtaaccggggttacccttacggtacccgttaacccgtccgttaacccgtaccggg

SEQ ID NO: 260495 - DNA, 702 bp, Homo sapiens
  misc_feature: GYAE6OF01A13DH.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtcgcccactcccaggtccagcttgtgcagtcgtggggctgaggtgaagagccgtggggcctcgagtgtaaggtttcctgcgaaggtcttacgaggtactacctaccttcacgtaggtatgctatactagttgggtgccgccgacggcccccggaagaaaggcttggagtggagtgggatggatcgaacgctgggactaagtacggtaaacaaacaaaaaacttcaacgaaggtaaacgttaccgaaggggacaaggtacggtacctacccgtttaaccgacggggtaaccacgtacgtccgacgtaggtaacttacttaagtagtgggacgtacgtaggacgacgtacgtaccgtagaacgtacgtaccggaacgacgacggtctagtttaagtttacgttttgacggtaccgtaccgttacgttacggtagggtacgttacgtaagtttacgttacgtacttaacgtaacgtttcggtaccgttcccggtacggggtacccgtaaccgggtacccgttacggtaccgtaccccggttccttcccgtaacccg

SEQ ID NO: 260496 - DNA, 188 bp, Homo sapiens
  misc_feature: GYAE6OF01BEXKA.1.5.A05.1.454.CMB.1.raw
  modified_base (178)..(188): a, c, t, g, unknown or other
  misc_feature (178)..(188): n is a, c, g, or t
tcagacgagtgcgtcacgaccggtgctcgatttagatagatagacagggcaccaagggcccatcggtcttccccctggcaccctcctccaagagcacctctggggcacagcggcctgggctgcctggtcaaggactacttccagtactctatctgagcgggctggcaaggcgcatagnnnnnnnnnnn

SEQ ID NO: 260497 - DNA, 184 bp, Homo sapiens
  misc_feature: GYAE6OF01CNUB6.1.5.A05.1.454.CMB.1.raw
  modified_base (170)..(170): a, c, t, g, unknown or other
  misc_feature (170)..(170): n is a, c, g, or t
  modified_base (175)..(184): a, c, t, g, unknown or other
  misc_feature (175)..(184): n is a, c, g, or t
tcagacgagtgcgtcacgaccggtgctcgatttagatagatagacagggcaccaagggcccatcggtcttcccctggcaccctcctccaagagcactctggggcacagcggccctgggctgcctggtcaaggactacttccagtactctatctgagcgggctggcaggcnatagnnnnnnnnnn

SEQ ID NO: 260498 - DNA, 895 bp, Homo sapiens
  misc_feature: GYAE6OF01DUQNB.1.5.A05.1.454.CMB.1.raw
  modified_base (140)..(140): a, c, t, g, unknown or other
  misc_feature (140)..(140): n is a, c, g, or t
  modified_base (187)..(187): a, c, t, g, unknown or other
  misc_feature (187)..(187): n is a, c, g, or t
tcagacgagtgcgtcacgaccggtgctcgatttagatagatagacgaggggacccaacaaccacatccctcctcagaacgccccagagcacaaccgccccaccatggactggacctggaggattcctttcgtttttgggnggcaggcagccgacgagggtcacccacctcccgaggtccagtcttgngctggtcgtggggctggaggtagaaagacggccgtggggcctcgtaggtagttaacgggtttccaggacgaacggtctttacgaaggtacttacctaaccgtttacaacgttaggtctacgtacttagttaacgtaggtttcggggcgccggaacccggaccgggaaccccggaacggaaacggtcgttagggaggtagggtaggtaggagttaggaactaccgaaccggtgtaggaactaaaggttaacggtaaaaaccaaaaacgttaaaaaactccgaaagtaaaggtaaccgtaccgggaaggaccgtaagacgtaccaattacaacggtaccaccggaacgtaccaaacgtactaaccgaacggtaacgaacgtaaccgttacccaaaggaacggttacggaacgttaccggggaaacggtacctaaccgttacgggaaactacgttaacccgtaagggaaaccccgggtacgtaaacccccggtttcttaaaaccgggtttaccttaaacggggtccgggacccgtaaacggttaaaggggtaactttaaccgttaacgtttacgggaccctttaaacggggttttccgggtaaccccgttggggttaaaccctaacccggggttaactaacccggggtcgttttacggggaccgggttaccggggaacccccggttggggggtaacccccgaaaacccggg

SEQ ID NO: 260499 - DNA, 814 bp, Homo sapiens
  misc_feature: GYAE6OF01DDEA7.1.5.A05.1.454.CMB.1.raw
  modified_base (135)..(135): a, c, t, g, unknown or other
  misc_feature (135)..(135): n is a, c, g, or t
  modified_base (228)..(228): a, c, t, g, unknown or other
  misc_feature (228)..(228): n is a, c, g, or t
  modified_base (240)..(240): a, c, t, g, unknown or other
  misc_feature (240)..(240): n is a, c, g, or t
  modified_base (315)..(315): a, c, t, g, unknown or other
  misc_feature (315)..(315): n is a, c, g, or t
tcagacgagtgcgtcacgaccggtgctcgatttagatagatagacaggggacccaacaaccacatcccctcctcagaacgccccccagagcacaaccgccccaccatggactggacctggagatcctcttttggnggcagcagccacaggtcgcccactccccaggtcccagcttgtgcagtctggggctgaggtgaagagccgtggggcctcgagtgtacgtttccngcgaaggtcttnaggactacctaccttcacgtaggtatcgtactatacgtagttgggtcgaccggacccgaccgggacccccggaanaaaacgggtccgtttaggacggtaggtacggtagggtagtaggactaccgaacgcgtaggacgtaagtacggtaaaacaaactaaaaaacgttcaacgaaacgtaaccgttaccgaacgggtacaacggtaaccgttaaccgtaaccctttaaccggaacgggtactaacgtaaccgtcccggtacggtaacgttaacgtttaacgttaacgtaagtgggtaacgtacgtaggtaccgaccgtacggtacccgttaggaacggttaccgtaacccgggaacgtaaccggaacgggttcttaagtttaagttttacgtttttacggtaccgtaccgttaacccgttgttaacgggtttagggtaaccgtttacgttaacgtttaacctaccggttacttaaccgttaaacgttttcgaaccccggttcgggtacccggggacccgttaaccgggtaccccggttacgtaccccgtaaccgtcccgttaacccgtaccccg

SEQ ID NO: 260500 - DNA, 628 bp, Homo sapiens
  misc_feature: GYAE6OF01BZFSL.1.5.A05.1.454.CMB.1.raw
  modified_base (221)..(221): a, c, t, g, unknown or other
  misc_feature (221)..(221): n is a, c, g, or t
  modified_base (489)..(489): a, c, t, g, unknown or other
  misc_feature (489)..(489): n is a, c, g, or t
  modified_base (495)..(495): a, c, t, g, unknown or other
  misc_feature (495)..(495): n is a, c, g, or t
tcagacgagtgcgtcacgaccggtgctcgatttagatagatagacagggggacccaacaaccacatccctcctcagaagcccccagagcacaacgccccaccatggactggacctggaggatcctcttttggtggcagcagccacaggtgcccactcccaggtccagctgtgcagtctggggctgaggtgaagaagcctggggcctcagtgaaggtttccngcgaaggtcttcgaggatacaccttcacgtaggtatgctatacagttgggtgcgccgacggccccggaacgaacggcttggacgtggagtgggatggatcgaacggcgtggacaagtaggtaacaacgtaaaaatcgaacgtaagtaagttccgaagggacaggtacgtacaccgtttacgagggtaccacgacgtccgacgtaggtacttaacgttagtagtaggacgcgtggagcgagtctaggagtacacgaacgacgtacggtntagttnttagtttcgtgccgttacgtcgttaggtaggaggttctagttacgttacgcttagtactttcgaccgtccgggtacggggaccggtaaccggggtacccttacggtacccgtacccgttcgtcccgttaaccg

SEQ ID NO: 260501 - DNA, 983 bp, Homo sapiens
  misc_feature: GYAE6OF01DLPZV.1.5.A05.1.454.CMB.1.raw
tcagacgagtgcgtcacgaccggtgctcgatttagatagatagacaggggacccaacaaccacatcccctcctcagaagcccccagagcacaaccgccccaccatggactggacctggaggatccttctttttggtggcagcagccacaggtcgcccactcccaggtccagcttgtgcagtctgggctgaggtgaagagccgtggggcctcgagtgaaggtttcctgcaaggcttcgaggtatacaccttcactaggtatcgtatatacagttgggtgccgccgacggcccccggaacaaacggtcttaggaggtgggagtggggatgggatcgaacggcgttaggactaagtacggtaaacaaacgtaaaaaaattccgaacgtaacggtaaacggttaccgaacggggactaacggtaacgttacccgttaaacccgttttaaacccggaaacggggtaaccgtaaccgtaaccgttaccccgggaaccgggtaaacgggtttaaacgttttaaaccgttttaaacgttacggtttaacgggggtaacgtcggtttagggaaccggtaccgggtaaccggtaccccggttaaggtaacccgggttaaacgtaaaccccgggtaaaaccggtaacccggtaaacccggggtcgttttaaacgggtttttaacggtttttaacggtttttttttacgggttaccgggtttacccgtttaaccccgggtttaaccgttttaacgggggttacggggtttacggttttaacccggtttaaacgttttttaaacgtttaaccccggtttacgttttaaccgtttaaaaccgggtttttttaaccgaccccggggtttttaacccgggtacccggggggtttaaccccccgggaaaacccggggggttttaaccccccggtttaacgggggtttaccccccgttaaacccgggtttcccccgtttaccccgggttaaaccccccggg

SEQ ID NO: 260502 - DNA, 730 bp, Homo sapiens
  misc_feature: GYAE6OF01BSQA9.1.5.A05.1.454.CMB.1.raw
  modified_base (131)..(131): a, c, t, g, unknown or other
  misc_feature (131)..(131): n is a, c, g, or t
  modified_base (143)..(143): a, c, t, g, unknown or other
  misc_feature (143)..(143): n is a, c, g, or t
  modified_base (173)..(173): a, c, t, g, unknown or other
  misc_feature (173)..(173): n is a, c, g, or t
  modified_base (226)..(226): a, c, t, g, unknown or other
  misc_feature (226)..(226): n is a, c, g, or t
tcagacgagtgcgtcacgaccggtgctcgatttagatagatagacaggggacccaacaaccacatccctcctcagaacgccccagagcacaacgccccacatggactggacctggagatccttcttttggnggcagcagccanaggtcgcccactcccgaggtccagtcttgngcagtcgtggggctggaggtagaagagccgtgggcctcgagtgtacgtttccngactaggtcttgaggtactaccgaccttcgacgttaggtactgtactaacgttactaggtttcggtacgccgaccgaccgggacccccggaagaaacggtccgttaggtaggtcggaagtggggagtggtacgttacgaacgcgtaggactaacgtaggtaaacctaaacgtaaaacgttacaacgtaacgtaacgtacggaaggaccgtaagtagtacctaaccgtttaccgaacggactacgtacgtaccgagtacgttacttaatagttagagggtacgacgttacgaggtctacggtcgtacgagttacgaacgaacggtaaccgtcggtacttaagtttacgtttagttttcgtacgtaccgttacgttacggtacgtacggtacgttacttaaggttacgttacgtaccgttaagttaccgtttagtacccgttacgggttcggaaccgtaccgggttaaccgtacggttacccgtccgttcccgtcgttaaccccgg

SEQ ID NO: 260503 - DNA, 848 bp, Homo sapiens
  misc_feature: GYAE6OF01DYV3B.1.5.A05.1.454.CMB.1.raw
tcagacgagtgcgtcacgaccggtgctcgatttagatagatagacagggacccaacaaccacatccctcctcagaacgcccccagagcacaaccgccccaccatggactggacctggaggatccttctttttggtggcagcagccacaggtcgcccactcccaggtccagcttgtgcagtctgggctgaggtgaagacgccgtggggcctcgagtgtaacggtttcctggcaaggtccttacgaaggtacttaacctacctttacgacgttacgggtatcggtacttaagttacgtaacggtttggggtacgccggtacccgaaccgggtcccccccgggaaagaaacgggttcctttaggacggttagggaggttaggggattagggaacttccgaaaccggtcgtacggactaaaggttacggtaaactaaacgtaaaaaacttccgaacaacggtaacggttccgaagggtccgaagtacggtacctaaccgtttacgacgggaccaacgtacgttccggacgtaagtaagtttacttaagttagtacgggtagtcgtagtacgacgtacggccgttaagaacgtaccgtaaccgaaaccggcgtaacggtctttaggtaacgttttagtttttaccgggcgtaaccggtttacccgttaagggttaacggtttcgggtaaacgttcgttaacgtttaaacggttacccggtactttaaccgtttaaagttttaccggtacccggttttcccggggaaacgggggttacccgtaaacccgggggttaaccccggtttacgggtaaccccttaaccccgggttcccgttacccggttaaaccccgg

SEQ ID NO: 260504 - DNA, 844 bp, Homo sapiens
  misc_feature: GYAE6OF01CHCY4.1.5.A05.1.454.CMB.1.raw
  modified_base (144)..(144): a, c, t, g, unknown or other
  misc_feature (144)..(144): n is a, c, g, or t
tcagacgagtgcgtcacgaccggtgctcgatttagatagatagacaggggacccaacaaccacatccctcctcagaagcccccagagcacaacgccccaccatggactggactggagatccttctttttggtggcagcagccanaggtgcccactcccaggtccagcttgtgcagtcgtggggctgaggtgaagacgccgtcgggcctacgaggtggtaacgtttccgtggacgaacggtcttcgaggtaactaccgtaccttacgacgtaggtatcgtactatacgtagttgggtcgccgaccgacccgggaccccggaacgaacggtcttaggaggtggtaggtggggtagtaggtacgtaccgaacggtcgtacggaacgttaacgtaacggtaaaacctaaaacgtaaaaactaccgaactaacggtaaacgttccggaacgggtacgaaggtaaccgttacccgttaaacccgtttaaacggaacgggtaacccaaccggttaacgtacccgggtaacgggtaaacggtttaactttaaacgtttaaggttaacggacggtaaacggtaccgtaaggacgtaccgtaaggtccggtaacggaaacgttaacccgaaacgggaaacccgtaccgggttaacggaccgttttaaagtttacgttttaaggtttttaccgggacgttacccgttaacgttacgggttaacgggttacggttaaggtaccttaagtttaacgtccgtaacgtttgtaaacggtttccgtacgttccgggggtaccgtaaccgggttaccgggaacccgtttccggtaccctcccgggttcctcccggtacccg

SEQ ID NO: 260505 - DNA, 778 bp, Homo sapiens
  misc_feature: GYAE6OF01A5PDM.1.5.A05.1.454.CMB.1.raw
tcagacgagtgcgtcacgaccggtgctcgatttagatagatagacagggacccaacaaccacatccctcctcagaagcccccagagcacaacgccccaccatggactggacctggaggatcctcttttggtggcagcagccacaggtgcccactcccaggtccagcttgtgcagtcgtggggctgaggtgaagagccgtggggcctcagtgtaaggtttcctgcaaggtcttcgaggactactaccttcacgtaggtatgctatacagttgggtgcgccgacggccccggaacgaacggcttagaggtggagtgggatggactacgacgcgtggactaagtacggtaaacaaacgtaaaaaacttcgaacgtaacggtaaacggttaccgaacggggtacaaggtacgtaacccgttaacccgtttaaccggaaccggggtaacctaaccgtaaccggtccccggtacggtaacgggttaacgttttaactttaagtaacggttacggggaacgtaccgtaggacgtaccgacggtaccggtacgtaagtaaccgtaacccggaacgaaccgtacggtacttagtttaacgttttagtttttacggtacggttaaccgttaccgtttacgttagggtacgggttaacggttacgttaagtttacgttaccgtactttaacgtacgttttacggtaccgttcccgggttaccgggtaccccgtaaccgggttaacccggtaccggttacccggttaccccttcccgttaccctacccgg

SEQ ID NO: 260506 - DNA, 750 bp, Homo sapiens
  misc_feature: GYAE6OF01CRPZP.1.5.A05.1.454.CMB.1.raw
tcagacgagtgcgtcacgaccggtgctcgatttagatagatagacaggggacccaacaaccacatccctcctcagaacgcccccagagcacaaccgccccaccatggactggacctggagatccttctttttggtggcagcagccacaggtcgcccactcccaggtcccagcttgtgcagtcgtggggctggaggtgaagaagccgtggggcctcgagtgtaaggtttcctgcgaaggtcttacgaggactaccaccttcacgtaggtatgactatactagttgggtgccgccgacggcccccggaagaaacggccttgacgtggagtgggatggatcgaacgcgtggacaattacggtaaacaaacaaaaatttccaactaagtaacgttccgaagggacaaggacgtacctaacccgtttaaccgaacggggtaccaacgtacgtacccggacggagggtaactttaacgttaattagtaggtacgacgttagagacgacggtacctaggaacgtaacgtaccggaaagaccgtaaccggtacgttacgtttaatttagttttttcggtacggtacccgttacccgtttgttaacgggtagggttacggttaccgttaagtttaacgtaccggttacttaaccgttaagttttaccgaccggtttcccggtacgggggtacccgtaaccgggggttaaccccttacgggttacccgttaacccgggttcccttacccggttaccccgg

SEQ ID NO: 260507 - DNA, 817 bp, Homo sapiens
  misc_feature: GYAE6OF01E35HH.1.5.A05.1.454.CMB.1.raw
  modified_base (138)..(138): a, c, t, g, unknown or other
  misc_feature (138)..(138): n is a, c, g, or t
  modified_base (229)..(229): a, c, t, g, unknown or other
  misc_feature (229)..(229): n is a, c, g, or t
  modified_base (504)..(504): a, c, t, g, unknown or other
  misc_feature (504)..(504): n is a, c, g, or t
tcagacgagtgcgtcacgaccggtgctcgatttagatagatagacaggggacccaacaaccacactccctcctcagaacgccccagagcacaaccgccccaccatggactggacctggaggactccttcgtttttggnggcagcagccacaggtgcccactcccaggtccagtcttgtgctagtcgtgggctggaggtagaagacgccgtgggcctgagtgtacgttcngacagtctcgagtactaccaccttgacgttaggtactagtcttaactacgtaggttgggtcgaccggtccgaacccgggaccccggaagtaacggtccttagggacggtcgggaggttagggtaacgttcggaataccgaacggtaccgtcggacgttaaacgttacgggaaaactaaaaccgtaaaaacttccgaaacgtacggtaacgttaccggaagggacgtaaggtaccgtttaacctaaccggtttaaccgacggaacctaccggtacnccgggtaacgaacggttaactttaacgtacgttaggtcggacttacgtacggactcgtaacggtcgtaggtaacggtaccgaaccgtaacggtaacccgaggtttacctttaagggttaactttttacgttacggttacccggccgttaacgtttacgggtaacggtttaggacgttacgtagggttttaaacctaccgggtactttaaaccggttaccgttgggttaacccggttccccgggtacgggggtaaaccccgtacccgggttaaccccggtcgttaaccccggttccccttccgtacccgtcccg

SEQ ID NO: 260508 - DNA, 616 bp, Homo sapiens
  misc_feature: GYAE6OF01E2M8P.1.5.A05.1.454.CMB.1.raw
  modified_base (133)..(133): a, c, t, g, unknown or other
  misc_feature (133)..(133): n is a, c, g, or t
  modified_base (151)..(151): a, c, t, g, unknown or other
  misc_feature (151)..(151): n is a, c, g, or t
  modified_base (174)..(174): a, c, t, g, unknown or other
  misc_feature (174)..(174): n is a, c, g, or t
  modified_base (484)..(484): a, c, t, g, unknown or other
  misc_feature (484)..(484): n is a, c, g, or t
  modified_base (490)..(490): a, c, t, g, unknown or other
  misc_feature (490)..(490): n is a, c, g, or t
  modified_base (519)..(519): a, c, t, g, unknown or other
  misc_feature (519)..(519): n is a, c, g, or t
  modified_base (560)..(560): a, c, t, g, unknown or other
  misc_feature (560)..(560): n is a, c, g, or t
  modified_base (568)..(568): a, c, t, g, unknown or other
  misc_feature (568)..(568): n is a, c, g, or t
tcagacgagtgcgtcacgaccggtgctcgatttagatagatagacaggggacccaacaaccacatccctcctcagaacgcccccagagcacaacgccccaccatggactggacctggagatccttcttttggnggcagcagccacaggtcncccactcccaggtccagcttgtncagtcgtgggctggaggtgaagacgccgtggggcctcgaggtgtaacggtttcctgacgaaggtcttacgaggactacctaccttgacgttaggtatcgactacgtacgtagttgggtcgcggaccgaccggaccccggaagaacggtccttaggaggtcgggagttggggatgggtactacgacggtcgtacggataagttacgtaaaacaaactaaaatcgaacagtaacgttccgagggacacggtacgtacctaaccgttacggacggaacactacgtcggacgtagtacttacgtatagtacgangtacgngcacgtcgagagtacaccgagcgaacgtnttagttagttattgcgtacctacgttacgtaggcgtacgtntatcgtcngttactgttctcgcgtacggccaggtaccctcgactcgtctccgtacg

SEQ ID NO: 260509 - DNA, 781 bp, Homo sapiens
  misc_feature: GYAE6OF01CSVGL.1.5.A05.1.454.CMB.1.raw
  modified_base (437)..(437): a, c, t, g, unknown or other
  misc_feature (437)..(437): n is a, c, g, or t
  modified_base (574)..(574): a, c, t, g, unknown or other
  misc_feature (574)..(574): n is a, c, g, or t
tcagacgagtgcgtcacgaccggtgctcgatttagatagatagacaggggacccaacaaccacatccctcctcagaacgcccccagagcacaaccgccccaccatggactggacctggagatccttcttttggtggcagcagccacaggtcgcccactcccaggtccagcttgtgcagtcgtggggctggaggtagaagagccgtggggcctcgagtgtaacggttcctgacgaaggtcttacgaggtactacctaccttcaacgtaggtatcgacttaactacgtagttgggtcgccgtaccgaccggaccccggtaagaacggtcgttaggtaggtaggaggtaggagtacggaacgtacgacggtcgtacggactaagtaacggtaaaacaaacgtaaaaacgttacaacgtaagtaacgttaccggaacgganacgtacgtacctaaccgttacgaacggtacacgtacgtccgaacgtaacgttacgttaacttagtaggtaggacgcgtaagacgtacgacgtacgtaggaaccgtacgtaacccgtaaggaaccgttaaccggggtntttaacgggtttaacgtttttaggtttcggaccggtacccgttaccggtttaacggtacgggtttaacgggacgtttaacgttaacctttaacggttaaccgtcgtttaacgtttaaacgttccggtacccggttacgggtccccggggtaaaccgtacgggtaaccccgttacgggttacccctacccgtcgttaccccggtaccg

SEQ ID NO: 260510 - DNA, 182 bp, Homo sapiens
  misc_feature: GYAE6OF01DC6N2.1.5.A05.1.454.CMB.1.raw
  modified_base (60)..(60): a, c, t, g, unknown or other
  misc_feature (60)..(60): n is a, c, g, or t
  modified_base (172)..(172): a, c, t, g, unknown or other
  misc_feature (172)..(172): n is a, c, g, or t
  modified_base (177)..(182): a, c, t, g, unknown or other
  misc_feature (177)..(182): n is a, c, g, or t
tcagacgagtgcgtcacgaccggtgctcgatttagatagatagacagggcaccaagggcncatcggtcttcccctggcaccctcctcaagagcacctcgtggggcacagcggccctgggctgcctggtcaaggactacttccagtactctatctgagcgggctggcaggcgnatagnnnnnn

SEQ ID NO: 260511 - DNA, 258 bp, Homo sapiens
  misc_feature: GYAE6OF01A9CCI.1.5.A05.1.454.CMB.1.raw
  modified_base (252)..(258): a, c, t, g, unknown or other
  misc_feature (252)..(258): n is a, c, g, or t
tcagacgagtgcgtcacgaccggtgctcgatttagatagatagacaggtgcagttccagatttcaactgctcatcagcagcctgcagtctgaagattttgctagtttattactgtcagcaagtataataactggcctccgacgttcggccaaagggacaaggtggaaatcaaaacgatgtaggctgcaccatctgtctcatcttcccgcatctgactcgtctctactgagcgggctggacaaggcgcatagnnnnnnn

SEQ ID NO: 260512 - DNA, 322 bp, Homo sapiens
  misc_feature: GYAE6OF01C3E8E.1.5.A05.1.454.CMB.1.raw
  modified_base (304)..(304): a, c, t, g, unknown or other
  misc_feature (304)..(304): n is a, c, g, or t
  modified_base (306)..(322): a, c, t, g, unknown or other
  misc_feature (306)..(322): n is a, c, g, or t
tcagacgagtgcgtcacgaccggtgctcgatttagatagatagacaggggcagttccagtatttcaactgctcatcagcagcctgcagtctagaagtattttgctagttttattactgtcagctaagttaataaataactcggccctaccggacgttccggaccgaaagggaccaaggtaggaaatacaaaacgtactggtcggcctgaccaacctattcttcgttcttactacttcccttcccgctagtctgactcgtactgccgcgtggacggcgggcgtacggagaaacggcgacaagtgncnnnnnnnnnnnnnnnnn

SEQ ID NO: 260513 - DNA, 276 bp, Homo sapiens
  misc_feature: GYAE6OF01BFCUQ.1.5.A05.1.454.CMB.1.raw
  modified_base (236)..(236): a, c, t, g, unknown or other
  misc_feature (236)..(236): n is a, c, g, or t
  modified_base (257)..(257): a, c, t, g, unknown or other
  misc_feature (257)..(257): n is a, c, g, or t
  modified_base (263)..(276): a, c, t, g, unknown or other
  misc_feature (263)..(276): n is a, c, g, or t
tcagacgagtgcgtcacgaccggtgctcgatttagatagatagacaggggcagttccagatttcaactgctcatcagcagtctgcagtctgaagatttttgctagttttattactgtcagcagtataataactggcctccgacgttcgaccgaaggaccaaggtgaaatcgaaacgactggtggctgcaccatctgtcttcactccttcccgctatctacgaacgctacgtcgtcnggacgcggctggacaagggcncatagnnnnnnnnnnnnnn

SEQ ID NO: 260514 - DNA, 820 bp, Homo sapiens
  misc_feature: GYAE6OF01A417L.1.5.A05.1.454.CMB.1.raw
  modified_base (226)..(226): a, c, t, g, unknown or other
  misc_feature (226)..(226): n is a, c, g, or t
tcagacgagtgcgtcacgaccggtgctcgatttagatagatagacaggggacccaacaaccacatccctcctcagaacgccccagagcacaaccgccccaccatggactggacctggaggactccttcgtttttggtggcagcagccacgaggtgcccactcccgaggtccagcttgtgcagtcgtggggctggaggtgaagagcgtgggcctcagtgagtttccngcgaaggcttcgaggataccaccgtttcacgttaggtatgtacctatacgatttgggtcgccgtaccgaccggaccccggaacgaaacggtccttaggacggtacgggtaaggtaggggaacgttggggaacttccgaaaccggtcgttacgggaccgtaaacgttacgggtaaaaccctaaaacggtaaaaaaactttccgaaaccgtaaacggttaaaccgtttacccggaaggggacctaacggtacgtaacccgtaacccgttttaaccgaacggggtaacctaaccgtacgtaccccgggtaacggtacgggttaactttaaccgtttagtaacgtagggtacgtcgttaggaacgtacgtacgtacccttaggaccgtaacgtaccggtaaacgaccgtcggacgttagttaagtttacgttttcggtcgtaccgtaccgttacgttaacgggttggtaccggttacgttaaccgtttagttaccgttacttacggttaactttcggaacccgttcccgggtacgggtacccgtaacccggggtaaccgttcggttaccccgaaccggtttccttaacccggtcccgg

SEQ ID NO: 260515 - DNA, 760 bp, Homo sapiens
  misc_feature: GYAE6OF01EZL7Z.1.5.A05.1.454.CMB.1.raw
  modified_base (293)..(293): a, c, t, g, unknown or other
  misc_feature (293)..(293): n is a, c, g, or t
tcagacgagtgcgtcacgaccggtgctcgatttagatagatagacaggggacccaacaaccacatccctcctcagaagcccccagagcacaaccgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggactacaccttcactaggtatcggctatacagtttgggtgcgccgtacggccccgganaaacggtcttgagtggagtggggatggatcgaacgcgtaggacaagtacggtaaacaactaaaaattcaacaagaagttccgagggacagacgtacctaaccgtttaaccgagggtaacacgtacgtacccgggtacgggtaactttaacgtttagtaacgttagggaacgtcgttacgggtagaccgagtaccgttaggacgtaacgtacccgaaacgtaccgaccggtacgtttaacgtttacgttttagttttttacggtacggtaaccgtaacccggtttacgttaacgggttacgggttaacggttactttaacgtttaacgtttaaccgggttacctacggttttaaactttacccgggttaccgttcccgggtaccgggggtaccccggtaaacggggttaaccccggtaccggggttacccgtaaccccgtttccggttcccccttacggttaccccgg

SEQ ID NO: 260516 - DNA, 817 bp, Homo sapiens
  misc_feature: GYAE6OF01C15JJ.1.5.A05.1.454.CMB.1.raw
  modified_base (227)..(227): a, c, t, g, unknown or other
  misc_feature (227)..(227): n is a, c, g, or t
tcagacgagtgcgtcacgaccggtgctcgatttagatagatagacaggggacccaacaaccacatccctcctcagaacgcccccagagcacaaccgccccaccatggactggacctggagatccttctttttggtggcagcagccacaggtgcccactcccaggtccagcttgtgcagtctggggctggaggtagaagagccgtggggcctcgagtgtaggtttccngacaaggtcttacgaaggtactacctaccttacacgtaaggtctgacttaatacgtagtttcggggtcgccgacccggaccgggacccccggaagaaaacggtcgttggaggtgggtaggtgggtagtggacttaccgaacggcgtaggactaagtacggtaaaacaaaactaaaaaacttccaacgtaagtaacgttacccgaagggacaacgtacgtaccttaacccgttaaccgaacggtaccacacgttccggacggtaaggttacttaacgttaattaaggtaggtacgtaccgttaggacgtacgaacggtcccgttagggaacgtacggttaacccggaaacgtaaccggtaacccggggttactttaaggtttaacgtttttagtttttttacgggaccggtttaccggttaccgtttaccgttaagggttagggttacgttaacttaacgtttttacgtaccgttacgttaacgttaacgttttcgaacccggtttcccgggtacggggtaaccccgggttaaccgggttaaccccgtttaccgggtacccttaacccggttccccgttcccgtaaccccg

SEQ ID NO: 260517 - DNA, 646 bp, Homo sapiens
  misc_feature: GYAE6OF01EKX5A.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacagttgggtgcgccacggaccccgaacaaaggcttgagtggagtgggatggatcgaacgctggcaagtggtaaacaacaaaaattcaacagaagttccagggcagactctaaccttacgaggacacgactccgacgaaggtattacttaagtatggagtactagagcagcctagtagactaccggaagaccgaggtacttgtaatttagtttttcggacgtaccgtaccgttcgttaagggtgggtaacgttacgtaagtttaacgtttacggtacttaacgttaacgtttttacggaaccctttcccgggtaccggggggtaacccctaacggggggttaaaccccttacgggttaccccgtacccggtttcctcccgttaaccg

SEQ ID NO: 260518 - DNA, 814 bp, Homo sapiens
  misc_feature: GYAE6OF01ACJPK.1.5.A05.1.454.CMB.1.raw
  modified_base (236)..(236): a, c, t, g, unknown or other
  misc_feature (236)..(236): n is a, c, g, or t
tcagacgagtgcgtcacgaccggtgctcgatttagatagatagacaggggacccaacaaccacatccctcctcagaagcccccgagagcacaaccgccccaccatggactggaccctggaggactccttcttttggtggcagcagccacaggtgcccactcccaggtccaggtcttgtgcagtcgtggggctgaggtcgaaggacgccgtggggcctgtacgtggtaaggtttccngacaaggtcttacgaggactaccgaccttcgactaggtactgcctatacagttgggtcgccgccgacggccccggtaacgaacggccttaggagtcggagtgggaatcggtacgtccgaacggcgtacggacctaagtacgggtaaaccaaacttaaaaacttccgaacgtaacggtaaacggtttaccgaaggggactaacggtaacggttaccctaacccgtttaaccggacgggaacctaccgtaacgtcccggaacggtaacgggtaactttaaccgttaagtacggttacgggacgtacgttacggaacgtccgtaaacgggtcctaggggtaactaaccggttaacccggaaaggtacccgtacgggtcctttaaggggtttaactttacggtttttacggacgggtacccgtaaccggtttacggtacgggttacgggtacgttacgttaacgttccgttaaacggtcccgttaaccgttaacgggtttcccgaacccggtttccgggtacccgggtaacccgtaccggggtaccccttcgggtacccttacccgggtcctcccgtacccg

SEQ ID NO: 260519 - DNA, 809 bp, Homo sapiens
  misc_feature: GYAE6OF01BG8I7.1.5.A05.1.454.CMB.1.raw
  modified_base (137)..(137): a, c, t, g, unknown or other
  misc_feature (137)..(137): n is a, c, g, or t
  modified_base (156)..(156): a, c, t, g, unknown or other
  misc_feature (156)..(156): n is a, c, g, or t
  modified_base (244)..(244): a, c, t, g, unknown or other
  misc_feature (244)..(244): n is a, c, g, or t
tcagacgagtgcgtcacgaccggtgctcgatttagatagatagacaggggacccaacaaccacatcccctcctcagaacgcccccagagcacaaccgccccaccatggactggacctggagatccttcgtttttggnggcagcacgccacaggtcncccactcccaggtccagtcttgtgcaggtcgtggggctggaggtagaagtacgccggttcggggcctacgaggtagtaacggtttccnggccgtaaggtcttacgagtactacctaccttacacggttaggtatcgtacttagtacgtagttcggttcgcccgtaccgaccgggaccccggaacgaaacggtcgttaggacggtggaggtagggtacgtaggtacgtaccggtaacggtccgtaggtaacctaaaggtaacggtaaaaacctaaaaacgttaaaaacgtacgtaaacgaaggttaacccggtacggacggtaaacggtacggtaacccgttaccgttaacccggtttaaacccggacggtaaccctacgtaaccgtaccggaccggtaagttaacgttacgttagtagacggtacgtacgaggtacgcgtaaggtcacgtaaggtaaccgacgtaaccgacgtacgttacgttgttaagtttacgtttagtacgtaccgtacgttacggtacggttaggtacgttaccgtaaagtttccgttaaccgtagttacccgttagttacccgaacggttcccggggaccgtaacccggtttaccgggccccgttaagggttacccctacccgttcgtaccgtacccg

SEQ ID NO: 260520 - DNA, 704 bp, Homo sapiens
  misc_feature: GYAE6OF01EN3W0.1.5.A05.1.454.CMB.1.raw
tcagacgagtgcgtcacgaccggtgctcgatttagatagatagacaggggacccaacaaccacatccctcctcagaacgcccccagagcacaaccgccccaccatggactggacctggaggatcctctttttggtggcagcagccacaggtgcccactcccaggtccagcttgtgcagtctggggctgaggtgaagagccgtggggcctcagtgaaggtttcctgcaaggcttcgaggataccaccttcactaggtatgctatacagttgggtgcgccacggccccggagaaagcttgagtggatggggatggatcaacggctggacagtcggtaaacaacgtaaaaattcaacagtaacgttaccgagggacaagagtactaccgtttaaccgagggaaccacacgtaccgacggacggtaatttaaccgttaattagtaggagtacgttaggaacgacgacgtcccgtaggaagtacgttaccggaaacgaccgaacggtcgttacgttaatttaacgtttttggtaccggtccgtaacccgttagttaacgggtgggtacggtttagtaacgtttaacttacggtaccgtttagttaaacgtttttacggaccctttccccgggtacgggggtaccccgttaacgggggtaaccccgtttacgggttaccccgtaacccggttcccgttccgttaaccccg

SEQ ID NO: 260521 - DNA, 793 bp, Homo sapiens
  misc_feature: GYAE6OF01C3X77.1.5.A05.1.454.CMB.1.raw
  modified_base (291)..(291): a, c, t, g, unknown or other
  misc_feature (291)..(291): n is a, c, g, or t
  modified_base (323)..(323): a, c, t, g, unknown or other
  misc_feature (323)..(323): n is a, c, g, or t
tcagacgagtgcgtcacgaccggtgctcgatttagatagatagacaggggacccaacaaccacatccctcctcagaacgcccccagagcacaacgccccaccatggactggacctggagatcctcttttggtggcagcagccacaggtgcccactcccaggtccagcttgtgcagtctggggctgaggtgaagaacgccgtggggcctcgagtgaaggtttcctgacaaggcttacgaggtatacacctttcactaggtatgactatacatgggtgcgccacggccccganaaggtcttgagtggagtaggatggatcaacgngtggactaaacgtagggtaaacctaaaactaaaaaaagttccaaaacgtaacggtaaaacggtttcccgaaaggggccgtaagtacggttacctaaccgtttaaccgaaggggtaaccaacctaagtcccggacgtagggttaactttaaccgttaagttagtagggtaacgaccggtaggaacgaccgtaacggacccgttaggaacgaacttaacccgggaaagaccggaaccgggtacttagggttaattttacgtttttacggtaggttacccggtacccttaacggttagggttaacgggtaacgggtttaccttaaacggttttaacgtttaaacccggtacctttaacgttaaacggtttttaccggaacccgttttaccggggtacccgggggtaccccgtaaaccggggttaaaccccgtaggggttaccctaccccgggttaccttccccggttaacccg

SEQ ID NO: 260522 - DNA, 875 bp, Homo sapiens
  misc_feature: GYAE6OF01CNAY6.1.5.A05.1.454.CMB.1.raw
tcagacgagtgcgtcacgaccggtgctcgatttagatagatagacaggggacccaacaaccacatccctcctcagaacgcccccagagcacaaccgccccaccatggactggacctggagattccttctttttggtggcagcagccacaggtcgcccactcccgagtccagcttgtgcagtctggggctgaggtgaagacgccgtgggcctgagtgtaaggtttccgtagacgaaggtccttcgaggtactacctaccttacacgtaggtatgactatacgtagttggtgcgccgaccgggaccccggaacgaaacggtcgttggacggttcgggaggttcgggagtaggacgttacgaaccggcgtaggacgaaagttaacggtaaaacgaaacctaaaaacttacaaacgtaaacgtaagtttaaccgaacgggtacgaacggtaacgtttacccgtaacccgttttaaaccggaacgggtaaccgtaaaccgtaaccgttaccccggtacggttaaacggtaacttttaaccgttaaagtttacgttaacggggtaagtaccgttaggacgtaccgtaacggtaccccgtagggtaaccggtaacgttaaccgggaaacgtaaccgtaacccgggtatttaaccggtttaagtttttaagtttttaaccggtccggttaaccgttacccgttacggttaagggtttacggacgggttttacccgtaaattttaacgggtttaccttagtttaacccgtaaacggtttttcccgttaaccggtttaccccgggttacggggtacccgttaaacccggggttaccccggttacgggttttccccgaaccccgtttccgttaaccccggttcccg

SEQ ID NO: 260523 - DNA, 213 bp, Homo sapiens
  misc_feature: GYAE6OF01EDBUP.1.5.A05.1.454.CMB.1.raw
  modified_base (179)..(213): a, c, t, g, unknown or other
  misc_feature (179)..(213): n is a, c, g, or t
tcagacgagtgcgtcacgaccggtgctcgatttagatagatagacagggcaccaagggcccatcggtcttccccctggcaccctcctccaagagcacctcgtggggcacagcggccctgggctgcctggtcaaggctacttcctcgtactgcgctgagcgggctggcaaggcgcatagnnnnnnnnnnnnnnnnnnnnnnnnnnnnnnnnnnn

SEQ ID NO: 260524 - DNA, 682 bp, Homo sapiens
  misc_feature: GYAE6OF01EY8AC.1.5.A05.1.454.CMB.1.raw
  modified_base (137)..(137): a, c, t, g, unknown or other
  misc_feature (137)..(137): n is a, c, g, or t
  modified_base (215)..(215): a, c, t, g, unknown or other
  misc_feature (215)..(215): n is a, c, g, or t
  modified_base (261)..(261): a, c, t, g, unknown or other
  misc_feature (261)..(261): n is a, c, g, or t
  modified_base (497)..(497): a, c, t, g, unknown or other
  misc_feature (497)..(497): n is a, c, g, or t
tcagacgagtgcgtcacgaccggtgctcgatttagatagatagacaggggacccaacaaccacatccctcctcagaacgcccccagagcacaaccgccccaccatggactggacctggaggactccttctttttggnggcagcagccacaggtcgcccactcccgaggtcccagcttgtgcagtcgtgggctgaggtagaagagccgtgggcctnagtcggtaagtttcctgacgaaggtcttacaggactacctaccttnaacttaggtatgacttatactagttgggcgccgtacccgaccgggacccccggaataaacggtccgttaggacggtaggaggtaggggatacgggtactaccgaacggcgtacggactaaagtaggtaaacaaaactaaaaacttcgaaactaaggtaacgttccgaaggtacaagacgtctaaccgttaacgacgaccacacgtcgacgtagtattactaagtatggatgtagancgtacgacgtagacgtaacgtaccgaaggtacacggtactagggttactttagttttacgcgtacgtaccttaggtacgttagggtacttacgtaacttttagtaccgtacttacgtaacgtttcgtacgtccgggtacggacccgtacggtaccccgttgacccgtaccgttcctccgtacccg

SEQ ID NO: 260525 - DNA, 771 bp, Homo sapiens
  misc_feature: GYAE6OF01A31A4.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggatgatcctcttttggtggcagcagccacaggtgcccactcccaggtccagcttgtgcagtctggggctgaggtgaagagccgtggggcctcgagtgaaggtttcctgcgaaggcttcaggactaccaccttcactaggtatgactatactagttgggtcgcgtccgtacgggacccccggaagaaaggtccgttaggacggtagggaagtggggataggggtaactaccggaaccgtccgtaggactaacgtaacggtaaaaccaaaactaaaaaacgttccgaaacgaacggtaaaccgttaccgaacgggaccgtaaggaacgttaccgtaacccgtttaccgaaaggggtaccacgacgttacccggacggtaaggtaactttaacgttaattcggtaaggtagtaccgtaggacgactacggtccgtaggaccgtaacgtaccggaacgtacgtacgggtacttaggttatttacgttttacggccgtacccgttaaccttgtaagggttcggtaacggttcttactttaaacgtacccggtacttacgtttaagttaccggtaacccgtttccggggtaaccgggggtacccgtaaccgggggttaaccccgttacgggtccccgtaaacccggttcccccttacccggg

SEQ ID NO: 260526 - DNA, 708 bp, Homo sapiens
  misc_feature: GYAE6OF01DO6FD.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctgggctgaggtgaagagccgtggggcctcagtgaaggtttcctgcaaggcttcaggatacaccttcactaggtatgactatacagttgggtacgccgccgacgggacccccgaagaaacggtctggaggtggagtgggagtggatcgaacgcgtaggacaagttaggaaacaactaaaaattcaactaagtaacgttaccgagggacaagacgtacctaaccgttaccgacgggaccacgtacgtaccggacgtaagtactttaacgttaatacggtaaggacgtacgtaggaacgtacgtacgtcccgtaggtaacgtacgtaccggaaagacggtaccggtacttagtttaactttaggtttttcgaccggttaccgtaccgttacggttagggttacgggtacggttacttaacgtttaacgttccgtaccttaacgttaacgttttcccggaacgtttccgggtacggggtaacccgacccgggttaaccgtacggtcccgtaacccgttcccgttcccgtaacccg

SEQ ID NO: 260527 - DNA, 183 bp, Homo sapiens
  misc_feature: GYAE6OF01CE5SV.1.5.A05.1.454.CMB.1.raw
  modified_base (178)..(183): a, c, t, g, unknown or other
  misc_feature (178)..(183): n is a, c, g, or t
tcagacgagtgcgtcacgaccggtgctcgatttagatagatagacagggcaccaagggcccatcggtcttcccctggcaccctcctccaagagcacctctggggcacagcggccctggctgcctggtcaaggactacttcctcgtactgcgctgagcgggctgggcaaggcgcatagnnnnnn

SEQ ID NO: 260528 - DNA, 743 bp, Homo sapiens
  misc_feature: GYAE6OF01DU4XR.1.5.A05.1.454.CMB.1.raw
  modified_base (133)..(133): a, c, t, g, unknown or other
  misc_feature (133)..(133): n is a, c, g, or t
  modified_base (309)..(309): a, c, t, g, unknown or other
  misc_feature (309)..(309): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggnggcagcagccacaggtcgcccactcccaggtccagcttgtgcagtcgtggggctgaggtgaagagccgtggggcctcaggtgtaacggtttcctggacaaggtcttacgaggatacctaccttcactaggtatgactatactagttgggtcgccggcccgacgggtaccccggaanaaacggtcttaggaggtaggagtggggaatgggactacgaaccgcgtaggacgtaagtagggtaaaactaaactaaaaaacttcgaactaaggtaacgttaccggaggcgtaagacgtactaacccgtttaaccgaacggtacgactacgtaccggacggaaggttacttaacttagtacgtaggtacgtcgacgaacggcgtacgaccgtacggaagttaccaccggaacgacgtacggtactagtttaacgtttagtttttcggaccgttaccggtacctttacgttaacggttagggtacggttacttaacgtttaacgttaccgttacgttaacgttaacgtttacggttaccgttccggttaccgggggtacccgtaacccggggttaacccgtcggttacccgtaacccgttcccctaccgtaacccg

SEQ ID NO: 260529 - DNA, 661 bp, Homo sapiens
  misc_feature: GYAE6OF01BSRIC.1.5.A05.1.454.CMB.1.raw
  modified_base (228)..(228): a, c, t, g, unknown or other
  misc_feature (228)..(228): n is a, c, g, or t
tcagacgagtgcgtcacgaccggtgctcgatttagatagatagacaggggacccaacaaccacatccctcctcagaacgcccccagagcacaacgccccaccatggactggacctggaggatcctctttttggtggcagcagccacaggtgcccactcccaggtccagcttgtgcagtcgtggggctgaggtgaagaagccgtggggcctcgagtgtaacggtttccngcaaggtcttcaggactaccaccttcacgtaggtatgtctatactagttgggtgcgccgacggccccggaacaaggcttgaggtggagtgggatggatcgaacgcgtaggacagtaggtaaacaaacgtaaaaaattcaactaagtaacgttaccgaacgggacgaagtaacgttacctaaccgtttaaccgaacgggtaccaacacgtaccgacggaacggtatttaacgttaatagtaggagtccgtagtacgcgacgccgtagagaacgtacgaacgacgacgtctagttattgttttgacgtcgtaccgtagttagtggtacgtacgtatttacgttacgtcctacgtaagtttacgaccgttcccggtacgggtacccgtacggggtaacccgttccgggttacccacccgttccgtcccgtaacccg

SEQ ID NO: 260530 - DNA, 827 bp, Homo sapiens
  misc_feature: GYAE6OF01D5CX3.1.5.A05.1.454.CMB.1.raw
  modified_base (139)..(139): a, c, t, g, unknown or other
  misc_feature (139)..(139): n is a, c, g, or t
tcagacgagtgcgtcacgaccggtgctcgatttagatagatagacaggggacccaacaaccacactccctcctcagaacgcccccagagcacaaccgccccaccatggactggaccgtggaggatccttcgtttttggnggccagcagcccacgaggtcgcccaccgtcccgaggtccagtcgttgtacgcgtaggttcgtggggtcctaggaggtaggaaaggtacggtcccggtacggggaccttacgaggttacggttaacgggttttccacggacgtaaacggttccgttacgaaggtaccttaaccgtaccctttacgaacgttacgggtattcggtacgtaacgttacgtaggttcgggtaccgtcccggacccggaacccgggaccccgggaaagtaacggttacgttagggaacggttacgggtacgttacgggggagtacggtaacgtaccgaaccggcggtacggtaacgtaagttaaaccggtaaaactaaaacgtaaaacttcgaaacgtaaggtaaccggtacgaaggtaccgtaaggtacccgtaccttaccgttaacggacgtaccgacgtacggtaccgacggtaacgtaacttaacgttagtacgtaggacgtgacggtcgaagtccgagacgtaacgacgacgaacgcgtaggtctagtttacttagtttcgaccgtacgttcgtacgtaggttagtaccgttagttacgttacgtaccgttacgttaagttagtttacccggcgtacccgggttaccgtaaccggtaccgggttaccgtggttacccgtaccgtcccgtccgaaaccg

SEQ ID NO: 260531 - DNA, 845 bp, Homo sapiens
  misc_feature: GYAE6OF01CTM1E.1.5.A05.1.454.CMB.1.raw
  modified_base (219)..(219): a, c, t, g, unknown or other
  misc_feature (219)..(219): n is a, c, g, or t
  modified_base (270)..(270): a, c, t, g, unknown or other
  misc_feature (270)..(270): n is a, c, g, or t
  modified_base (286)..(286): a, c, t, g, unknown or other
  misc_feature (286)..(286): n is a, c, g, or t
tcagacgagtgcgtcacgaccggtgctcgatttagatagatagacaggggacccaacaaccacatccctcctcagaagccccagagcacaacgccccacatggactggacctggaggatcctcttttggtggcagcagccacaggtgcccactcccaggtccagcttgtgcagtctggggctgaggtgaagagccgtggggcctcagtgaaggtttccngcaaggtcttcgaggtatacaccgttcactaggtatgctatacattgggtncgctacggccccgganaaaggcgttgacgtggatgggatgggatcgaaccgcgtagggctaaagtgggttaaaaccaacgtaaaaaaacgtttcgaaacgtaacggaaacgtttacccgaaacggggtcctaaacggtaaacggttacccgaaccccgtttttaacccgaaacgggggtaccctaaaccgtaaccggtttccccggaccggtaaacgggtacttttaaaccgtttaacgttacttaacggggtagtacccgttaggaaccggtacctaacgggtaccccgttagggaacggtaaccgttacccgggaaaaggaacccgtaacgggtactttacgggtttaacgttaagtttttttcgggtacggtaacccggttaccgtttaccggttaaagggttcggggtaaccggttacggtaacttttaacgtttaacccgggactttacccgttaaaacgtttttccggaaccgtttcccgggttaccgggggtaaccccgtaacgggggttaaaaccccccgtttgggttaccccgttaaaccccggttccgtcccccgttaaccccgg

SEQ ID NO: 260532 - DNA, 684 bp, Homo sapiens
  misc_feature: GYAE6OF01DS0IE.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttcctgcaaggtcttcaggatacaccttcactaggtatgactatactagttgggtgccgccgacggacccccggaacgaaacggcgttggaggtggagtggggtagtggatacgaacgcgtggacaagtaggtaaacaacgtaaaaattcaacgaagtaacgttccgagggacagacgtacctaaccgtttaccgagggtacacgtacgtaccggacgaaggttacttaacgttaagtaagttagggagtacgtaggtacgacgtacgtccgtaggacgtaacgtaccggaaacgtaccgaacggtacttaggttatttacgttttagtacggtacgtaccgttacgttaggtacggtacgtacgttatttaacgttacgtacttacgttaacgtttagaccgttccggtacggggtacctaccggggtacccgttacggtacccgttacccgtccgttcccgtacccg

SEQ ID NO: 260533 - DNA, 708 bp, Homo sapiens
  misc_feature: GYAE6OF01CYGI9.1.5.A05.1.454.CMB.1.raw
  modified_base (125)..(125): a, c, t, g, unknown or other
  misc_feature (125)..(125): n is a, c, g, or t
  modified_base (132)..(132): a, c, t, g, unknown or other
  misc_feature (132)..(132): n is a, c, g, or t
  modified_base (261)..(261): a, c, t, g, unknown or other
  misc_feature (261)..(261): n is a, c, g, or t
tcagacgagtgcgtcacgaccggtgctcgatttagatagatagacagggacccaacaaccacatccctcctcagaacgcccccagagcacaacgccccaccatggactggacctggagatccttnttttggnggcagcagccacaggtcgcccactcccaggtccagtcttgtgcagtctggggctgaggtgaagacgccgtggggcctcaggtgtaaggttcctgacgtaacggcttacgaaggaacttaccaccctttnacgtaaggtactcgacttaatactaagttgggtcgaccgcccgaaccgggacccccggaagaaaagggtccgttaggaggttagggtagttagggaagtggtaacttaccgaaacggcgtacggataaagttaggaaaaccaagtaaaaaaacttcgaacgaacggtaaacgttaccgaagggtaccgaagtacgttaacctaacccgtttaaccgaacgggtaaccacgaaccgtaccggtaacgaagggtaactttaacgttaatacgtaagggcgtaaccgtagacgtacgaagcccgtagaacgacgtaccgaagtacgaacgtctagttattattttcgagtccgtactagtagtagagtctaattaactcgtactattagttacacggttccggacgggtccgaaacggtaccgtacgtaccgaccgtctcccgtaacccg

SEQ ID NO: 260534 - DNA, 754 bp, Homo sapiens
  misc_feature: GYAE6OF01CBV9S.1.5.A05.1.454.CMB.1.raw
  modified_base (175)..(175): a, c, t, g, unknown or other
  misc_feature (175)..(175): n is a, c, g, or t
  modified_base (228)..(228): a, c, t, g, unknown or other
  misc_feature (228)..(228): n is a, c, g, or t
  modified_base (259)..(259): a, c, t, g, unknown or other
  misc_feature (259)..(259): n is a, c, g, or t
tcagacgagtgcgtcacgaccggtgctcgatttagatagatagacaggggacccaacaaccacatccctcctcagaacgcccccagagcacaacgccccaccatggactggacctggagactccttcttttggtggcagcagccacaggtcgcccactcccaggtccagtcttgngcagtcgtggggctggaggtagaagacgccgtggggcctgagtggtagtttcngacgaggtccttagaggtactaccaccgttnaacgtaggtatcgtactatacgtagtttacggggcgccgaccgcccgggaccccggaagtaaacggtcgttaggaggtcggaaggtggggagtacgggactcgaaccggcgtacggactaaacgtaacggtaaaactaaaactaaaaacgttacaacgtaacgtaacgttcgaaggtacgagtactaccgtaccgttaaccgaacggtacacgtcgtacgagtaacggttacttacttaagtcgtagacgtacgtacggacgtacgagtacccgtaggaacgtaccggtaaccggtaacggaacccgtacggtacgtttagtttacttttacgggtttttacgccggtacccgttaccgttacggttaaggtcgggttacgttacttaaagttacgttaccgtacttacggtaacgttttacgacccggtttaccgggacggggtacccgtaacgggtaccccgttacgtacccgtcccgttccgccttacccgg

SEQ ID NO: 260535 - DNA, 802 bp, Homo sapiens
  misc_feature: GYAE6OF01AQN57.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtctggggctgaggtgaagagcctggggcctcagtgaaggtttcctgcaaggcttcgaggactacacctttcacgttaggtatgctatacagttgggtcgcgccacggaccccgaacgaaacggcttggagtggagtagggatggatacgaaccggtcgtggactaacgttacggtaaacaaaacgtaaaaaacgttccgaaacgtaacggtaaacgtttccgaacggggtaccaaggaacgtttacccgtaacccgttttaacccgaacgggggtaaccaacctaacggttacccggacggtaaagggttactttaaaccgtttaagtaacggttacggtaacgtcgttaggacgtacgaacggttcccgtaagggacgtaacgtacccggaaagaaccgacccgggttattacgtttaactttaaggttttttcggacggttacccgtaccgtttacggttaacggttagggttaacggttccgttaaagtttacgtttaacccggtcctttaaccgttaaacgtttttccgaacccggtttccggttaccggggaaccccgttaaccggggtaaccccgttccgggtacccttaaccccggttccgttacccccgttacccgg

SEQ ID NO: 260536 - DNA, 669 bp, Homo sapiens
  misc_feature: GYAE6OF01C7I4B.1.5.A05.1.454.CMB.1.raw
  modified_base (226)..(226): a, c, t, g, unknown or other
  misc_feature (226)..(226): n is a, c, g, or t
  modified_base (500)..(500): a, c, t, g, unknown or other
  misc_feature (500)..(500): n is a, c, g, or t
  modified_base (527)..(527): a, c, t, g, unknown or other
  misc_feature (527)..(527): n is a, c, g, or t
tcagacgagtgcgtcacgaccggtgctcgatttagatagatagacaggggacccaacaaccacatccctcctcagaacgcccccagagcacaacgccccaccatggactggacctggagatccttctttttggtggcagcagcccacaggtgcccactcccaggtccagcttgtgctagtctggggctgaggtgaagagccgtggggcctcagtgtaaggtttccngcaaggtcttacgaggtatacctaccttacgacttaggtatcgctaatactagttgggcgtccgacccgacggacccccggtaagaaacggtcttaggagtagggtagtacgggtagtggtaactcgaaaccgtcgtagggactaaagttacggtaaaaccaaactaaaaaaacgttcccgaaataacggtaacgttaccggaagggtaccagtacgtactaaccgttacgacggacacacgtaccggacgtagtattacttaatgtaggtacncgtagacgcagcctgacgactacgganaccgagtactgttaattgtttacggtagaccgttctcgtaggttacggtgtactagtttagtacgtactcgttaaagtttgaccgttcgggtaccgggaccgtacggtaacccgttcggtaccacccgttctaccgtacccg

SEQ ID NO: 260537 - DNA, 705 bp, Homo sapiens
  misc_feature: GYAE6OF01C7NP5.1.5.A05.1.454.CMB.1.raw
  modified_base (127)..(127): a, c, t, g, unknown or other
  misc_feature (127)..(127): n is a, c, g, or t
  modified_base (134)..(134): a, c, t, g, unknown or other
  misc_feature (134)..(134): n is a, c, g, or t
  modified_base (226)..(226): a, c, t, g, unknown or other
  misc_feature (226)..(226): n is a, c, g, or t
  modified_base (291)..(291): a, c, t, g, unknown or other
  misc_feature (291)..(291): n is a, c, g, or t
  modified_base (511)..(511): a, c, t, g, unknown or other
  misc_feature (511)..(511): n is a, c, g, or t
  modified_base (521)..(521): a, c, t, g, unknown or other
  misc_feature (521)..(521): n is a, c, g, or t
  modified_base (645)..(645): a, c, t, g, unknown or other
  misc_feature (645)..(645): n is a, c, g, or t
tcagacgagtgcgtcacgaccggtgctcgatttagatagatagacaggggacccaacaaccacatccctcctcagaacgcccccagagcacaaccgccccaccatggactggacctggagatccttnttttggnggcagcagccacaggtcgcccactcccaggtccagcttgtgcagtcgtgggctggaggtgaagagccgtggggcctgagtgtaaggtttccnggacgaggtcctagaggtactacctaccttcaacgtaggtatcgtactaactactaggttcgggnccggacccgaccgggaccccggaagtaaacggtccgttaggaggttgggaaggtggggtaacgtcggtaactaccgaacggtcgtaggaactaagtacgtaaaacaaacctaaaaatccgaaagtaacgtaacgtcggaacgggtacacgtacgttacctaaccgttaacggaacggtacacgtacgtaccgaacggtaagttaacgtttacttaggtanacggggtaanccgtaggacgacctaacgtcgttacgaagtaaccgtacggaacggtaccgtaggttatacgtttaatttttggtttcgcgtaaccgtccgttaggttaggcgttagtacttacgttagtacctntacggttattcggactcgggtacgaaccgtacggtccttacggccctacggctccgtacc

SEQ ID NO: 260538 - DNA, 939 bp, Homo sapiens
  misc_feature: GYAE6OF01CZJGR.1.5.A05.1.454.CMB.1.raw
  modified_base (234)..(234): a, c, t, g, unknown or other
  misc_feature (234)..(234): n is a, c, g, or t
  modified_base (273)..(273): a, c, t, g, unknown or other
  misc_feature (273)..(273): n is a, c, g, or t
tcagacgagtgcgtcacgaccggtgctcgatttagatagatagacagggacccaacaaccacatcccctcctcagaacgcccccagagcacaaccgccccaccatggactggacctggagatccttcttttggtggcagcagccacaggtcgcccactcccgaggtccagcttgtgcaggtcgtggggctggaggtacgaagacgccgtgggcctcgaggtggtaacgtttccngcaaggtctacgagactactacctttacgacgttaggtnttcggacttacttacgtaaggtttcggggtcgaccggaccccgaaccgggacccccgggtaaacgtaaacgggtcgttacgggaaggttacgggtaagggttacggggagtggtaacgtacccggaacgggtccgttaagggaccgtaaaacggttaacggtaaaaacccgtaaaacaaaaaaactttaccgaacgtaaacggtaacgttaacccggaacggggacctaaacggtacgttacgttaaacccgttttaaccgggacgggaaacctaaccgtaaccggtacccgggtaccggtaaagggttacttttaaaccgttagtttaggtacgggtaacggtcgtaaccggtacgtacgtaccggttaccggtacgaacggtaaccgtaaccggtaaaccggaacccggttaaccgggttcctttaacggttttacgtttttaacgtttttacggaaccgtttccccggggttaacctttacgggtttaacggggtttaaggggtttaactttttaacggttaaacccgttttaccgtaccgttttaaccgtttaaacgttttacggtacccgggtttccggggtacggggttaccccggtaaccggggttacccgtttacccgggaccttaccccggttcttaccccgtccgtaaacccccgg

SEQ ID NO: 260539 - DNA, 298 bp, Homo sapiens
  misc_feature: GYAE6OF01CIJ6B.1.5.A05.1.454.CMB.1.raw
  modified_base (269)..(270): a, c, t, g, unknown or other
  misc_feature (269)..(270): n is a, c, g, or t
  modified_base (272)..(298): a, c, t, g, unknown or other
  misc_feature (272)..(298): n is a, c, g, or t
tcagacgagtgcgtcacgaccggtgctcgatttagatagatagacaggggcagttccagatttcaactgctcatcagcagcctgcagtctgaagtatttttgctagttttattactgtcagcaagtataatactcggcctcgacgttcggaccaagggaccaaggtagaaatcaaaacgactgtggctgcaccatctgtcttcatcctcccgctatctgactcgtactgcgtcgtggacggcgggtctggacgtaacggcgacagtagnnannnnnnnnnnnnnnnnnnnnnnnnnnn

SEQ ID NO: 260540 - DNA, 735 bp, Homo sapiens
  misc_feature: GYAE6OF01CX04J.1.5.A05.1.454.CMB.1.raw
  modified_base (225)..(225): a, c, t, g, unknown or other
  misc_feature (225)..(225): n is a, c, g, or t
  modified_base (566)..(566): a, c, t, g, unknown or other
  misc_feature (566)..(566): n is a, c, g, or t
tcagacgagtgcgtcacgaccggtgctcgatttagatagatagacaggggacccaacaaccacatccctcctcagaacgcccccagagcacaacgccccaccatggactggacctggaggatcctcttttggtggcagcagccacaggtgcccactcccaggtccagcttgtgcagtctggggctgaggtgaagaagccgtggggcctcgagtgaacggtttccngacgaaggtcttcgaggtactaccaccttcacgtaggtatgtactatacagttgggtgccgccgacggccccggacaaacggcttgagtggagtgggatggatacgaacggtggactaagtacggtaaacaaactaaaaaacttcaactaagtaacgttccgaaggggacaaggacgttacctaacccgtttaacggaacgggaacctaccaacgtacccggacgtaaggtactttacgtaattagtagggaagtctaagggacgaccgtagaacccgtgaaggtccgtaaacccggagtaacccgtacggtcttaggtttaattttaggtttttaccggnggttaaccccgtacccgttaggttagtaacgggggttaccttagttaactttaacgttaccgccgtttaataacggttttcgacccgtttacccggtcgggggaaccccctaacggggtaccccgtcggttaacccgtaccccgttacctccccgttaactacccccgg

SEQ ID NO: 260541 - DNA, 737 bp, Homo sapiens
  misc_feature: GYAE6OF01BYZGT.1.5.A05.1.454.CMB.1.raw
  modified_base (231)..(231): a, c, t, g, unknown or other
  misc_feature (231)..(231): n is a, c, g, or t
  modified_base (534)..(534): a, c, t, g, unknown or other
  misc_feature (534)..(534): n is a, c, g, or t
tcagacgagtgcgtcacgaccggtgctcgatttagatagatagacaggggacccaacaaccacatccctcctcagaacgcccccagagcacaacgccccaccatggactggacctggaggatccttcttttggtgcagcagccacaggtgcccactcccgaggtccagcttgtgcagtcgtgggctggaggtagaagacgccgtggggcctacgagtaggtacggtttccngacgtaacggcttacgaaggactacctaccttcgagttaggtatacgactatacgtagttgggtcgccgaccgaccgggaccccgagaaggtctacggagtggacgtgggtagtcggtactacgaacgtcgtacggactaagtaacgaaactaaaactaaaaagttccaacgaacgtaacggtacggaggtaacgacgtaacgttaccttaacccgttaaccggacgggtaacctacgtaccggtaccggaacggtaacggttaactttaacgttaacgaagttgggaacgtcgacggtaacncgtaacgtccggtagaacggtaccgaaccggaacgtacccggtacgttcgttaggttactttgtttaacggtccggtaccgttacgtgttaagggtcgtacgttactagtttaccgttacaccgttaacgttggttacctaccggttacggaccgggtacctaccggggtccttacgttacccgccttccgtcccgtacccgg

SEQ ID NO: 260542 - DNA, 764 bp, Homo sapiens
  misc_feature: GYAE6OF01B319O.1.5.A05.1.454.CMB.1.raw
  modified_base (224)..(224): a, c, t, g, unknown or other
  misc_feature (224)..(224): n is a, c, g, or t
  modified_base (302)..(302): a, c, t, g, unknown or other
  misc_feature (302)..(302): n is a, c, g, or t
  modified_base (378)..(378): a, c, t, g, unknown or other
  misc_feature (378)..(378): n is a, c, g, or t
tcagacgagtgcgtcacgaccggtgctcgatttagatagatagacaggggacccaacaaccacatccctcctcagaacgcccccagagcacaacgccccaccatggactggacctggagatcctcttttggtggcagcagccacaggtgcccactcccaggtccagcttgtgcagtcgtggggctggaggtgaagagccgtggggcctcgagtgaaggtttccngcaaggcttcgaggtactacacctttcacgtaggtatgacttatacagtttgggtcgccgccgacgggaccccggaanaaaggtcttggaggtggagtgggattcggatcgaacgcgtggactaagtaggtaaacaaacgtaaaaattcgaaanaaggtaaacgttccgaagggacaaggacgttacctaacctttaaccgagggaccacgacgtaccggacggaaggtactttaacgttacgtagtacggggtaactcgttacggacgtaccgtagggtacccgttaggaacgtacgttaacccgggaaaggtaccggtaaacgggtcgtttaacggtttaacgttttaacgtttttccggtacgggtaacccggtttaaccccggttaggttaacggggttacgggttaacggttaccttaaaggttttacccgtaaccggttctttaacgttaaacgtttcgtaaaccggttccggtcgggggtaccctaaacgggtacccgttacggtacccgttacccgttccgttcctacccgg

SEQ ID NO: 260543 - DNA, 922 bp, Homo sapiens
  misc_feature: GYAE6OF01AUYU1.1.5.A05.1.454.CMB.1.raw
  modified_base (287)..(287): a, c, t, g, unknown or other
  misc_feature (287)..(287): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagtcttgtgcagtcgtggggctggaggtgaagagccgtggggcctcgaggtagtaaggtttcctagacgaaggtcttacgaggactacctaccttcactaggtatgctatactagttggggtnccgaccacgggaccccggaacgaacggtcgttggagtgggagtaggggagtggaactacgaacgtcgtaggactaagtacggtaaacaaactaaaaaacgtttacaacgtaaaggtaaccggttaccgaaaggggaccgaaggacgtttaaccctaacccgtttaaccggaacggggtaaccgaaccgtacggtacccggaacgggtaacgttactttaacgtttaagttagtacgggaacgtactagggtaacgaccgtaacggtacccggtacgaaggttaaccgttaacccggggaaaaccggtaccgggtaaaccgggttaccgttaggttttaaacgttttaacggttttttttaccgggaccggtttaacccggtaacccggtttacggtttaaacggggtttacgggtaaccgggtttactttaacggtttttaaaccggtttcccggtaaccgttttaaagggtttaaccgtttttaacccgggtaaccccggtttttcccgggggtaacccggggggttaaaccccccgggttaaaacccggggggtttaacccccggtttacggggttaaccccccgggtttaaccccccgttccccggtttaaccccccggttaaacccccggg

SEQ ID NO: 260544 - DNA, 705 bp, Homo sapiens
  misc_feature: GYAE6OF01CLNSG.1.5.A05.1.454.CMB.1.raw
  modified_base (134)..(134): a, c, t, g, unknown or other
  misc_feature (134)..(134): n is a, c, g, or t
  modified_base (152)..(152): a, c, t, g, unknown or other
  misc_feature (152)..(152): n is a, c, g, or t
  modified_base (190)..(190): a, c, t, g, unknown or other
  misc_feature (190)..(190): n is a, c, g, or t
  modified_base (211)..(211): a, c, t, g, unknown or other
  misc_feature (211)..(211): n is a, c, g, or t
  modified_base (322)..(322): a, c, t, g, unknown or other
  misc_feature (322)..(322): n is a, c, g, or t
  modified_base (343)..(343): a, c, t, g, unknown or other
  misc_feature (343)..(343): n is a, c, g, or t
tcagacgagtgcgtcacgaccggtgctcgatttagatagatagacaggggacccaacaaccacatccctcctcagaacgcccccagagcacaaccgccccaccatggactggacctggagatccttcttttggnggcagcagccacaggtcncccactcccaggtccagcttgtgcagtcgtggggctgnggtgaagacgctggggcctanagtggtaaggtttcctgacgaaggtcttacgaggacttacctaccttcacgttaggtatcgtactatactagttcgggtcgcgaccgacggaccccggaagaacggctggngtggagtcggagtgatcacgntcgatagtagaaacaactaaaatcaacgacgtaacgtacgaggcagagtacctaccgttacgacggaactacgacgtacccgaggtacgttaacgttactttacgtaaggttacggtaacgtcgttaggaaccgtcggaaccgtaccgtaggaaccgtacgaacccggaaacgtacgtacggtacttagttaacgttgttttacggacgtcccgttaccgtaggttaccggttaggtaccggttacgttaacttacgttaccgtaccttaacgttaacgtttaccggtacggttcccggtaccgggtaccggtaacgggttaccccggtcggttacccgtacccgttccgtccgttaaccgg

SEQ ID NO: 260545 - DNA, 760 bp, Homo sapiens
  misc_feature: GYAE6OF01AZRE5.1.5.A05.1.454.CMB.1.raw
  modified_base (212)..(212): a, c, t, g, unknown or other
  misc_feature (212)..(212): n is a, c, g, or t
  modified_base (222)..(222): a, c, t, g, unknown or other
  misc_feature (222)..(222): n is a, c, g, or t
tcagacgagtgcgtcacgaccggtgctcgatttagatagatagacaggggacccaacaaccacatcccctcctcagaacgccccccagagcacaacgcccccaccatggactggacctggaggatcctctttttggtggcagcagccacaggtcgcccactcccaggtccagcttgtgcagtctggggctgaggtgaagagccgtgggcctnagtgagttcngcagctcgagatcactcacgtaggtatgctatacattgggtgcgcccgacgggtcccccggaacgaaaacggtcgttacggaggtagggtaacggtggggtagtagggaactaccgaaccggaccgttgggacgaaagttacgggtaaaacctaaaaccaaaaaaacgtttacgaaacgtaaggtaaacggtttccgaagggacaaggtaacgtacctaaaccgtttaccgaacgggtaccaaccgaacgtccggacgtaacggtaacgtttacgttaagtaagtacgggtagcgttaggacgtcgacgtcccgtaggaacgtagacccggaaaggaccgtacggtacgttacgtttagtttagttttacggtacgtaccggttaccgttacgttaggtacgggtacggtacgttagtttaacttaccggttaccttacgttaagtttacggtacccggttccggtaccggggtaacccggtaaccgggttaccccgtacggttacccggttaacccgttcccgttcccgtaccccgg

SEQ ID NO: 260546 - DNA, 752 bp, Homo sapiens
  misc_feature: GYAE6OF01CFRQJ.1.5.A05.1.454.CMB.1.raw
  modified_base (193)..(193): a, c, t, g, unknown or other
  misc_feature (193)..(193): n is a, c, g, or t
  modified_base (233)..(233): a, c, t, g, unknown or other
  misc_feature (233)..(233): n is a, c, g, or t
  modified_base (273)..(273): a, c, t, g, unknown or other
  misc_feature (273)..(273): n is a, c, g, or t
tcagacgagtgcgtcacgaccggtgctcgatttagatagatagacaggggacccaacaaccacatcccctcctcagaacgcccccagagcacaaccgccccaccatggactggacctggagatcccttctttttggtggcagcagcccacgaggtcgcccactcccacggtccagcttgtgcagtcgtggggntggaggtagaagacgccgtgggcctgagtagtagtttccngacgtagcgttcaggtactacctaccttactacgttagtntacgtctaacttacgtaggtttaggggtacgcccggaacccggacccgggacccccgaacggtaaacggtcgttacgggaggtaggggtaggttaggggaacgttaggtacgtaaccgaaccgtccggtagggtacctaaaggtaacggtaaaacaaaacttaaaaacttacgaacgtaagtaacggtaccggacggtacgacggtaaccttaaccgtaaccgttaacgaacggacctaccgacgtacccggacggtaaggttaactttaacgttagttaaggtcggtacgtgtaacggacgaacacggtcccgtagaacgtaaccgtacgaaacggacccgtaggttactttagttattttgtttacgtcggtaccgttacgttacggtggttagtacgtattaacgttagtacgtctagttaacgttcgtacgttcgggtcgaccggtaccgtacctcgtactcccgtctcgtaccg

SEQ ID NO: 260547 - DNA, 183 bp, Homo sapiens; identical to SEQ ID NO: 260080
  misc_feature: GYAE6OF01AETFN.1.5.A05.1.454.CMB.1.raw
  modified_base (178)..(183): a, c, t, g, unknown or other
  misc_feature (178)..(183): n is a, c, g, or t

SEQ ID NO: 260548 - DNA, 269 bp, Homo sapiens
  misc_feature: GYAE6OF01BYUB3.1.5.A05.1.454.CMB.1.raw
  modified_base (182)..(182): a, c, t, g, unknown or other
  misc_feature (182)..(182): n is a, c, g, or t
  modified_base (252)..(252): a, c, t, g, unknown or other
  misc_feature (252)..(252): n is a, c, g, or t
  modified_base (259)..(269): a, c, t, g, unknown or other
  misc_feature (259)..(269): n is a, c, g, or t
tcagacgagtgcgtcacgaccggtgctcgatttagatagatagacaggggcagttccagatttcaactgctcatcagcagcctgcagtctagaacgtattttgctaattttatttctgtcagcagtacaatattggcctttgacgttcggaccaagggaccaaggtagaaactaacgactgnggctgcacatctgtcttcatccttcccgctatctgagagtgcgtctcgtgaggcgggctggccaaggccnaataggnnnnnnnnnnn

SEQ ID NO: 260549 - DNA, 694 bp, Homo sapiens
  misc_feature: GYAE6OF01AXJN5.1.5.A05.1.454.CMB.1.raw
  modified_base (270)..(270): a, c, t, g, unknown or other
  misc_feature (270)..(270): n is a, c, g, or t
tcagacgagtgcgtcacgaccggtgctcgatttagatagatagacaggggacccaacaaccacatccctcctcagaacgcccccagagcacaacgccccaccatggactggacctggaggatcctctttttggtggcagcagccacaggtgcccactcccaggtccagcttgtgcagtctggggctgaggtgaagaagcctggggcctcagtgaaggttcctgcaaggcttcaggatacgaccttcactaggtatgctatacattgggtncgccacggccccggaacaaaggcttgagtcggagtgggatggatcgaacgccgtaggaccaatgggtaaacaaactaaaaaattcaacaaggtaaacgttccaacggggtcaaggtacgtacaacctttaaccgacggggtacaacgactccggtacggaggtaacttacgttatagttagggacgtccgttaggagtacgaacgtacccgtggaacgtacgtacccggaaagaccgacgggtaccttaggttaactttagtttttggtacggtaccgtacttaccgtagggttcggtacggttactaacgtttacgtttaaccgacttcgttaaagtttacggtaccgttcccggtaccggggtacccgtaacggggtaaaccccgttgggtaacccttacccggttcccttccgttacccgg

SEQ ID NO: 260550 - DNA, 872 bp, Homo sapiens
  misc_feature: GYAE6OF01A87SQ.1.5.A05.1.454.CMB.1.raw
  modified_base (147)..(147): a, c, t, g, unknown or other
  misc_feature (147)..(147): n is a, c, g, or t
tcagacgagtgcgtcacgaccggtgctcgatttagatagatagacaggggacccaacaaccacatccctcctcagaacgcccccagagcacaacgccccaccatggactggacctggaggatccttcttttggtggcagcagccacnggtcgcccactccaggtccagcttgtgcagtctgggctggaggtgaagagccgtggggcctcgagtgtaacggtttcctaggacgtaggtcttacgacggtacttacctaccttctaacgttaggttactgtactagttacgtagttgggtacgccgacccgaccggaccccggaacaaggtccgtaggaggtcggtacgtagggattcggactaccggacgtacgtcggaacgtaacgtaacggtaacctaaaacgtaaaacttcgaaacgaacgttaacggttacggaacgtacgtacgtaaccgttacccgttaacccgttaacggaccggtaacgaccttaacggtcccggtaggttaacggttaacctttaacgttaagtaccggtaggtaccgtacgttcggaacgtttaccggaccgttacgtacggttaaccgaccgtaaccccgtaaggtacgtacccggtttaggttaacgtttttacgtttaccggttttacggtacccgtacccgggttaacttacccggttaagggttaccgggtaaccggttttcttaaaaccggtttttacgtaaccccgttaccggtttaaaccgttttacgggttaaccccggtcccggtttaccccggggttaccggggtaacccccgggttaacccggggtaacccctttccccgggttaacccctccccggttttaacccgtcccgggtaccccg

SEQ ID NO: 260551 - DNA, 810 bp, Homo sapiens
  misc_feature: GYAE6OF01E2S9A.1.5.A05.1.454.CMB.1.raw
  modified_base (180)..(180): a, c, t, g, unknown or other
  misc_feature (180)..(180): n is a, c, g, or t
  modified_base (231)..(231): a, c, t, g, unknown or other
  misc_feature (231)..(231): n is a, c, g, or t
  modified_base (256)..(256): a, c, t, g, unknown or other
  misc_feature (256)..(256): n is a, c, g, or t
tcagacgagtgcgtcacgaccggtgctcgatttagatagatagacaggggacccaacaaccacatccctccctcagaacgcccccaccgagcacaaccgccccacatggactggacctggaggatccttcgtttttggtggcagcagccacgaggtcgcccactcccaggtccagcttgngcagtcgtgggctgagtgaagacgccgtgggcctgaggtagtaggtttccngacaaggcttcgagactacaccttnacgtaggtatctacgtatactgttgggtcgcgccgaaccggcccggaaacaacggtctaggtacggtggacgtggggtatacggtactaccgaacggtaccgtagggaacctaagtaacggtaaaacaaaacctaaaaaactttcaaacgtaacgtaacggttaccggaaggacgtaaggtaccgtaaccttacccgttaacggaacggtaaccaacgtaaccgtaccggaacggtaaggttaactttaacgttaataaggtcggactacggtagaaccggtcaacgtaccgtaaggaacctaacggtaacccggaacggtaacccgacggtacctttaagtttaacgttttctttttacgggacccgggttaacgttacccgttagggtttaacgggtaggttaacgttaaccgttatttaaacggtcccggtaaagtttaccggtttaacgttttacggaccccggtttacgggaccgggtaacccggttaaacggggttaacccccgttacgggtacccgtttaacccccggtccgtccccgtaaacccgg

SEQ ID NO: 260552 - DNA, 793 bp, Homo sapiens
  misc_feature: GYAE6OF01AQHQL.1.5.A05.1.454.CMB.1.raw
  modified_base (230)..(230): a, c, t, g, unknown or other
  misc_feature (230)..(230): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtcgcccactcccaggtccagtcttgtcgcgagtcgtggggctagaggtgaagacgccgtggggcctcgagtgtaacgtttccngacaggtcttgaggtatacctccgttacacgtaggtatcgtactactacgtagttgggtacgcgtacccgaccgggtacccccggtaacgtaaaccggtcgtttaggacgtagggaacgtgggtagtggactcgaacgtcgtacggactagtacggtaaaacaacgtaaaaactcgaacgtaacggtaacgttacggaacgggtacgaacggtaccgttacgtaacccgtttaacgaacgggtacctaaccgtacgtacccggaacggtaacgttaacgtttaacgtttaagtacggttacgggacgtacggtaggaccgtactaacggtcctagggaaaccgttacggtaacccggtaaaggacccgtaacgggtccgtttaagttaacgtttttagtttccggtacggttaccccgtacggtttaccggttaggttccgggtaacgtttaacgtacttttaacgtaccggtacctttacgtaaacgttttccggaccggttccgggtacgggtccgaaaccggtcccgtttacggaccgtccccggttctacccgttcccg

SEQ ID NO: 260553 - DNA, 722 bp, Homo sapiens
  misc_feature: GYAE6OF01C5F7S.1.5.A05.1.454.CMB.1.raw
  modified_base (282)..(282): a, c, t, g, unknown or other
  misc_feature (282)..(282): n is a, c, g, or t
  modified_base (329)..(329): a, c, t, g, unknown or other
  misc_feature (329)..(329): n is a, c, g, or t
tcagacgagtgcgtcacgaccggtgctcgatttagatagatagacagggacccaacaaccacatccctcctcagaacgcccccagagcacaacgccccaccatggactggacctggagatccttcttttggtggcagcagccacaggtcgcccactcccaggtccagcttgtgcagtcgtggggctggaggtgaagacgccgtggggcctcagtgaaggtttcctgactaaggtcttacgaggactacaccttcaacgtaggtatgactatacagttgggtncgccgacggccccgagaaacggcttgagtggagtggatgatcaacgngtgacaagtaggtaaacaactaaaaattcaacgagtaacgttcgaggacagacgtactaaccttacgaaggaccacacgtccgacgaggtactttaactaagttagaggtagtacgtggacgtacgaacggtaccgtacgaacgtacggtaacccgaaacgaaccggtaaccggtacgttagttaacgttttaacgtttttacggtccggtaaccgtttaacccggttacgttaacgggttacgggttaacggttaaccgttaacgttttaacgtaacccggtttacctttaaccgtttaaacgtttacggtacccgtttcccggtacggggtaacccgtaaccgggtaaccccgttacggtacccgtaccccggtttcctcccgttaacccg

SEQ ID NO: 260554 - DNA, 793 bp, Homo sapiens
  misc_feature: GYAE6OF01DRRE9.1.5.A05.1.454.CMB.1.raw
  modified_base (210)..(210): a, c, t, g, unknown or other
  misc_feature (210)..(210): n is a, c, g, or t
  modified_base (289)..(289): a, c, t, g, unknown or other
  misc_feature (289)..(289): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtcgtggggctgaggtgaagagccgtggggcctnagtgaagtttcctgcaaggcttcgaggatactaccttcactaggtatgctatacagttggtgcgcgacggccccggaanaaaggctgaggtggagtgggatggatcgaacgcgtggacaagtacggtaaacaaacgtaaaaaattcaactaaggtaaacggttaccgaacgggacaaggtaagtaccgtaaacccgtttaaccgaacggggtaaccaacgtaacgttcccggacggtaaggtaactttaacgttaacgtaagttacgggaacgtacgtagtaacgaccgaacggtcccgtaaggaacgtaacgttacccggaaaggtaaccgaacgggttacttaagggtttaattttaacgttttttaggtaccgttacccggttaacccgtttaccggttaagggttacgggttaacgggttaccgttaaagttttaaaccgtttaaccgtaccgtttaaccgtttaaacgttttaccggtaacccggtttacccgggttcgggggtaaccccgtaaccgggggttaaaccccgttacgggttaccccttaaccccgggttccttaccccggttaccccgg

SEQ ID NO: 260555 - DNA, 823 bp, Homo sapiens
  misc_feature: GYAE6OF01EIBKG.1.5.A05.1.454.CMB.1.raw
tcagacgagtgcgtcacgaccggtgctcgatttagatagatagacaggggacccaacaaccacatccctcctcagaacgcccccagagcacaaccgccccaccatggactggacctggagatcctcttttggtggcagcagccacaggtgcccactcccaggtccagcttgtgcagtctggggctgaggtgaagagccgtgggcctcagtgaagttcctgacaaggcttcgaggactaccaccttcaacgttaggtatgactatactagttgggtgccgtccgaccggaccccggaacgaaacggtccgttagacggttaggacgtggggtagtgggtaactacgaacggtcgtacggacaatacggtaaacaaacgtaaaaaattcaacgaagtaacgttaccgagggactacgacgtaccgtaccgttaacgaacgggtacaccgtaacgtacccggaggtaacggtaactttaacgttaattaacggtagggtacgtaccgttaaggaacggacgtacgtacccggtagaaacggtaccgttaaccggaaacgtaccggaacggttaccgttagtttaagtttacgttttacggtacccggtaccgttaacccgtttagggttaacggttacgggttaacggttaacctttaaagttttaacccgttaaaccgttacccgtttaacgtttaaacggttttaccggttaacccggttcccgggtaacccggggttaaccccgggtaaccccggggtttaaacccggttccgggtttaccccggttaaccccggtttccccgtacccgttaaaccccccggg

SEQ ID NO: 260556 - DNA, 794 bp, Homo sapiens
  misc_feature: GYAE6OF01CBW55.1.5.A05.1.454.CMB.1.raw
  modified_base (349)..(349): a, c, t, g, unknown or other
  misc_feature (349)..(349): n is a, c, g, or t
  modified_base (450)..(450): a, c, t, g, unknown or other
  misc_feature (450)..(450): n is a, c, g, or t
tcagacgagtgcgtcacgaccggtgctcgatttagatagatagacaggggacccaacaaccacatccctcctcagaagcccccagagcacaaccgccccaccatggactggacctggagatcctctttttggtggcagcagccacaggtcgcccactcccaggtcccagcttgtgcagtctggggctggaggtgaagagccgtggggctcagtagaaggtttcctgacaaggcttacgaggactaccaccttacactaggtatggactatacgtagttgggtcgtaccgacccgacgggaccccggaaaaggtcgttagaggtaggagtagggagtaggatacgaacgngtacggactaacgtaggtaaacaaacgtaaaaacttccaacgtaagtaacggttaccgagggacaaggtaacgtacctaacccgtttaaccggacggtaanaccgtacgtaccggacggtaacggtaactttaactttaacgttaaggtacgggagtaccgtaaggtacgcgaacgtaccgtacggaagtaacgtaacccggaaacgtaccgaacggtaccgtttaggtttaatttaggttttttacgggtcggtacccgtttaaccttacgggtttagggttacgggtaacggtttaccgttaacgtttagtttaccggttaccgttactttaacggtttaccgttaacggtccccgggtttacgggggtacccccggtaacgggttaaccccgttcgggttaacccccgttacccggtccctttacccgtacccgtaacccgg

SEQ ID NO: 260557 - DNA, 727 bp, Homo sapiens
  misc_feature: GYAE6OF01CPEG9.1.5.A05.1.454.CMB.1.raw
  modified_base (134)..(134): a, c, t, g, unknown or other
  misc_feature (134)..(134): n is a, c, g, or t
  modified_base (499)..(499): a, c, t, g, unknown or other
  misc_feature (499)..(499): n is a, c, g, or t
tcagacgagtgcgtcacgaccggtgctcgatttagatagatagacaggggacccaacaaccacatccctcctcagaacgcccccagagcacaaccgccccaccatggactggacctggagatccttcttttggnggcagcagccagaggtcgcccactcccgaggtccagctgtgcagtcgtgggctggaggtgaagacgccgtgggcctcgaggtgtaacggtttccgacgaaggtcttcgaggtactaccaccttacacgtaggtactgtactatactagttcggtcgccgaccgaccggtaccccggaagaaacggtcttggaggtacggagtaggagtggactacgacgtcgtagactaacgtacggtaaacaaactaaaaacttacgaacgtaacggtaacgttacgaagggactaaggtacgtaaccgtaacccgttacggaacggtaccacgtacgtccggaacgtagttacttaacgttaatagtaggacncgtagacgtacacggtcctagtacgactaccggaacaccgtacggtactaaggtttagtttaacgttttcgtacggtacccgttacgttacgttagggttacggtagttacgttaacttttacgtaccgtatttaaccgttacgtttaccgtaccggttccggtaaccggggtaccgtaaccgggtccccggttacggaccccttacggttccctacccggtaacccg

SEQ ID NO: 260558 - DNA, 182 bp, Homo sapiens; identical to SEQ ID NO: 260191
  misc_feature: GYAE6OF01AYKAD.1.5.A05.1.454.CMB.1.raw
  modified_base (179)..(182): a, c, t, g, unknown or other
  misc_feature (179)..(182): n is a, c, g, or t

SEQ ID NO: 260559 - DNA, 720 bp, Homo sapiens
  misc_feature: GYAE6OF01AR84L.1.5.A05.1.454.CMB.1.raw
  modified_base (228)..(228): a, c, t, g, unknown or other
  misc_feature (228)..(228): n is a, c, g, or t
tcagacgagtgcgtcacgaccggtgctcgatttagatagatagacagggacccaacaaccacatccctcctcagaagcccccagagcacaaccgccccaccatggactggacctggaggatccttctttttggtggcagcagccacaggtcgcccactcccaggtccagcttgtgcagtcgtggggctgaggtagaagagccgtggggcctcaggtgtaaggtttccngacgaaggtcttcaggactactaccttcactaggtatgctatagtagttgggtcgccgccgaccggaccccggaacgaaacggcgttggagtggaggtgggataggacgcgaacggtcgtacggactaaacgtacggtaaacaaactaaaaacttcaacgtaacggtaacgtaccggagggtaccgaagtacgttacctaccgtttaaccgacgggacctacgacgtaccggacggtacgtaacgtttactttagtacgtaggtacacgtagacgtacgacgtcgtagacgtacgtaccgaacggaccgtacgtacgttagtttaacgttttagttttacggtcgtacccgttacgttacgttaggttacggtaggtttacctagtttacgttaccgtacgttacgtttaacgtttaccggaaccggtttcccggtacgggtacccgtaacggggtaccccgttcggtaccctaccggtcccttccgtaccg

SEQ ID NO: 260560 - DNA, 700 bp, Homo sapiens
  misc_feature: GYAE6OF01CM0IM.1.5.A05.1.454.CMB.1.raw
  modified_base (138)..(138): a, c, t, g, unknown or other
  misc_feature (138)..(138): n is a, c, g, or t
  modified_base (229)..(229): a, c, t, g, unknown or other
  misc_feature (229)..(229): n is a, c, g, or t
  modified_base (554)..(554): a, c, t, g, unknown or other
  misc_feature (554)..(554): n is a, c, g, or t
tcagacgagtgcgtcacgaccggtgctcgatttagatagatagacaggggacccaacaaccacatccctcctcagaacgcccccagagcacaaccgccccaccatggactggacctggaggattccttcgtttttggnggcagcagccacaggtcgcccactcccaggtccagcttgtgcagtcgtgggctgaggtgaagacgccgtgggcctcgagtgtaggtttccngacgtaggcttacgaggtactaccgacctttcacgtaaggttactgtcttaatacgtagtttgggcgccgcgaccgggaccccggaagaacggtcttaggagtggtagtaggagtggactacgacgcgtgacaagtagtaaacaaactaaaagtacaacgtaacgtaacgtaccgaagggacaagtacgtaccgtaaccgttaaccggaacggtaccaacgtacgtaccggacgtaagttaacttaacgtttaagtaggttaggaccgtagtacgaggacgtacgtacgtacggacgtaaccgtaccggaacgtccgtaacggtnttacgttaattttgttttacgcgtaccgttaaccgtgttaggtagggtacgtattattaccgtacgtacgtactacgtttacggacgttccggtacgggaccgttaccgggaccgttccgacgttaccccgtccgttaccgtcccg

SEQ ID NO: 260561 - DNA, 928 bp, Homo sapiens
  misc_feature: GYAE6OF01DA6WJ.1.5.A05.1.454.CMB.1.raw
  modified_base (229)..(229): a, c, t, g, unknown or other
  misc_feature (229)..(229): n is a, c, g, or t
tcagacgagtgcgtcacgaccggtgctcgatttagatagatagacaggggacccaacaaaccacatcccctcctcagaacgcccccagagcacaaccgccccaccatggactggacctggaggatccttcttttggtggcagcagccacaggtgcccactcccaggtccagcttgtgcagtcgtggggctggaggtgaagaagcctggggcctcagtgtaaggtttccngacgaaggccttacgaggaacttaccacctttcaacttagggtatcgtacttaactacgtagttgggtacgtccggacccgaccggtaccccgggaacgaaacgggcgtttaggaggtcgggtaagtgggtacgtgggactacgaacggtcgtacggacgtaaacgttacgggtaaaacctaaaacgtaaaaaaaacttaccgtaaacgtaaaccggttaaacggtttaccccgaaacggggtaacgaaacgggtaaccgtttaaccgttaaaccccgttttaaacccggaaccggggtaaaccgaacccgttaaccgttacccccgggttaaaccggtaacgggttaaacttttaacccggtttaaagttacggttaacggggtaacggtcggtttaacggtaaccggaaccgggtaaacggtacccggttacgggaacggtaaaccggttaaccggtaaaaggtacccggtaacgggacgttttaaggttaacgttttttacgttttagggttaccggtaccgttaacccgttcgttaacgggttcggttacggttaaccgtttaagtttacggttaaccgttacttaacgttaaaccgtttcgaacccgggtttcggtacccggggggtaccgtaaacccggggttaaccccgttacgggttaccccgtaaccccgtcccgtttcccgtaacccgg

SEQ ID NO: 260562 - DNA, 703 bp, Homo sapiens
  misc_feature: GYAE6OF01DKCM0.1.5.A05.1.454.CMB.1.raw
  modified_base (135)..(135): a, c, t, g, unknown or other
  misc_feature (135)..(135): n is a, c, g, or t
  modified_base (233)..(233): a, c, t, g, unknown or other
  misc_feature (233)..(233): n is a, c, g, or t
tcagacgagtgcgtcacgaccggtgctcgatttagatagatagacaggggaccaacaaccacatccctcctacagaacgcccccagagcacaaccgccccacatggactggacctggagatccttcgtttttggnggcagcagccacaggtcgcccactccccaggtccagtcttgtgcagtcgtggggctggaggtgaaagacgccgtggggcctcaggtgtaaggtttccngcgaggccttagagactacctacgttcaagtggtatgactaatactacgttgggcgccgaccgaaccgggaccccggaagaaacggtccgttaggacggttaggaggttaggggaatcggactaccgaacggcgtggactaaagtacggtaaaacaaactaaaaacttcaactaaggtaacgtccgaaggaccaaggaccgtactaacccgttaccgaagggacctaacgtacgtaccggacggtaacgtacgttaacttaacgtacggtacgggtacgtacgtaggaccgacggtaacgtcctagggtaacgtaccgtaacggacgtacccgacggtcttacgttacgtttagtttcgacgtccggtacctgttacgtcggtacgtacgtacttacgtctaccgtacttacggttcgaccggttcgacgggtacaccgggttaccgtaggtccctacggtctccgtacc

SEQ ID NO: 260563 - DNA, 696 bp, Homo sapiens
  misc_feature: GYAE6OF01BU6FK.1.5.A05.1.454.CMB.1.raw
  modified_base (481)..(481): a, c, t, g, unknown or other
  misc_feature (481)..(481): n is a, c, g, or t
  modified_base (515)..(515): a, c, t, g, unknown or other
  misc_feature (515)..(515): n is a, c, g, or t
  modified_base (687)..(687): a, c, t, g, unknown or other
  misc_feature (687)..(687): n is a, c, g, or t
tcagacgagtgcgtcacgaccggtgctcgatttagatagatagacaggggacccaacaatcacatccctcctcagaacgcccccagagcacaaccgccccaccatggactggacctggaggattccttctttttgggtggcagcagcccacgaggtcgccccactccccaggtccagtcttgtgcagtcgtggggctggaggtgaagacgccgtggggcctcagtgtacgtttctggcaaggcttcgaggataccacttcacgtaggtatgactatactagttggtgtcggccaccgggccccggaacaacggtctaggtacgtaggagttgggagtggactacgaacgtcgtacggactaaagtacggtaaaacaaacgtaaaaattcgaaacgaaggtaacgtaccgaagggacgtaagacgtacctaccgtttaacgaacggacaacgacgtcgacgtacgtactttaatacgttagnggtagtacgtagacgacgtacggacctagggtanaacgtaccggaaagtaacccggaggtactttaggtaacgttttagtttggtaccgttccggtaccttaggttacggtaggttaacgtcttaaggtttacttaccgtcttaagttaactttcggaccgttccggtacggacccgtaacggtacccgtcgttacccgtcccgtnttaccccgg

SEQ ID NO: 260564 - DNA, 762 bp, Homo sapiens
  misc_feature: GYAE6OF01AODGH.1.5.A05.1.454.CMB.1.raw
  modified_base (192)..(192): a, c, t, g, unknown or other
  misc_feature (192)..(192): n is a, c, g, or t
  modified_base (634)..(634): a, c, t, g, unknown or other
  misc_feature (634)..(634): n is a, c, g, or t
tcagacgagtgcgtcacgaccggtgctcgatttagatagatagacgaggggacccaacaaccacactccctcctacagaacgccccacgagcacaaccgccccaccatggactggaccgtgggaggacgttccttcgtttttgggtggcagcacgccacaggtcgcccactcccgaggtccagtcttgtgcngtcgtggggctggaggtgaagacgtccggtggggcctcgtagtaggttaacggtttcctgacgacggtctttcgaggtactaacctccttacgtacgtagtagtcgtacttacgtaacgtggttgggtcggtaccggaccgacccggggacccggaacgtaaacggtcgtacggtaggtaggagtacgggagtacggtactaccgaacggtcggtacggacgtaaagttaacgggtaaaacctaaaacgttaaaaacgttacaaaaccggtacggttaaaccggttaccgacggggttaacccgaaacggaccgtttaaccccgtaaccggtttaaccgggaacgggtaaccacgtaaccgtaccgggacggttaacgtttaattaccgttagtacggttagacgtacgtacggagcctacgctacggactacgacggtacncggacttagtagttattgtttacgcggtactacttggtagtacgtagtctaattgtacctacgttcgtaacgttcgcgttaccgggctaccggttacggccttacgcccgtaacgttcttaccggacc

SEQ ID NO: 260565 - DNA, 760 bp, Homo sapiens
  misc_feature: GYAE6OF01A8WSZ.1.5.A05.1.454.CMB.1.raw
  modified_base (145)..(145): a, c, t, g, unknown or other
  misc_feature (145)..(145): n is a, c, g, or t
  modified_base (233)..(233): a, c, t, g, unknown or other
  misc_feature (233)..(233): n is a, c, g, or t
tcagacgagtgcgtcacgaccggtgctcgatttagatagatagacaggggaccaacaaccacatccctcctcagaacgccccagagcacaacgccccaccatggactggacctggaggatccttcttttggtggcaggcagccanaggtcgcccactcccgaggtccagtcttgtgcagtcgtggggctaggaggtagaagacgccgtggggcctgagtgtaacggttttccngacgtaaggtcttcgaaggtactaaccgtacctttcgaacgttaggttctagtacctattaacgtaggtttggggtacgccggaccgaccggggaccccggaacgtaaacgggtccgttaggtacggtagggaagttgggggaacgttacgggtacgtaccgtaacggccggtggaaacgtaagttaacggtaaaactaaaaccttaaaaaacgtttcgaaacgttaggtaaaccgtaccggaacggtaactagaacgtttacctaaccgttaacggacgtaacacgtacaccggtacgaagtaactttacgtagtagtacggtacgacgtcgaagtcgtacgcgttaacgtagaaccggtcgtaaagaccgtacgtattacgtttagttttacgtttcggccgttaccgtacgttggtaaggtgggtacttacggttaattcggtaacgttacttacggttacgttacaccggttgggaccggtaccgtaacgtaccggtcgttacgtaccgtccctagtacccgg

SEQ ID NO: 260566 - DNA, 1031 bp, Homo sapiens
  misc_feature: GYAE6OF01CZKVP.1.5.A05.1.454.CMB.1.raw
  modified_base (133)..(133): a, c, t, g, unknown or other
  misc_feature (133)..(133): n is a, c, g, or t
  modified_base (187)..(187): a, c, t, g, unknown or other
  misc_feature (187)..(187): n is a, c, g, or t
tcagacgagtgcgtcacgaccggtgctcgatttagatagatagacagggacccaacaaccacatccctcctcagaacgccccagagcacaaccgccccaccatggactggacctggagatccttcgttttggnggacagcagccacaggtcgaccctactcccaggtccagtcttgtgcgtagtcgnggggtctaggaggtagaagaacgtccgtggggcctagtaggtacgtaacgggtttccagtacgaacggtctttacgacggtaactaacctaaccgtttacgaacgttaacgggttacttacggtaacctttaaacgttaacgtttaacggtttacgggggttaacggtaccccggtaacccggtaacccggggaacccccccgggtaaaaggtaaaaccggggttaccgttttaccggggtaaggggtttaccgggtaagggttacgggggttaacgttacgggtaacgttaaccggtaacggtaccggtacggtaaacgtaaaacggtttaaaccgggttaaaaaccttaaaaaccgttaaaaaaaacgttaccgtaaacggttaaaacggttaaccggtttaaccggaaacgggggtaactaaacgggtttaacccggtttaaaccccgttaaacccgttttaaaccgggaaccggggttaaccaaccggtaacccggtaacgggtaccgttaaacgttaacgtttaacggttaacgtttaacgggacgggtacgtacgtaacggtacgtaccgtaaacgttacccggtaacgtacgtaaccgtaaccgaaaccggtaacggttacccggaagtttaccgttaagtttttacgtttaacggttaccgtacccgtttaacgtaccggtttaagggtaacgggttacgttacctttaaaggtttaccgtaaccgttagttaaccgttaacggttacgtacccggtttaccgggaccggtaacgggttaaaccggtaccccgggttagttaaccccgtacccggttaccgttccggtaaaccccg

SEQ ID NO: 260567 - DNA, 877 bp, Homo sapiens
  misc_feature: GYAE6OF01CFHZ5.1.5.A05.1.454.CMB.1.raw
tcagacgagtgcgtcacgaccggtgctcgatttagatagatagacaggggacccaacaaccacatcccctcctcagaagcccccagagcacaacgccccaccatggactggacctggaggatcctcttttggtggcagcagccacaggtgcccactcccaggtccagcttgtgcagtctggggctgaggtgaagaagccgtggggcctcgaggtgaaggtttcctgcaaggtcttcgaggtactaccaccttcactaggtatgactatacagttgggtcgcgccgacggcccccggaacgaaaggtccttaggacggtggtagtggggattcggagtacgaaccggtcgtacggacgtaaagttaacgggtaaaactaaaaccgtaaaaaaacgtttacccaacgtaaacggtaaacggtttacccgaagggtaccgaaggaaccgtttaacctaacccgttttaaccgaacggggtaccctaaaccgtacggtacccggaacggtaacgggttaacgtttaacccgtttaagtttaaacggttacgggtaacgggtacgttaccgggtaacggtaaccgtaacgggtcccgttaacgggaacggtaaccgttaacccgggaaacgaacccggtacgggtcccgtttaaggtttacgttttaacgtttttttcggaccggttaaccccggttaacccgtttacggtttaacgggttacgggtaacggtttacctaaaggttttactttacccggtacctttaacgttaaacgtttttacggaacccggtttccgggtaccggggtaaccccgtacccggggttaaccccgttaccgggtaccccgttaccccggttccgttaccccgttaaccccgg

SEQ ID NO: 260568 - DNA, 566 bp, Homo sapiens
  misc_feature: GYAE6OF01COMGR.1.5.A05.1.454.CMB.1.raw
  modified_base (267)..(267): a, c, t, g, unknown or other
  misc_feature (267)..(267): n is a, c, g, or t
  modified_base (381)..(381): a, c, t, g, unknown or other
  misc_feature (381)..(381): n is a, c, g, or t
  modified_base (407)..(407): a, c, t, g, unknown or other
  misc_feature (407)..(407): n is a, c, g, or t
  modified_base (494)..(494): a, c, t, g, unknown or other
  misc_feature (494)..(494): n is a, c, g, or t
tcagacgagtgcgtcacgaccggtgctcgatttagatagatagacaggggacccaacaaccacatccctcctcagaagcccccagagcacaacgccccaccatggactggacctggagatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtncgccaggccccggacaaaggctttgacgtggatgggatggattcaacgctggcaatggtaaacacaaaaaattcacaagaacgttcagggtcagagtcaccttaccagggacanatccgacgacgattacttatatgganctgagcagcctgagaactccgaagacgacgctagtattaattttgtcgtacgtaccttcgtagtagggagtcgtaattataaccgtntacgtaatttacgacttccgtacgggtacctacgggtacccgtacggtacctacccggttctcccgtacccg

SEQ ID NO: 260569 - DNA, 604 bp, Homo sapiens
  misc_feature: GYAE6OF01DT286.1.5.A05.1.454.CMB.1.raw
  modified_base (225)..(225): a, c, t, g, unknown or other
  misc_feature (225)..(225): n is a, c, g, or t
  modified_base (248)..(248): a, c, t, g, unknown or other
  misc_feature (248)..(248): n is a, c, g, or t
  modified_base (272)..(272): a, c, t, g, unknown or other
  misc_feature (272)..(272): n is a, c, g, or t
  modified_base (285)..(285): a, c, t, g, unknown or other
  misc_feature (285)..(285): n is a, c, g, or t
  modified_base (480)..(480): a, c, t, g, unknown or other
  misc_feature (480)..(480): n is a, c, g, or t
  modified_base (525)..(525): a, c, t, g, unknown or other
  misc_feature (525)..(525): n is a, c, g, or t
tcagacgagtgcgtcacgaccggtgctcgatttagatagatagacaggggacccaacaaccacatccctcctcagaagcccccagagcacaacgccccaccatggactggacctggacggacttccttctttttggtggcagcagccacaggtcgcccactccccaggtccagcttgtgcagtctggggctgaggtgaagagcctggggcctcagtgagtttccngcaaggcttcaggatacaccttnactaggtatgctatacattgggtncgccacgcccganaagcttgagtgagtggatggactcgaacgctggacaataggtaaacaacaaaaattcaacaagagttaccgagggacaggtacgtacctacctttaccgaacgggacacgacgtccgacggaaggtattaacgttatagtaggcacgttgaggacaacggcctagacgaacgtaccgaagtacacggactagttnttaaagtttttggagtccggtaccttacgtacgttggtacggttntaagtttactacgtcttactaagtttcacgttccgacggggtaccacgggtaccctgtacccgccgttccctctacccg

SEQ ID NO: 260570 - DNA, 792 bp, Homo sapiens
  misc_feature: GYAE6OF01AJ2HB.1.5.A05.1.454.CMB.1.raw
  modified_base (138)..(138): a, c, t, g, unknown or other
  misc_feature (138)..(138): n is a, c, g, or t
  modified_base (153)..(153): a, c, t, g, unknown or other
  misc_feature (153)..(153): n is a, c, g, or t
  modified_base (263)..(263): a, c, t, g, unknown or other
  misc_feature (263)..(263): n is a, c, g, or t
  modified_base (540)..(540): a, c, t, g, unknown or other
  misc_feature (540)..(540): n is a, c, g, or t
  modified_base (638)..(638): a, c, t, g, unknown or other
  misc_feature (638)..(638): n is a, c, g, or t
  modified_base (769)..(769): a, c, t, g, unknown or other
  misc_feature (769)..(769): n is a, c, g, or t
tcagacgagtgcgtcacgaccggtgctcgatttagatagatagacaggggacccaacaaccacatccctcctcagaacgcccccagagcacaaccgccccaccatggactggacctgggagactccttcgtttttggnggcagcacgccacgnggtcgcccctactccccgagggtccagtcttgtcgcgtaggtcgtggggcttggaggtaggaaacgacggcccgttgggggccctagtaggtacggttaacgttttccgngacgtaacggtcttacgaggtactacctccttccgaagttaggttactgtactacgtactaggttcgggtcgcccggtaccggacccgggtaccccggtaagtaaccgggtcgttagggtaggtagggtaggtgggtaacgtgggtacctacggaaccggtggtacggaacgtaaggtaaccgttaaacaaaacgttaaacgtactaacggaacggttaacgtacgacgggactacggacgttaccctaaccgtttacgaacggtactacggtaccnccggtacgtacgtacttagtacgtacgtgacgcgtaggactcgtacgccgtagaacggtcgtaaccgacgtccgaacgggttctacggtttaacgttnttttccgggtacgtccgttacggttcggtggttacggtatacggtttacgtacgttacctacgttcgttacgggttacgtcccggtcgggttaacccggggtcgaaaccccgggttcgtaccggttacccnccggttcccgtcccgtaaccccg

SEQ ID NO: 260571 - DNA, 697 bp, Homo sapiens
  misc_feature: GYAE6OF01DM76Z.1.5.A05.1.454.CMB.1.raw
  modified_base (134)..(134): a, c, t, g, unknown or other
  misc_feature (134)..(134): n is a, c, g, or t
tcagacgagtgcgtcacgaccggtgctcgatttagatagatagacaggggacccaacaaccacatccctcctcagaacgcccccagagcaacaaccgccccaccatggactggacctggagatcctcttttggnggcagcagccacaggtgcccactccccaggtccagtcttgtgcagtcgtggggctgaggtgaagaagcctggggcctcgagtcgaaggtttcctgaccgaaggtcttacgaggactacgtccttacacgtaggtatgactatacagttgggtgccgccgacggccccggtaacaaacggtctaggagtggtacgtagggagtggatccgaacgtcgtggactaagtacgtaaacaaacgtaaaaaactcgaacgaacggtaagttaccgaacgggtacaggtacgtactaaccgttacgaaggtacacgactccgacgagtactacgttatagtagagactgacgtcgaacgtcgtacgacgtaacgaccggtaaacggacgtaacggtactagggtttaactttagttttacggtacggttaccgtaccgttacgttaggtacgggttcgtaagttaccgtttacgtacgtccgttaagttaacctttagtccgtacgggtccgggtaaccgtaacggttaccccggttaaggtacccgttaccggtcctcccggtaacccg

SEQ ID NO: 260572 - DNA, 652 bp, Homo sapiens
  misc_feature: GYAE6OF01CRJEJ.1.5.A05.1.454.CMB.1.raw
  modified_base (295)..(295): a, c, t, g, unknown or other
  misc_feature (295)..(295): n is a, c, g, or t
  modified_base (310)..(310): a, c, t, g, unknown or other
  misc_feature (310)..(310): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctggaggtgaagaagccgtggggcctcagtgaaggtttcctgcaaggcttcgaggataccgtaccttcacgtaggtatgactatactagttgggtgcgccgacggccccgganaacggcttgagtggngtggagtggatcaacgctaggacagtagtaaacaactaaaaatcaacagtaacgttaccgagggcagactacctaaccttaccgagggaccacacgtccgacgaggtacttacgttaatagtaggtagcgtaggacgacgacgccgtagaacggtacgtaaccgaagaccgacgggtcttaaggttatttagtttttaggaccggtaccgtaccttacgttacgggttcggtacgttacttagttacgttaccgtcttaacgttacttacggtcgttacccggttggggtacccctaacggggtacccttacggtcccgtaacccgttcctcccgtaccccg

SEQ ID NO: 260573 - DNA, 635 bp, Homo sapiens
  misc_feature: GYAE6OF01AO5JK.1.5.A05.1.454.CMB.1.raw
  modified_base (146)..(146): a, c, t, g, unknown or other
  misc_feature (146)..(146): n is a, c, g, or t
  modified_base (210)..(210): a, c, t, g, unknown or other
  misc_feature (210)..(210): n is a, c, g, or t
  modified_base (273)..(273): a, c, t, g, unknown or other
  misc_feature (273)..(273): n is a, c, g, or t
  modified_base (356)..(356): a, c, t, g, unknown or other
  misc_feature (356)..(356): n is a, c, g, or t
  modified_base (404)..(404): a, c, t, g, unknown or other
  misc_feature (404)..(404): n is a, c, g, or t
  modified_base (568)..(568): a, c, t, g, unknown or other
  misc_feature (568)..(568): n is a, c, g, or t
tcagacgagtgcgtcacgaccggtgctcgatttagatagatagacaggggacccaacaaccacatccctcctcagaacgcccccagagcacaacgccccaccatggactggacctggaggatccttcttttggtggcagcagccanaggtcgcccactcccaggtccagtcttgtgcagtcgtgggctgaggtagagacgcgtgggcctnagtgagttctgcgaggtctcgagactacctaccttcactaggtatgtactatactgttggtcncgaccgacggcccgagaacggtcgttacgagtcggagtggagtggactacgacgcgaggtctaagtaggtaaacaacaaattnaacgagtaacgtcgaacggcgaagacgtcaacttacgaacggacgacncgtacgcgagtacttacttatacgtgggaactgagtacgacacgcgagtacgacgtaccgtaacgaccgtcggtacttaggttctttaagttttccggtcggaccgttaacgttggttacgtagggtacttacgttagttactttacgaccttctaacggtttnacccgttcgggaccggtaccgtaaccgggtaccttacggtacccgtcccgttccgttccgtaccccg

SEQ ID NO: 260574 - DNA, 750 bp, Homo sapiens
  misc_feature: GYAE6OF01BMTLG.1.5.A05.1.454.CMB.1.raw
  modified_base (221)..(221): a, c, t, g, unknown or other
  misc_feature (221)..(221): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttgtggcagcagccacaggtgcccactcccaggtccagcttgtgcagtcgtggggctgaggtgaagagccgtggggcctcgagtgaggtttccngcaggcttagaggatacacctacactaggtatgctatacgtacgttggggtcgccggccgaaccgggacccccggtaagaaacgggtccgtttaggacggttaggagtaggggacgttagggaacgttccgaacggccgtagggactaaagttacggtaaaacaaacgtaaaaacttacaaccgaggtaaacgtccgaaggggcaaggtacgtaccgtaaccgtttaccgaagggacctaactacgtaccgaccggtaagttacgtttaacgttacggttaggaacggggtactagtacgggactacggaacgttcccgtaaggaggtacccgttaaccggaacgaacgtaccgggtactagtttagttttacgttttacggcggtaccgtttaaccgttcgtaaggttggtacggttctaagttaccttaccggtacttacgtaagttttacggtacccgttcgggacgggacccgtaaaccgggtcccggttaccggtacccttccggttaccccgtcgtaaccccg

SEQ ID NO: 260575 - DNA, 913 bp, Homo sapiens
  misc_feature: GYAE6OF01CAXI8.1.5.A05.1.454.CMB.1.raw
  modified_base (133)..(133): a, c, t, g, unknown or other
  misc_feature (133)..(133): n is a, c, g, or t
tcagacgagtgcgtcacgaccggtgctcgatttagatagatagacaggggacccaacaaccacatcccctcctcagaacgcccccagagcacaaccgccccacatggactggacctggagatcctcttttggnggcagcagccacgaggtcgcccactcccaaggtcccagcttgtgcagtcgtggggctggaaggtgaaagaaggcccgtggggccctgaggtagtaaacgggttttcccagacgaaagggtcctttacgaaggaacttaccaacccttttacgaaccgttaaagggttattcggaccttaagttaaccgtaaggtttacgggggttacggtacccgaccggtaacccggggaccccccggaaacgtaaaaaaccgggtcgtttagggaaccgggtttacggggaacggtttagggggaacgttaagggtaacgttaacccggaaaccggtccgttacgggaaccgtaaaagttaacgggtaaaacctaaaaacgtaaaaaaaactttaccgaaaccgtaaacggtaaacgttacgaacgggaccgaaaggtaacggttacctaacccgttaaccggtaacggaaccgtaacgacgtacccggacggaacggttaattaaaccgttaataaggtacggagtaacgtgtaacgacgagtaccgtaaggtacgtaagtaacccggaagaaccggtaacggaccgttaggttaagttttacgtttttaacggtacggtacccttaacgggttacgttaacgggttagggtaacgttcgtaaacgttttaagttaacccgtaccttaagttaaacttttaccggaccgtttaaccgggacgggtttaccccggaaccgggttaacccggttacggttacccggtaacccttcgtccccgttaaccg

SEQ ID NO: 260576 - DNA, 775 bp, Homo sapiens
  misc_feature: GYAE6OF01DNXLZ.1.5.A05.1.454.CMB.1.raw
  modified_base (226)..(226): a, c, t, g, unknown or other
  misc_feature (226)..(226): n is a, c, g, or t
  modified_base (304)..(304): a, c, t, g, unknown or other
  misc_feature (304)..(304): n is a, c, g, or t
  modified_base (375)..(375): a, c, t, g, unknown or other
  misc_feature (375)..(375): n is a, c, g, or t
tcagacgagtgcgtcacgaccggtgctcgatttagatagatagacaggggacccaacaaccacatccctcctcagaagcccccagagcacaacgccccaccatggactggacctggagatccttcttttggtggcagcagccacaggtcgcccactcccaggtccagcttgtgcagtctggggctgaggtgaagaagcctggggcctcgagtgtaagggttttccnggaccaaggtcttcgaggtatacctaccttcactaggtatgactatacagttgggtgccgccgacgggacccccgganaaacggtcttggaggtaggagtgggagtggactcgaacgcgtaggcaagtaggaaacaacaaaaattcaanaggtaacgttccgagggtacacgtacgtacctaaccgtttaccgaagggaccacaccgttaccggacggtaagggttactttaaccgtttaagtacgtagggtacgacggttaggacgtacgaacggtccccgttaagggaacgtaccgtaacccggaaagtaacccggaacgggttactttaacggtttacttttaacgttttttcgggtacggttacccgttaacccgttacggtttacgggttaggggttaccggtttacgttaacttttacgttaccggttaccttaacggtttaaccgtttacggtacccgtttacccgggtaccgggggtaccctaaccgggggtaaccccttaccggtacccgtaaccccggttcccgtcccttaaccccggg

SEQ ID NO: 260577 - DNA, 198 bp, Homo sapiens
  misc_feature: GYAE6OF01BBTR5.1.5.A05.1.454.CMB.1.raw
  modified_base (179)..(198): a, c, t, g, unknown or other
  misc_feature (179)..(198): n is a, c, g, or t
tcagacgagtgcgtcacgaccggtgctcgatttagatagatagacagggcgaccaagggcccatcggtcttcccctggcaccctcctccaagagcacctcgtggggcacagcggcctgggctgcctggtcaaggactacttccacgcactcgtctgagcgggctggcaaggcgcatagnnnnnnnnnnnnnnnnnnnn

SEQ ID NO: 260578 - DNA, 805 bp, Homo sapiens
  misc_feature: GYAE6OF01CBUW8.1.5.A05.1.454.CMB.1.raw
  modified_base (133)..(133): a, c, t, g, unknown or other
  misc_feature (133)..(133): n is a, c, g, or t
tcagacgagtgcgtcacgaccggtgctcgatttagatagatagacagggacccaacaaccacactccctcctcagaacgccccagagcacaaccgccccaccatggactggacctggagatccttcttttggnggcagcagccacaggtcgcccactccaggtccagtcttgtgcagtcgtggggctgaggtagaagacgccgtgggcctagaggtagtaacgtttccagacgaaggtcttacggaaggacttacctaccttacgaacgttaggtatcgtataactacgtagttgggtcgacggaccggacccgggaccccggaagaaacggtccgtttaggacgggtaggtaaggtagggtagtacggtaacgtaaccgttaaccggacggtacggtaaccgtaaaaggttaacgggtaaaaacgtaaaaaccttaaaaaaacgttacgaaaccgtaaaggtaaacgtttaccggaagggaccgaagtaccgtaaccgtaacccgttaacggaacgggtaaccaacgtaccgtaccggaagtagttaacttaacgtttataacggtacgtagttacggaggacgtacgacgtacgaggtaacgaaccggtaaccgaacgacgtacggtattacgtttaacgttttagttcggtacgtaccgttaaccggtttagtacgggttaaggtacgttacgttaagttacgtaccgttaacgttagtttaaccgtttagacccggttcgggacccgggtaaccgtaccggtacccgtacgttaccccgtacgttcccgtccgtaacccgg

SEQ ID NO: 260579 - DNA, 743 bp, Homo sapiens
  misc_feature: GYAE6OF01EJ15P.1.5.A05.1.454.CMB.1.raw
  modified_base (152)..(152): a, c, t, g, unknown or other
  misc_feature (152)..(152): n is a, c, g, or t
  modified_base (227)..(227): a, c, t, g, unknown or other
  misc_feature (227)..(227): n is a, c, g, or t
  modified_base (247)..(247): a, c, t, g, unknown or other
  misc_feature (247)..(247): n is a, c, g, or t
tcagacgagtgcgtcacgaccggtgctcgatttagatagatagacaggggacccaacaaccacatccctcctcagaacgcccccagagcacaacgccccaccatggactggacctggaggatccttctttttggtggcagcagccacaggtncccactcccaggtccagcttgtgcagtcgtgggctgaggtgaagagccgtgggcctcgagtggtaacggtttccngcaaggtcttcaggataccnccttcacgttagtatcgacttatactagttgggtcgccgtaccgaccgggaccccggagaaacggtccgttaggagtcggagtggggagttggactcgacgcgtggactaagtacgtaaacaataaaaacttcgaactaacggtaaacgtaccggaaggtacaacggtacgtacccgtaacccgtttaaccggaacggggaacctaacccgtacgtacccgggtacggtaacggttaactttaacgttacgttagtacggtagtacgtagaacgtctaggtacccgtaggtaaccgaacgtacccggaagtacccgtacggtactttacggtttaagtttacgtttttacgaccgtacggtacctttagggtagttcggtagttactagtttaaccgtacgttacttacgttaacgttccgtccggttaaccgtcgggggtaacccgtaccgggtacccgttcgggtaaccctaacccgggtccctaccgtacccg

SEQ ID NO: 260580 - DNA, 840 bp, Homo sapiens
  misc_feature: GYAE6OF01DQAH8.1.5.A05.1.454.CMB.1.raw
tcagacgagtgcgtcacgaccggtgctcgatttagatagatagacaggggacccaacaaccacatccctcctcagaacgcccccagagcacaaccgccccaccatggactggacctggagatccttctttttggtggcagcagccacaggtcgcccactcccgaggtccagcttgtgcagtcgtgggctgaggtgaagagccgtgggctcagtgtaaggtttcctgcaaggtcttacgaggtactacgtaccttcacgttaggtactcgtactatacgtagtttcgggtgccgaccgaccggaccccggaacgtaaacggtccgttaggacggttagggtaaggttacggggtaagttacgggtaacgttaccgaaacggtcggttacggaccgtaaaggttaacggttaaaaccaaaaccgtaaaaaaactttccaaaacgtaacggtaacggttaccggaacgggtacgaacgtacggtacccttaacccgttaaccgaacggtacaaccgtacgtaccgacggtaaggtaactttaacttaagtacgttagggacgtcgtaggtaacgacgtacggtaccgttaggaacgtaaccgtacccggaaagtaccggtaccggttacgtttacggttttaacgttttacgtttttacggacggttaacccgttaccgtttacggttagggttacgggtacggttaactttaagtttacgttaaccgtactttaaccgttaaacgttttacgaaccggtttcccgggtaccgggggtaacccgttaaaccgggtaccccgtttacggtaaccccgttacccggttccctacccggtacccgg

SEQ ID NO: 260581 - DNA, 716 bp, Homo sapiens
  misc_feature: GYAE6OF01COM6G.1.5.A05.1.454.CMB.1.raw
  modified_base (157)..(157): a, c, t, g, unknown or other
  misc_feature (157)..(157): n is a, c, g, or t
  modified_base (314)..(314): a, c, t, g, unknown or other
  misc_feature (314)..(314): n is a, c, g, or t
  modified_base (333)..(333): a, c, t, g, unknown or other
  misc_feature (333)..(333): n is a, c, g, or t
tcagacgagtgcgtcacgaccggtgctcgatttagatagatagacaggggacccaacaaccacatcccctcctcagaacgcccccagagcaaccaaccgccccaccatggactggacctggagactccttctttttggtggcagcagccacaggtcncccactcccaggtcccagcttgtgcagtcgtggggtctggaggtagaagacgccgtggggcctgaggtgtaacgtttccagcaggtcttacgagactaccgtaccttcaacgtaggtatgtactatacgtagttggtcgacgccgaccggacccganaaggtctggagtgagtggntgagtcaacgcgtagactagtaagtaaacaaaactaaaactcgaactaaggaacgttaccggaaggacaaggtacgttacctaaccgtttacccgaacgggtaaccaacggtaccgtaccgtacggtaacgttaacgttttaccgttaagtacggttacggtaacggtcgtacggtagtccaacgggttcagggaaccgttaacggtaaccgaaacgtaccggaggttcgttaactttaattttacgttttcggcgggtaccctttcgtacgttacggtacgggttagtaccgttacgtttaactacgtcctttaagtacgttactacggtcgtaccgggacgttaaccggtccgtttacggacctcccgttccgcccgtacg

SEQ ID NO: 260582 - DNA, 706 bp, Homo sapiens
  misc_feature: GYAE6OF01EMFGD.1.5.A05.1.454.CMB.1.raw
  modified_base (342)..(342): a, c, t, g, unknown or other
  misc_feature (342)..(342): n is a, c, g, or t
tcagacgagtgcgtcacgaccggtgctcgatttagatagatagacaggggacccaacaaccacatccctcctcagaagcccccagagcacaaccgccccaccatggactggacctggaggattcccttctttttgggtggcagcagccacaggtgcccactccccaggtccagtcttgtgcagtcgtggggctggaggtgaaggaacgccgtggggccctgaggtggtaacggtttcctggcgtaacggtcttacgaggtaactacctacccgttacacgttaggtatcgtactatactagttggtgccgccgaccggccccggacaaggtcctggagtggngtggggatggactacgacgtcgtaggactaagtaacggtaaacaaactaaaaacttcaacgagtaacgttaccggagggactaggactacccgttaaccgttaaccgaacgggaacccaccgtaccggtacccgacgggtaacgttatttaaccttaagtacggttaacgggagtcgtaggtacggacgtacggtccgtaagacgtaacgtaaccggagaacccgtagggtcttaggtttatttagttttcggacgtcgtacccgttagttcgggtaggtagtctatttaccgtacgtctagttacgttcgtaccgtcggtcgggacccgtaccgggtacctcggtccgccgtccgtcccgtcg

SEQ ID NO: 260583 - DNA, 745 bp, Homo sapiens
  misc_feature: GYAE6OF01AR9L2.1.5.A05.1.454.CMB.1.raw
  modified_base (223)..(223): a, c, t, g, unknown or other
  misc_feature (223)..(223): n is a, c, g, or t
tcagacgagtgcgtcacgaccggtgctcgatttagatagatagacaggggacccaacaaccacatccctcctcagaagcccccagagcacaaccgccccaccatggactggacctggaggatcctctttttggtggcagcagccacaggtcgcccactcccaggtccagcttgtgcagtctgggctgaggtgaagagccgtggggcctcgagtgaggtttccngcaggctcgagatacaccttcgactaggtatgtctatacgagttgggtcgcgccgaccggcccccgaagaacggtcgttaggacgtggagtgggtacgtggactaccgaacgcgtacggaccaaagttacggtaaactaaactaaaaaagttccaacaagtaacgtccgaagggcacggacgtactaaccgtttacgaacggacacaccgtcggaacgtagggtactttaacgttatagtagtacggtcaggtaacgactacgccgtagacgtacgtaccgaagtaaccgtacggtacttaagtttaagtttacgtttttacgtaccggtaccgttaccgttacggttacggttacgggtaccggttaactttaccggtttaagttttaacccgacgtttacgtttaaaccggtttttagtaacccggttccccggggttaaccggggtaacccggttaacccgggttaaccccggtacggtttaaccccggtaccccgttcccgttccgttaacccccggg

SEQ ID NO: 260584 - DNA, 700 bp, Homo sapiens
  misc_feature: GYAE6OF01AGKSZ.1.5.A05.1.454.CMB.1.raw
  modified_base (396)..(396): a, c, t, g, unknown or other
  misc_feature (396)..(396): n is a, c, g, or t
tcagacgagtgcgtcacgaccggtgctcgatttagatagatagacaggggacccaacaaccacatccctcctcagaagccccagagcacaacgccccaccatggactggacctggaggatcctctttttggtggcagcagccacaggtgcccactcccaggtccagcttgtgcagtctgggggctggaggtgaagaagccgtggggcctcagtgaaggtttcctgcgaaggtcttcgaggtactactaccttcacgtaggtatgcttatacagttgggtgcgccgacggaccccggacaaaggcttggagtggagtgggatggatcaacgcgtaggctaatgggtaaaaccaactaaaaaactttcaaacgtaacgtaaacgttccgaaacggggnaacggacggttaaccgtaaccctttaaccggaagggaccaaccagttcccgacggtagggtaatttaacttaagttagtgggagtcgtagagcgacgtaccttaggacgtacgtaccgaacgacgacggtaccttagttagtttacttttgggtcgtaccgtaccgttacgttaggttagggtacgtacgttaattacgttaacgttcttaaccgttaacgtttcgtaccgttccggtaccggggtccggtaaacccggggttacccgttcgggtaaccccttccggtcccttccggtaccccg

SEQ ID NO: 260585 - DNA, 768 bp, Homo sapiens
  misc_feature: GYAE6OF01B0HS6.1.5.A05.1.454.CMB.1.raw
  modified_base (210)..(210): a, c, t, g, unknown or other
  misc_feature (210)..(210): n is a, c, g, or t
  modified_base (297)..(297): a, c, t, g, unknown or other
  misc_feature (297)..(297): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtcgtggggctggaggtgaagagccgtggggcctnaggtgtaaggtttcctgcgaaggcttcgaggataccaccttcacgtaggtatgctatactagttgggtcgcgccgacggacccgganaacggtctaggagtggagtagggataggtactacgacgtcgtggactaagtacggtaaactaaacgtaaaaattaccaacgtaacggtaacgttaccgaacgggacgaacgtacgtacccgtaaccgtttaaccgaacgggtaacctaacctacgtacccgaacggtaggttaactttaacttaagtaagtagggacgtacgtagacgtacgtacgtacgtagagtaaccgtaccggaaacgtaccggtacggttacgttaacgtttaagttttaacgtttttacgggtcgttaacccggttaccgtttaccggttggttaacggggttacgtacgttaaacgttttacggttacgtaccgtttacgtttaaaccgtttcggtaaccggttcccgggttaacggggaccccgggttaaaccggtaaccccggttcggttaaccccgtacccggttccgtcccccgtaaccg

SEQ ID NO: 260586 - DNA, 768 bp, Homo sapiens
  misc_feature: GYAE6OF01CR72Z.1.5.A05.1.454.CMB.1.raw
  modified_base (134)..(134): a, c, t, g, unknown or other
  misc_feature (134)..(134): n is a, c, g, or t
  modified_base (152)..(152): a, c, t, g, unknown or other
  misc_feature (152)..(152): n is a, c, g, or t
  modified_base (228)..(228): a, c, t, g, unknown or other
  misc_feature (228)..(228): n is a, c, g, or t
tcagacgagtgcgtcacgaccggtgctcgatttagatagatagacaggggacccaacaaccacatccctcctcagaacgccccagagcacaaccgccccaccatggactggacctggaggatccttcttttggnggcagcagccacaggtcncccactcccaggtccagcttgtgcagtctggggctgaggtagaagacgccgtagggcctcagtgtaacggtttccngacgaaggcttagaggtactacctaccttacacgtaggtatgacttatactagttcgggtcgacgccgtaccggacccggaacgaaacggtccgttaggaggtaggagtacgggtagtaggtacgtacgaacgtcgtaggaccgtaaagttacgggtaaaacctaaaacgtaaaaaacttacaacgtaacgtaacgtaccgaagggactaagacgtacctaaccgtttaaccggaaggtaccgtaacgaccgtaccgacggtaagtactttaacgttaaagtacgtaagggactacggttacggaagaccacgtaccgtagggtaacgtaacgtaaccggaaacgtaaccgacgggttaccttagttaaacgtttttagttttacggtacggtaacccgtaccttacggtaacggtttaacgggtacggtactttaacgtttaacgtacgtaccgttaacgttaaacgtttcgaccgttacggtaccgggtacgtaacccgggtacccgtacggtacccgtaaccttccgtccgtaaccg

SEQ ID NO: 260587 - DNA, 759 bp, Homo sapiens
  misc_feature: GYAE6OF01DE8IQ.1.5.A05.1.454.CMB.1.raw
  modified_base (226)..(226): a, c, t, g, unknown or other
  misc_feature (226)..(226): n is a, c, g, or t
  modified_base (275)..(275): a, c, t, g, unknown or other
  misc_feature (275)..(275): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtctggggctggaggtgaagagccgtggggcctcgagtgtaaggtttccngcaaggcttcgaggatacaccttcactaggtatgactatacagttgggngccgccgacggccccggacgaaaggcgtttaggcggtggagtggggatgggatccgaacggcgttagggctaaagttcggtaaacaaactaaaaaactttccgaactaagtaacgttaccgaggggacaggtacgtactaaccctttaccgaacgggaccacgtacgtcccggtagacgggttatttaacgtttaatagtcgggtagtcgtaggacgtacacgggtcctaggaacgtacggtaacccggaacggtaccgtaaccgggtctttagttttaagtttaacgttttttcggtaccggtaaccgtacccggtttagttaacggggttcgggtacggtttcttaaacgttttacgttaccggtactttaaccgtttaagtttacggtaccggtttccccgggtacgggggtacccccggtaacggggttacccccgtttagggtaccccgttaaccccggtccgtttccccgtaacccgg

SEQ ID NO: 260588 - DNA, 201 bp, Homo sapiens
  misc_feature: GYAE6OF01CMR6B.1.5.A05.1.454.CMB.1.raw
  modified_base (182)..(201): a, c, t, g, unknown or other
  misc_feature (182)..(201): n is a, c, g, or t
tcagacgagtgcgtcacgaccggtgctcgatttagatagatagacagggcaccaagggcccatcggtcttcccctggcaccctcctccaagagcacctcgtggggcacagcggccctgggctgcctggtcaaggacttacttcctatgtattactctgaggcgggctggcaaggcgcatagnnnnnnnnnnnnnnnnnnnn

SEQ ID NO: 260589 - DNA, 807 bp, Homo sapiens
  misc_feature: GYAE6OF01CX411.1.5.A05.1.454.CMB.1.raw
  modified_base (147)..(147): a, c, t, g, unknown or other
  misc_feature (147)..(147): n is a, c, g, or t
  modified_base (758)..(758): a, c, t, g, unknown or other
  misc_feature (758)..(758): n is a, c, g, or t
tcagacgagtgcgtcacgaccggtgctcgatttagatagatagacaggggacccaacaaccacatccctcctcagaacgcccccagagcacaaccgccccaccatggactggacctggagattccttcttttggtggcagcagccanacggtgcccactcccgagtccagcttgtgcagtcgtggggctggagggtagaagaacgccgtggggcctacgaggtaggtaacggttttccaggaccgtaagggtcctttacgaaggacttaaccaccgtttacacgttaggtatgacttaagtacaggtttcggcgacccgccgaaccgggaccccgaaggtaaacggtcgttaggaacgttgggtaaggtaggggtagtacggtaacttaacccggaaaccggtccggttaaggaacctaaaacgttaaccgggtaaaaactaaaaacgtaaaaaacctttcgaaactaacgggttacgttaacccgaagggtaccgaacggttaaccgttaaccgttaaacccgtttaccggaaacgggaccctaacggtaccgtacccggacgtaacggtttaacttaacgttaagtacgtagggactccgtagtacacggtaacgtcgtaacggacacgtaaccgaacgacgtacggtacggttataaccgttttagtttcggtaacgtaccgttaccgttagtaccggttaagtacgttagtacgtttacctacggtactacgttagttacgtacgttacccggngggaaacctacccggggtaccttacggaccctcccgttcgccgttaccg

SEQ ID NO: 260590 - DNA, 851 bp, Homo sapiens
  misc_feature: GYAE6OF01A0432.1.5.A05.1.454.CMB.1.raw
  modified_base (181)..(181): a, c, t, g, unknown or other
  misc_feature (181)..(181): n is a, c, g, or t
tcagacgagtgcgtcacgaccggtgctcgatttagatagatagacaggggacccaacaaccacatccctcctcagaacgcccccagagcgacaacgccccaccatggactggacctggaggatcctcttttggtggcagcagccacaggtgcccactcccaggtccagcttgtgcagtcgngggctgaggtgaagaagccgtggggcctcgagtggtaacggtttcctgcgaaggtccttgacggatactaccgtttcacgttaggatgactatacgtagttggggtcgcgccgacgggccccgaacgaacggtcgttgagtgggagtgggataggatacgaacgcgtaggacaagtaacggtaacaaaactaaaaacttcgaaccgaagtaaaccggtttaccggaacggggacaacggtaacgtaccgtaaaccccgttttaacggaacgggtaaacccaaaccggaaccttacccgggacggtaacggttaacggttttaaccctttaaggttacggttaggaagtaccggttacgtaggaccccgaagggttacccgtacgggtaacgtaacggttaaccccggaaaacggtaacccggtaacggtaccgtttaggttaacgtttttacgttttttacgggacgtacccggttaccgtcggtttacgggttacggtaacgggtttacttaaacttacggtttaaccgtaccgttaaccgttaaacgttttacgggtaaccccgtttcgggggttaccccggggtaaaccccgttaaccggggggttaaacccccgttccggggttaccccgttaacccccggtttcgtttaacccccgtaccccggg

SEQ ID NO: 260591 - DNA, 755 bp, Homo sapiens
  misc_feature: GYAE6OF01B9Z6N.1.5.A05.1.454.CMB.1.raw
tcagacgagtgcgtcacgaccggtgctcgatttagatagatagacaggggacccaacaaccacatccctcctcagaacgcccccagagcacaacgccccaccatggactggacctggaggatcctcttttggtggcagcagccacaggtgcccactcccaggtccagcttgtgcagtcgtggggctggaggtgaagacgccgtggggcctcgaggtgtaacggtttcctgcaaggtcttacgaggtactaccaccgttcacgtaggtatgtcttaatacgtagttgggtcgccgcccgaccgggccccggaaagaacggtcttggaggtaggagtgggagtggactacgacgtcgtggactaagtaacgtaaacaaactaaaacttcgaacgagtaacggtccggaaggcgtaagtacgtacccgtaaccgtttacgaaggtaccactacgtacccggacggtaaggttaacttttaacgttagtaaacggtcgggtaacgtcttaacgggtaacgtaccgtacgtaccgtagggaacgtaccgtaacccggtaacggaccgaacgggtttcttaagggttttaattttacggttttacggccggtacccgttcccgttaggttacgggtacggttacgtacttaagtttaccgttaccgtaccgttattacggttccgtacccggttccggtacggggtaccccgtaacgggtacccgttccggtaacccgtcccgttccgtcccgttacccgg

SEQ ID NO: 260592 - DNA, 746 bp, Homo sapiens
  misc_feature: GYAE6OF01ANDRK.1.5.A05.1.454.CMB.1.raw
  modified_base (131)..(131): a, c, t, g, unknown or other
  misc_feature (131)..(131): n is a, c, g, or t
  modified_base (248)..(248): a, c, t, g, unknown or other
  misc_feature (248)..(248): n is a, c, g, or t
  modified_base (298)..(298): a, c, t, g, unknown or other
  misc_feature (298)..(298): n is a, c, g, or t
  modified_base (325)..(325): a, c, t, g, unknown or other
  misc_feature (325)..(325): n is a, c, g, or t
tcagacgagtgcgtcacgaccggtgctcgatttagatagatagacaggggacccaacaaccacatccctcctcagaacgccccagagcacaacgccccacatggactggacctggagactcctcttttggnggcagcagccacaggtcgcccactcccaggtccagtccttgtcgctacgtcgtgggctggaggtgaagacgccgtcggggacctcgagtcgtaaggtttccagacgtaaggtcttanaggtactacctccttacacgtaggtatgacttataccgtagttcgggtcnccgacccgtaccgggaccccggtaaanaaacgggtcctttaggacggttacgggtaggtacggggtacttacgggactaccggtaacggtcggtacgggtactaacgtaacggaaacctaaaagtaaaacgtttcaacgtacggtaaccgtcgaagggaccaaggtaccgtaccgtaaccgtttaaccggaaggtaacccacgtaccgtaccgagggtaacgttattacgtatacgaggtcgacgtagacgtacgacgtcgtacggacgtagtaccgaagtacgaccgttagtaactttgtacgttttacggcgtacggttacctacggttagggcgtagttaacccggttaataccgttcgtacgttaacgttaacgtcccggttacggtccgggtacgggacccgtaacggtacctcggtaacccctcgttccgtcccgtacccgg

SEQ ID NO: 260593 - DNA, 190 bp, Homo sapiens
  misc_feature: GYAE6OF01BKYN5.1.5.A05.1.454.CMB.1.raw
  modified_base (178)..(190): a, c, t, g, unknown or other
  misc_feature (178)..(190): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttccagtactctatctgagcgggctggcaaggcgcatagnnnnnnnnnnnnn

SEQ ID NO: 260594 - DNA, 296 bp, Homo sapiens
  misc_feature: GYAE6OF01AKU5B.1.5.A05.1.454.CMB.1.raw
  modified_base (200)..(200): a, c, t, g, unknown or other
  misc_feature (200)..(200): n is a, c, g, or t
  modified_base (211)..(211): a, c, t, g, unknown or other
  misc_feature (211)..(211): n is a, c, g, or t
  modified_base (256)..(256): a, c, t, g, unknown or other
  misc_feature (256)..(256): n is a, c, g, or t
  modified_base (273)..(273): a, c, t, g, unknown or other
  misc_feature (273)..(273): n is a, c, g, or t
  modified_base (276)..(276): a, c, t, g, unknown or other
  misc_feature (276)..(276): n is a, c, g, or t
  modified_base (278)..(296): a, c, t, g, unknown or other
  misc_feature (278)..(296): n is a, c, g, or t
tcagacgagtgcgtcacgaccggtgctcgatttagatagatagacaggggcagttccagatttcaactgctcatcagcagcctgcagtctagaagtatttttgctagttttattactgtcagctagtataataacgtcgcctaccgacgttccggcgaaggaccgaaggtagaaatacgaaacgactgtggctgccactntctgtcttacncttcctccgcatctagtcgtctacgtgcgtcgtaggcggcgggtnacggacaacggcgaatnagntnnnnnnnnnnnnnnnnnnn

SEQ ID NO: 260595 - DNA, 792 bp, Homo sapiens
  misc_feature: GYAE6OF01CCIUU.1.5.A05.1.454.CMB.1.raw
  modified_base (137)..(137): a, c, t, g, unknown or other
  misc_feature (137)..(137): n is a, c, g, or t
  modified_base (229)..(229): a, c, t, g, unknown or other
  misc_feature (229)..(229): n is a, c, g, or t
  modified_base (259)..(259): a, c, t, g, unknown or other
  misc_feature (259)..(259): n is a, c, g, or t
tcagacgagtgcgtcacgaccggtgctcgatttagatagatagacaggggacccaacaaccacatccctcctcagaacgcccccagagcacaaccgccccaccatggactggacctggagactccttcgtttttggnggcagcagccacaggtcgcccactcccaggtccagtcttgtgcagtcgtggggctggaggtgagagccgtgggcctcgagtgtacgtttccngacaggtcttacgaggtactaccacctttnacgtaggtatcgtacttattacgtagtttggggtacgccggacccgaccgggtacccccggaagtaaacgggtccgttaggacggtcgggaagttggggacgttacgggtaactacccggtaacggcggtttacggaaccgtaaaggttacgggtaaaaacctaaaacgtaaaaaaacgtttcccgaaacgtaacggttaaaccggttaccggaaacggggacctaacgggtaaccgtttacccgtaaacccgtttaaacccggaaggggtaacccctaagaaccgttccgggaacggtaacggttaactttaacgtttagtaacgtgggtacgtcgttaggaacgctaaccggctaggacgttacgacggaacgacgacggttcttaacggttactttaagttttcggaccgtcgtaccgttaggtaggtacggttacgtatacgtttacgtaccgtagttacttaacgttcggaccgttcggaacgggtacccgtacggtaccggttcgacctcccgttccgtcgtacccg

SEQ ID NO: 260596 - DNA, 813 bp, Homo sapiens
  misc_feature: GYAE6OF01ET1AQ.1.5.A05.1.454.CMB.1.raw
  modified_base (311)..(311): a, c, t, g, unknown or other
  misc_feature (311)..(311): n is a, c, g, or t
  modified_base (398)..(398): a, c, t, g, unknown or other
  misc_feature (398)..(398): n is a, c, g, or t
  modified_base (528)..(528): a, c, t, g, unknown or other
  misc_feature (528)..(528): n is a, c, g, or t
tcagacgagtgcgtcacgaccggtgctcgatttagatagatagacgaggggacccaacaaccacatccctcctcagaacgccccagagcacaaccgccccacatggactggacctggacggtacttccttcgtttttgggcggacagcagacccagtaggtccaccctaccgtcccgaggtccagtcttgcgacgtaggtcggtgggtctagggaggtaggaacgacggtccggtggggtcctacgaggtacggtacggtttccagggaaccgtaacggtcttacggaacgttacctaaccttacccgttnaaccggttaggttactgtaactagtagtacggttgggacacgacccgaccggacccgaagaacggtcgtaggaggtacggtaacggngggaacgtcgtaacgacgtaggtacgtcggaattaacgtaacggtaaaacctaaaagtaaacctgaacgacggtaacgtacggaacgtacaacgtaacctccgtttaaacgtacggaacgtaccggtaancccgtaagggtaacggtaagtttacgtttaaccgtaagttaaacggcgggtaacgtaccgaagggtaaccaccgttaaggcctaacgggtcgtaaaaccgtaaccggaacggtcggttaacgtttctttagggttaactttggttaccgtaccggtcttaacgtgggtaagttcgggttaacgtacgtaatttaccggttataacgtttacgttaacgacgttacgggtcggtacgggaaccccgttaggtacccgtcgaaccggtcccttcgtccgtaaacccg

SEQ ID NO: 260597 - DNA, 854 bp, Homo sapiens
  misc_feature: GYAE6OF01BPJDA.1.5.A05.1.454.CMB.1.raw
tcagacgagtgcgtcacgaccggtgctcgatttagatagatagacaggggacccaacaaccacatccctcctcagaacgcccccagagcacaacgccccaccatggactggacctggaggatccttctttttggtggcagcagccacagggtcgccccactccccgaggtccagtcttgtgcagtcgtggggctggaggtagaagacggtccgtggggcctcgaggtaggtaacggttttcctagacgtaacggtcttacgaaggtactacctaccttcacgttaaggttatgtacttaatacgtagttcgggtcgccggaccggaccgggacccccggaaagaacggtcgttaggaggtgggtaaggtcggggtagtgggtactaccggaacggtcggtaggacgtaaagttaacggtaaaaccaaaacgtaaaaacttacgaacgtaacgttaacggtaccggaacgggtacgaaggtaaccgttaaccgttaaccgtttaaccggaaggtaaccaacgaccgtacccgggaacggttaacggttaactttaacgttaacgtaggtacgggtagtcgtacgacgtaccgtaacggtccgtaagggaacgtaactaacggaaacggtacggtaaccggttcgttaaggtttacgttttacggttttagggtaccggtacccggttaacgtttaccgttaagggttacggtacggtttaacttacgtttaacgttacccgtacgtttaccgttaacggtttaccgtacccgggttccggtacccgggggttacccgtaacccggggttacccgttacgggtacccttacccgggttcccttccccgggtacccg

SEQ ID NO: 260598 - DNA, 193 bp, Homo sapiens
  misc_feature: GYAE6OF01D09HK.1.5.A05.1.454.CMB.1.raw
  modified_base (180)..(193): a, c, t, g, unknown or other
  misc_feature (180)..(193): n is a, c, g, or t
tcagacgagtgcgtcacgaccggtgctcgatttagatagatagacagggcaccaagggcccatcggtcttcccctggcaccctcctccaagagcacctcgtggggcacagcggccctgggctgcctggtcaaggactacttccagtactctatctgagcgggctggacaaggcgcatagnnnnnnnnnnnnnn

SEQ ID NO: 260599 - DNA, 990 bp, Homo sapiens
  misc_feature: GYAE6OF01ES3LB.1.5.A05.1.454.CMB.1.raw
tcagacgagtgcgtcacgaccggtgctcgatttagatagatagacaggggacccaacaaccacactccctcctcagacgcccccagagcacaaccgccccaccatggactggacctggaggatcctcttttggtggcagcagccacgaggtcgccctacgtcccgaggtccagtcttgtagctaggtctggggctggaggtgaagacgccgtggggcctcgaggtcgtaacggttcctaggacgtaacgggcttacgacggactaccgtaccttacgtaacgtaggtacttgtaccttagtaccgtaggtttcgggtaccggacccggtacccggaaccgggtcccccggggtaaagtaaacgggtccgttggaacgggtttggggaggttacgggtagttacggtaacggttaccgaacggtccgtacgggtaccgtaagttaacgggtaaaacctaaactaaaaacgtttcaaacccggttaaggtaaaccggttacccggtaacggggtaccgtaacgtaaccggtttcccgtaaaacccgtttacccgggaaacgggaacccgtaaccggtaccgtacccggtacggtaaccgggttaacgttttaaccgttaagttacggtaacgggtaaccggtacgttacggaaccggtacccgtacggtacccggttaacgggaaccgtaaccggtaaccggtaaaccggtaaccgggtaccggttaaccggtttaggttttaacgttttacgtttttaccggtacggtaccggttaacccgttttacgggtaacggggttaccgttaacggggtttaaccttacggttttacccgtttaaaccggtaccgtttacccgtttaaaccggttttacgggtaaaccccggtttccgggggttaaacccggggttaccccgtaacgggggttaaaccccccgttcgggttaaccccgttacccgggtttcccccggtaaccctttacccccgggg

SEQ ID NO: 260600 - DNA, 584 bp, Homo sapiens
  misc_feature: GYAE6OF01A8USM.1.5.A05.1.454.CMB.1.raw
  modified_base (179)..(179): a, c, t, g, unknown or other
  misc_feature (179)..(179): n is a, c, g, or t
  modified_base (207)..(207): a, c, t, g, unknown or other
  misc_feature (207)..(207): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtcgngggctgaggtgaagagccgtggggcctnagtgtaggtttcctgcgaaggcttcgaggatacgaccttcactaggtatgctatacattgggtgcgccacggccccggacaaaggcttgagtggatgggatgggactcgaacgctggacaagtggtaacaactaaaaattcgaacagaacgttccgagggacagagtctactttacgaggacacatccgacgtacggaacttacttatacgtggacgctagcgcgagtcctgacgtagttccgaagacgtacgcgtagtattagttttgcgtcgtactcgtagttggacgttactagtttacgtacgtactacgtaagtttcgacttccggtcgggaccgtacgggtaccgtcggtaccgtccgtcgtccgtacccg

SEQ ID NO: 260601 - DNA, 694 bp, Homo sapiens
  misc_feature: GYAE6OF01DAXNH.1.5.A05.1.454.CMB.1.raw
  modified_base (131)..(131): a, c, t, g, unknown or other
  misc_feature (131)..(131): n is a, c, g, or t
  modified_base (223)..(223): a, c, t, g, unknown or other
  misc_feature (223)..(223): n is a, c, g, or t
tcagacgagtgcgtcacgaccggtgctcgatttagatagatagacaggggacccaacaaccacatccctcctcagaagcccccagagcacaacgccccaccatggactggacctggagatcctcttttggnggcagcagccacaggtgcccactcccaggtccagcttgtgcagtctggggctggaggtgaagacgcctggggcctcgagtgaacggtttccngcaaggcttcaggataccaccttcacgtaggtatgactatacattgggtgccgccgacggccccggacgaaacggcttgacggtggagtaggtagtggatcgaacgcgtaggcaaagttggaaaaccgacaaaaaactttacgaacctaagtaacgtttacccgaaggggaccaaggtaacgttacgtaacccgtttaacccgaaggggacctaaccgaacgttcccgacggtaacgggtactttaacgtattaagtacggtacgtacgtagtacgacgtaacgtcctacgggtaagaccgttacgaaacggaccgtaacggtcgttaggttactttaggtttacgttaggaccgtaccgttcgttacgtgggtacggttactaactttaagtccgataccgttaattacgtacccgtcggtaccggggactaccggggaacccttggacccttaccgcgtcccgtacccg

SEQ ID NO: 260602 - DNA, 689 bp, Homo sapiens
  misc_feature: GYAE6OF01EY9LI.1.5.A05.1.454.CMB.1.raw
tcagacgagtgcgtcacgaccggtgctcgatttagatagatagacaggggacccaacaaccacatccctcctcagaacgcccccagagcacaacgccccacatggactggacctggaggatcctctttttggtggcagcagccacaggtgcccactcccaggtccagcttgtgcagtctggggctggaggtgaagaagccgtggggcctcagtgaggtttctgcaaggcttacgaggatacaccttcacgtaggtactgactatactattgggtgccgtcgacggccccggacaaaggctagagtggagtgggatgggactcgaacgtcgtagggcaagtagggtaaactaaactaaaaaagttacaacgaaggaaacgttaccgaagggacctaaggatacctaaccgtttaaccgaggtaaccacgtacgtccgaacggtaggtaactttaacgtaacttaagtagggtagtaccgttagaacgtcacggtaccgtacgaggatacccggaagtacggaaccgtacgttagttaagttagttttttcggcgtccgttaccgttacggttacgtaggtaacgttcgtaactttaacgttaccgtacttacgtaacgtttagaccggtttccgtacggggaccgtaccgggaaccccttaggaccctaaccgttccgtcccgtaacccg

SEQ ID NO: 260603 - DNA, 744 bp, Homo sapiens
  misc_feature: GYAE6OF01EOBI1.1.5.A05.1.454.CMB.1.raw
  modified_base (214)..(214): a, c, t, g, unknown or other
  misc_feature (214)..(214): n is a, c, g, or t
  modified_base (226)..(226): a, c, t, g, unknown or other
  misc_feature (226)..(226): n is a, c, g, or t
  modified_base (279)..(279): a, c, t, g, unknown or other
  misc_feature (279)..(279): n is a, c, g, or t
tcagacgagtgcgtcacgaccggtgctcgatttagatagatagacagggacccaacaaccacatccctcctcagaacgcccccagagcacaacgccccaccatggactggacctggagatccttcttttggtggcagcagcccacgaggtcgcccgactcccaggtccagcttgtgctagtcgtggggctggaggtgaagagccgtggggcctnagtgaagttccngcgaagtctcgaggatacacttcagtaggtatgactaatacgtagttgggtanccgtaccacggaccccgaacgtaaaacggtccgtaggaggtagagtagggataggactacgaaacgcgttaggacctaagtacgggtaaactaaaacgtaaaaaaagtttccaaacgtaaggtaaaccggtttaccgaaaggggtccaaaggtacggtacctaacccgtttaacgaacggggaaccaactacgtaccggacggtaaggtaactttaactaggttaaccgtgggaccgttacgttacggagacgaaggaccctaggaacgtaccgtacgtaaaggaccgtacggtacgttagttaagtttacgttttaggtaccgacgttaccgtacttaaggtcggtaggtacccttaaagttacgttaacgtaccttaacggtactttaggtacccgttacccgggagggtacccggaacggtaaccccgtcggttacctacccgttccggtccgtaaccccgg

SEQ ID NO: 260604 - DNA, 945 bp, Homo sapiens
  misc_feature: GYAE6OF01BAUTM.1.5.A05.1.454.CMB.1.raw
  modified_base (138)..(138): a, c, t, g, unknown or other
  misc_feature (138)..(138): n is a, c, g, or t
  modified_base (158)..(158): a, c, t, g, unknown or other
  misc_feature (158)..(158): n is a, c, g, or t
  modified_base (234)..(234): a, c, t, g, unknown or other
  misc_feature (234)..(234): n is a, c, g, or t
tcagacgagtgcgtcacgaccggtgctcgattttagatagatagacaggggacccaacaaccacatcccctcctcagaacgcccccagagcacaaccgccccaccatggactggacctggagatccttctttttgggnggcagcagccacgagggtcncccactcccaggtccagtcttgtgcagtcgtggggctggaggtagaagacgcgtggggcctgaggtgtagtttccngcgaacggtcttgaggtactaccgtaccttacacgttaggtatggtacttactacgtaggtttggggtacgcccggacccggaccgggaccccccggtaaagtaaccgggtcgttaggacgggtagggtacggtaggggtaacgttcgggtaactaaccggaaccggtccggtacggtaaccgtaaacgggttaacggggtaaaaaccctaaaaacggttaaaaaaccttccgtaaacggtaaacgggttaacggttaacccgggaacggggaccgtaacgtacggttaacccgttaaacccggtttaaccgggaagggtaaacccaccggttaacccggtaccggggaacggtaaccgggtttaacttttaacgtttaacggttacgttacgggtacggtccgtaggtaaccgtcgtaaaccgtccgttaacgggtaacgtaacccgtaccggaacgtacccgtacggttacttaacggtttacttttagggttttccacggttacccggtaccgtttacggttaaggggttaccggttaaccggttacgttaacgttttaaccggttaaccggttaccgtttaacgtttaaccgggtttccgtaacccggggtttaccccggggacccggggttaaaccccggttacccggggttacccggttaaccgggttaccccgtaccccggtttcccgttacccgtaccccggg

SEQ ID NO: 260605 - DNA, 1075 bp, Homo sapiens
  misc_feature: GYAE6OF01EYJ0U.1.5.A05.1.454.CMB.1.raw
  modified_base (124)..(124): a, c, t, g, unknown or other
  misc_feature (124)..(124): n is a, c, g, or t
  modified_base (132)..(132): a, c, t, g, unknown or other
  misc_feature (132)..(132): n is a, c, g, or t
  modified_base (225)..(225): a, c, t, g, unknown or other
  misc_feature (225)..(225): n is a, c, g, or t
  modified_base (287)..(287): a, c, t, g, unknown or other
  misc_feature (287)..(287): n is a, c, g, or t
tcagacgagtgcgtcacgaccggtgctcgatttagatagatagacaggggacccaacaaccacatccctcctcagaagcccccagagcacaacgccccaccatggactggacctggagatcctntttttggnggcagcagccacaggtcgcccactcccaggtccagcttgtgcagtcgtgggctgaggtgaagagccgtgggcctcgagtagtaaggttttccngaccaaggtcttcgaggtataccaccttacacgtaggtatgacctatactagttaggggttnaccgccgtaccgggacccccggtaacgaaaacgggtccgttaggtaacggttagggtaagtgggggtaagttcggggaacttccggtaaaccggtccgttcgggaccgaaaagttaacggggttaaaaacctaaaaaccgttaaaaaaaaacgtttaccgaaaaaccgtaaacggtaaaaccggttttaaaccccgaagggggtacccgtaaaacgggtaaccggtttaacccgtaaaccccgtttttaaaccccggaaacgggggttaaaccccgaaacccgtaaaccgtaaccccggtaacccgggtaaacgggtttaaaaccgtttttaaaccgttttaaacgtttaaacgttttaacggggaaacggttaccggttaacgggttaaacggaacccgggtaaacggtaacccccccgggtttaagggtaaacgggttaaaccccggtttaaaccccgggaaaaaccgggttaacccgggtaaaacccggggttaacccgttttaaccgggtttaaaggtttttaaaccgtttttttttaacggggtaccggtttaacccccgggttaaccccggtttaaacccggttttaacggggttaaccgggtaaggggtttaccctttaaaacgggttttaaaccgttttaaacccggtaacccgttttaacgttaaaacgtttttccggtaaaccgtttccccgggttacgggggtaaccccgtaaaccggggtaaccccgttacgggttaccccgtaaccccggttccccgttaccccgttaaccccgg

SEQ ID NO: 260606 - DNA, 751 bp, Homo sapiens
  misc_feature: GYAE6OF01BFJFX.1.5.A05.1.454.CMB.1.raw
  modified_base (267)..(267): a, c, t, g, unknown or other
  misc_feature (267)..(267): n is a, c, g, or t
  modified_base (679)..(679): a, c, t, g, unknown or other
  misc_feature (679)..(679): n is a, c, g, or t
tcagacgagtgcgtcacgaccggtgctcgatttagatagatagacagggggacccaacaaccacatccctcctcagaacgcccccagagcaccaaccgccccaccatggactggacctggaggatccttctttttggtggcagcagccacgaggtcgcccactcccaggtccagcttgtgcagtcgtggggactggaggtgaagacgccgtggggcctcagtgtaacggtttcctgacaacggtcttcgaaggactacctacccttnacgtaggtatgacctatacgtagtttgggtcgccgcccgacgggcccccggaagaaacggtcgttggaggtggagtgggatggactcgaacgctggactaacgttaggaaaacctaaacgtaaaaactttaccgaacgtaaacggtaaacgttacccggtaagggaccgtacggtaacgttcccgtaaacccgtttaccggaacgggtaacccaacgtacggtacccgacgggtaacgtacgttttaacgttaattaacgtcgggaacgtacgtaggaacggtaccgaacggttacccgagaacgtaccgtaacggaaccggaaccgtacggttcgttacgtttaagtttagttttacggccggtacgttacccgttgttaacggtgggtacgttacgtatttacgtaccgntttaacgtacttaggcccgttcgggacgggtaccaaccgggtcctcgggtacctaccggttcctcccgtacg

SEQ ID NO: 260607 - DNA, 880 bp, Homo sapiens
  misc_feature: GYAE6OF01A3SJT.1.5.A05.1.454.CMB.1.raw
  modified_base (225)..(225): a, c, t, g, unknown or other
  misc_feature (225)..(225): n is a, c, g, or t
tcagacgagtgcgtcacgaccggtgctcgatttagatagatagacaggggacccaacaaccacactccctcctcagaacgcccccagagcacaacgccccaccactggactggacctggaggatcctcttttggtggcagcagccacaggtgcccactcccaggtccagcttgtgcagtctggggctgaggtgaagagccgtggggcctcaggtgaaggtttccngtacgaaggtctttcgagggtataccgtacctttacgaacgttaggtaactggacttaacgtactagtttgggtcgtccggaccgtaccggacccccggaagtaaacgggtccttacgggtaggtacgggtacgtaggggtacgttacgggtaacgtaccgaacggtccgttagggactaaacgttacgggtaaacctaaaccgtaaaaaaacgtttccgaaacggtaaacggttaaacggttaccgtaaacggggtaccgaacggtaacgggttacccttaaaccggtttaaccggaaacggggttaccaaacgtaccgttacccggaacgggtaacgttaactttaacgtttaacggtacgttaagggtacgtacgttaacggaacgtacgaacggtccgttacggaacggttaacgaaccggtacgaaccggtacgtacgtaagtttacgtttacgttaggtacgtaccgttaccgttacgttacggtaggtaaccgtttaaccgtagtttaaccgttaccgttattaaaccggtttcgttacccggttaaccgggttacccgggtaacccggggtaaccgtttaaccccggggtaacccggtttccggttaaacccctttcccgggaaaccctttcccgggtaaaccccgg

SEQ ID NO: 260608 - DNA, 687 bp, Homo sapiens
  misc_feature: GYAE6OF01A9PAR.1.5.A05.1.454.CMB.1.raw
  modified_base (132)..(132): a, c, t, g, unknown or other
  misc_feature (132)..(132): n is a, c, g, or t
  modified_base (145)..(145): a, c, t, g, unknown or other
  misc_feature (145)..(145): n is a, c, g, or t
  modified_base (150)..(150): a, c, t, g, unknown or other
  misc_feature (150)..(150): n is a, c, g, or t
tcagacgagtgcgtcacgaccggtgctcgatttagatagatagacaggggacccaacaaccacatccctcctcagaacgccccagagcacaaccgccccacatggactggacctggagatccttcttttggnggcagcagccagnggtcncccactcccgagtccagtcttgtcgcagtcgtgggctggaggtgaagagccgtgggcctgaggtacgtaacggtttccagacgtaaggtcttaggacggtactacctaccttacgacttaggtatgtactagtactaggtttgggacgccgcccgaccgggaccccggaagaacggtccgtaggagtggagtgggacgtggacgtacgacgtcgtcgtacaacgtagaaactaaacgtaaactacgaacgtagaacggtaccgaggacgtagacgttacctacgtacgagtacacgtacgcgtacgagttattacgtatagacgtgcgtgacgtcgaacgtccgaagacgaccgtaccgacgtacgaccgtattcggtttaatttcgttcggtagttacccgttacgtacggttagggttcggtacgttcgtaacgtttcgtaccgtaccgtttagttaaccggtttcggtaaccggtcccgggacggtacccggttacggtccgttccggtaaccctccgtttccgacccgtcccg

SEQ ID NO: 260609 - DNA, 901 bp, Homo sapiens
  misc_feature: GYAE6OF01DAFIP.1.5.A05.1.454.CMB.1.raw
tcagacgagtgcgtcacgaccggtgctcgatttagatagatagacaggggacccaacaaccacatccctcctcagaagcccccagagcacaacgcccaccatggactggacctggagatcctcttttggtggcagcagccacaggtgcccactcccaggtccagcttgtgcagtctggggctgaggtgaagaagcctggggcctcagtgaaggtttcctgcaaggcttcgaggactacaccttcacgtaggtatgactatacgagttgggacgtaccgccgtacggccccgtaagaaacggcttacggaggtggagttacgggaagtggtaatcgaaacgtctgggtaccaagttacggtaaacaacgtaaaaaacgttcgaactaacgtaacgttacccggaacgggtaccgtaaggtaacggtttaaccctaacccggttttaaacccgtaacggggtaaaccgtaaccgttaaacgttacccggaacggtaacgggttaaccgttttaaacgttttaaccgtaacggttaacgggttaacgtacccggttagtaaccggtaacccggtaaggttacccccggttaagtaaccggttaaccggttaaaccccgggtaaaagttaaccggttaaccggggtacttttaaccgggtttaacgttttaaccggtttttttaggaccggtaccccgggttaacttttaccgggttaacggttacgggttaaccgggtttaaccgtaaacgttttaacggttaaccccggttagtttaaccccgttaaaggtttttacgggaaccccttacccgggtttacccggggtaaccggttaaccccgggttaaacccggttcgggttaacccgttttaccccggtaccgtttacccgttaaccccggg

SEQ ID NO: 260610 - DNA, 896 bp, Homo sapiens
  misc_feature: GYAE6OF01E5GBX.1.5.A05.1.454.CMB.1.raw
  modified_base (234)..(234): a, c, t, g, unknown or other
  misc_feature (234)..(234): n is a, c, g, or t
tcagacgagtgcgtcacgaccggtgctcgatttagatagatagacaggggaccaacaaccacatccctcctcagaacgccccagagcacaacgccccaccatggactggacctggaggatccttctttttggtggcagcagccacaggtcgcccactcccaggtccaggcttgtgcagtcgtggggcttggaggtgaaggaagcccgtggggcctcgaggtagaacggtttccngccaaggtcttacgaggacttacgtaccttcacttaggatgctatatagttggtgcgtccgacggccccggtaacgaaacggtccttaggaacgttggggagttcgggggaatcggtactaccgtaacggtaccgtacgggacgtaaaccgtaaacgggtaaaaacctaaacgtaaaaaaaacctttaacggtaaaccgaaacggttaaacggtttaccggaaaccggggtaactaaacgggtaacggttacctaaacccggttttaaaccgaaacggggtaaccgtaaccgtaacggtaaccggaccgggtaagggttaaacgttttacgttaaactaaggttaccgggtaaggtacgtaaggtaacgggtactaccgggtaccgttaggtaaccgtaagttaccgggaaacgaaccggtacgggtactttaacgggttaacttttaagggtttttcgacgttacccggtaaccgtttacgggttacggtttacggggggtaactaaccgtttaacgtttaacggtttaccgtaccgttaagtttaaacggtttagttaaaacccgtccccggggtttaaagggaccccggggtaaacccgggtttaaccgggtacgttaaacccccggtccggtttaacccgttcccgttaaacccccgg

SEQ ID NO: 260611 - DNA, 261 bp, Homo sapiens
  misc_feature: GYAE6OF01ER4YV.1.5.A05.1.454.CMB.1.raw
  modified_base (254)..(261): a, c, t, g, unknown or other
  misc_feature (254)..(261): n is a, c, g, or t
tcagacgagtgcgtcacgaccggtgctcgatttagatagatagacaggggcagttccagatttcaactgctcatcagcagcctgcagtctgaagattttgcagttttattactgtcagcagtataataactggcctccgacgttcggccaagggaccaaaggtggaaatcaaaacgaactgtggctgcaccatctgtcttcatcttcccgccatctgatcgtactgcgctgagcgggctggcaaggcgcatagnnnnnnnn

SEQ ID NO: 260612 - DNA, 796 bp, Homo sapiens
  misc_feature: GYAE6OF01BHNAA.1.5.A05.1.454.CMB.1.raw
  modified_base (151)..(151): a, c, t, g, unknown or other
  misc_feature (151)..(151): n is a, c, g, or t
tcagacgagtgcgtcacgaccggtgctcgatttagatagatagacaggggacccaacaaccacatccctcctcagaacgcccccagagcaccaaccgccccaccatggactggacctggaggatccttctttttggtggcagcagccacgnggtcgcccacctccccgaggtccagtcttgtgcgagtcgtgggctgaggtgaagacgccgtggggcctcgtagtgtacggttcctgacgaggtcttcgagactacaccttcgactaggtatgactatacctagttgggtcgccggtaccgaccgggaccccggaacgaaggccgttagaaggttgggaggttagggacgtacgtacgtaccgaacggtcgtcggtaacgaagtaccggtaaactaaactaaaaaacgttccaaacgacggtaaacggttccgaagggactaacggtacgtaaccttaacccgttaaccggaaccgggtaaacctaaccgtaccgtaccccgggacgtaacgggttaacttttaaccgtaagtaacggttcggggtacgtacttacggaacggtcaacccgtcggtaggtaacggtaaccgtaacccggaaggtaaccgaccgggtttataacgttttacgttttaacgttttcgggtaccgtaccgttacccgttaggttcgggtagggttacgttaagttacttaaccgttaccgtatttaccgtaggttttacccgacggttcccgggacgggtacccgtacgggttacccttacgggacccttacggtccttacccgtccgg

SEQ ID NO: 260613 - DNA, 890 bp, Homo sapiens
  misc_feature: GYAE6OF01DHOVX.1.5.A05.1.454.CMB.1.raw
  modified_base (153)..(153): a, c, t, g, unknown or other
  misc_feature (153)..(153): n is a, c, g, or t
  modified_base (231)..(231): a, c, t, g, unknown or other
  misc_feature (231)..(231): n is a, c, g, or t
  modified_base (307)..(307): a, c, t, g, unknown or other
  misc_feature (307)..(307): n is a, c, g, or t
tcagacgagtgcgtcacgaccggtgctcgatttagatagatagacaggggacccaacaaccacatccctcctcagaacgcccccagagcacaaccgccccaccatggactggacctggagatccttctttttggtggcagcagccacaggtcncccactcccaggtccagtcttgtgctaggtcgtggggctggaggtagaagagccgtgggcctcgagtgtaaggttccngcgaaggtcctacgaggtactacctaccttacgaacgttaggtatcgtaacttaacgttaccgtaagtttcggggngtcccggacccggtaaccgggacccccgaaagtaaacggtctttaggacggttagggaagttaggggaagtacggtaactaccgaaccggtcgttaggaactaaagttaacggtaaaaccaaacgttaaaaaacttcgaaacgtaacggtaacgttaccgaagggtaccaggtaacgttacctaaacccgtttaccggaacggtaccaagtaccgtcccggaaacgtaggttaactttagttaacgtacggtacgtaacggtactacgtacgtaaccggacgttaccgttacggaacgtaaccggtaaacccgaacgggtaacccggtacggttacttaacgggtttttattttaacgggttttacgtacggttaccccgttacccggtttaggtaacggtttacggggtaacggtttacctttaaacggtttaacgtttacccggttaccctttaacgttttaaacgggtttaccccgtacccgggtttccccgggttaaccgggggtaaccccgttaaccccggggttaacccgggtttacggtttaccgtaaccgtttcccggtttccccggtaaccccg

SEQ ID NO: 260614 - DNA, 715 bp, Homo sapiens
  misc_feature: GYAE6OF01BDCH1.1.5.A05.1.454.CMB.1.raw
  modified_base (232)..(232): a, c, t, g, unknown or other
  misc_feature (232)..(232): n is a, c, g, or t
  modified_base (596)..(596): a, c, t, g, unknown or other
  misc_feature (596)..(596): n is a, c, g, or t
tcagacgagtgcgtcacgaccggtgctcgatttagatagatagacaggggacccaacaaccacatccctcctcagaacgcccccagagcacaaccgccccaccatggactggacctggaggatcctcttttggtggcagcagccacaggtcgcccactcccaggtccagcttgtgcagtctggggctagaggtgaagaacgccgtggggcctacgaggtgtaacggtttccnggcaaggtcttacgaggactaccaccttcacgttaggtatgactatacgtagttgggtcgcgcccgtacggcccccggaagtaaacggtcgttacggagtcgggagttcgggagtggactacgaaccggcgtacggactaaagtacgggtaaaccaaaacgtaaaaaactttcgaaacgacggtaaacgttccgaagggcaaggacgtacccgtaccgtttaaccggagggtacccaaccgtcgtacccgggtacgtaacggtactttaaccgttagtacggtacggtagtcgttagggaacgcgaacgtccgtagacgtacgtacggaacgaaccgcggtactacgttagttacgttttacgngtacccgttactacgtggtaacggtcgtaactagttacttacgcttacgtaacgttcgacgtcccgggtaggacccggtacggtacccgttcggtacccgaccgttccgtcccgtaccg

SEQ ID NO: 260615 - DNA, 768 bp, Homo sapiens
  misc_feature: GYAE6OF01CUSXW.1.5.A05.1.454.CMB.1.raw
  modified_base (678)..(678): a, c, t, g, unknown or other
  misc_feature (678)..(678): n is a, c, g, or t
tcagacgagtgcgtcacgaccggtgctcgatttagatagatagacaggggacccaacaaccacatccctcctcagaacgcccccagagcacaaccgccccaccatggactggacctggagactccttctttttggtggcagcagccacaggtcgcccactcccaggtccagcttgtgcagtcgtgggctggaggtagaagaacgccgtaggggcctacaggtgtaacggtttcctgactaaggtcttacgaagactacctaccttacacgtaacggtatgacttaatacgtaggtttagggtcgaccggacccgaccgggaaccccccggaagtaaacggtccttagggaagttagggaacggttggaacgtcggtaactaccgaaaccggtcgtacgggaactaaagtaacggtaaaaaccgtaaaactaaaaaacgttccaacgtaaacgtagttaaccgaagggacgtaagaccgtaccttaaccgttaaccggaacggtacctaacgtaacgtaccggtaacgtaacgaacgtttacctaacgttaagtacggagtaccgtaggaacgtacaacggtcgtaacgagtaccgtacgaacgtaaccgacggtacttagttaacgttcgttttaggacgtccgtaacttccggtaaggttgtacgtaacgtatttanaccgtattacgtaaagtttccgaccggttaccggttcggggaaccaccggggtaacccttcggacccgttaccgtcccttaacgtacccg

SEQ ID NO: 260616 - DNA, 676 bp, Homo sapiens
  misc_feature: GYAE6OF01EPKXV.1.5.A05.1.454.CMB.1.raw
  modified_base (232)..(232): a, c, t, g, unknown or other
  misc_feature (232)..(232): n is a, c, g, or t
tcagacgagtgcgtcacgaccggtgctcgatttagatagatagacaggggacccaacaaccacatccctcctcagaagcccccagagcacaaccgccccaccatggactggacctggaggatccttctttttggtggcagcagccacaggtcgcccacctcccgaggtccagcttgtgcagtcgtggggctggaggtgaaggacgccgtgggcctcgagtgtaaggtttccngacgaaggcttacgaggtactacctaccttacacgtaggtatgtactatacgtagttgggtcgccgacccgaccggaccccggaagtaacggtcgttaggaggtggagtggagtggacgtacgacgcgtacggatagtagtaacaaataaaactcgaacgtagtaacgtacgagggacagtacgtaccttaaccgttacgaaggtaccacgtcgtaccgtacggtaaggttaatttacgttaagttaaggtaggtacgtacgtagacgacgtacgtccgtagacgtacgtaccgaagaccgtacggtagttagtttagttttgtttacggtacgtacgtaccgttgtaggtcggtagtacttatacgttactcttaacgttattcggtactcccgggtacggtaccgtaccgggtccgtacgtacccgtccgttcctcgtaccg

SEQ ID NO: 260617 - DNA, 828 bp, Homo sapiens
  misc_feature: GYAE6OF01BBKAX.1.5.A05.1.454.CMB.1.raw
tcagacgagtgcgtcacgaccggtgctcgatttagatagatagacaggggacccaacaaccacatccctcctcagaacgcccccagagcaccaaccgccccaccatggactggacctggaggatccttctttttggtggcagcagccacaggtgccccactcccaggtccagtcttgtgcagtcgtggggctggaggtgaagaagccgtggggcctcgagtagtacggtttcgtgacaaggtcttcgaaggtataacctaccttcgaacttaggtatgtactaatactagttgggtacgccgaccgacggaccccggaacgaaacggtccgttaggtacggtgggaggtagggtacgttagggactaccggaacgtcgtacggactaaagtaacggtaaaccgtaaaactaaaaaacgtcaaacgtaaggtaaacggttccgaacgggtacaagtacgttaaccgtaacccgtttaaccgaagggtaaccaacgtacgtaccgggtacggtaacgttaacgtttacttaacgttagtacggtacgtctacggacgacgcgtacgtagggaacgtacgtaaccggaaacgaccgtaacggtactttaggtttaacgttttagtttttacgggtaccgtaccgggtacctttaacgggtttacggacggggtttacgttaaccgtttaagtttaacgtttaccgtaccggtttaacgttaacgttttaccggtaccggttccccgggttaagggcccccggttaaaccgggggttacccccttacggggttacccggttaaccccgttcccggttacccgtaaccccggg

SEQ ID NO: 260618 - DNA, 622 bp, Homo sapiens
  misc_feature: GYAE6OF01ATZQJ.1.5.A05.1.454.CMB.1.raw
  modified_base (318)..(318): a, c, t, g, unknown or other
  misc_feature (318)..(318): n is a, c, g, or t
  modified_base (511)..(511): a, c, t, g, unknown or other
  misc_feature (511)..(511): n is a, c, g, or t
  modified_base (556)..(556): a, c, t, g, unknown or other
  misc_feature (556)..(556): n is a, c, g, or t
  modified_base (570)..(570): a, c, t, g, unknown or other
  misc_feature (570)..(570): n is a, c, g, or t
tcagacgagtgcgtcacgaccggtgctcgatttagatagatagacagggacccaacaaccacatccctcctcagaagccccagagcacaacgccccaccatggactggacctggaggatcctctttttggtggcagcagccacaggtcgcccactcccgaggtccagtcttgtgcagtctggggctggaggtgaagacgccgtcggggcctcgaggtgtaaggtttcctgaccgaaaggtcttacgaggtactacctaccttcacgttaggtatgactagtacgtagttgggtcgaccgtccggaccggacccggaanaacggtctggtagtgggaggtggagcggtacacgacgctaggacagtacgtaacaaactaaaacgtccaacgtagtacgtacgagggctaacgtcgtaccgtaccttacggacggtaccacgtcgaccgagtaaggtaattacgtaagtcgtaggatcgtagactgaacgctagacgacctacggaagaccgngtactagttaagtttcgttcgtacgccgtctagtagtcggacgtntagtaccgtacgtntactagttcacgttcggacggtaccacggtacctcggtcaccgtctccgtac

SEQ ID NO: 260619 - DNA, 731 bp, Homo sapiens
  misc_feature: GYAE6OF01DXL3E.1.5.A05.1.454.CMB.1.raw
  modified_base (137)..(137): a, c, t, g, unknown or other
  misc_feature (137)..(137): n is a, c, g, or t
  modified_base (233)..(233): a, c, t, g, unknown or other
  misc_feature (233)..(233): n is a, c, g, or t
tcagacgagtgcgtcacgaccggtgctcgatttagatagatagacgagggacccaacaaccacatccctcctcagaacgcccccagagcacaacgccccaccatggactggacctggaggactccttcgtttttggnggcagcagccacgaggtcgcccactcccaggtccagtcttgtgcagtcgtgggctggaggtagaagacgccgtgggcctcgagtcggtagtttccngaccgaaggtctacgacggtactacctaccttacgagttaggtactcgtacttacgtacgtaggttcgggtcgaccggacccgaccgggaccccggaagtaacggtcgttggacggttggagttagggagtaggactaccgaacggcgtacggataagtaacggtaaaaccaaacgtaaaaactcaacgtaagtaccgttacgaggacagtactaccgtaaccgttaccggacggactacgacgtccggagtaagttacttagtatagtgacgtcgtagagacgacgtccggtagacgtaccgtacggaacgaccggtacgttcgttagtttacgtttcgtttacggtccgtaccgtacttagggtaggtaggtacgttacgttaacgttcgttaccgtacttacgttaacggtttaccgcccggttaacgggtaccggtaaccggaacccgggttccgttaacccggttcccgtaacccgttcccgtccgtaacccg

SEQ ID NO: 260620 - DNA, 706 bp, Homo sapiens
  misc_feature: GYAE6OF01D4S65.1.5.A05.1.454.CMB.1.raw
  modified_base (232)..(232): a, c, t, g, unknown or other
  misc_feature (232)..(232): n is a, c, g, or t
  modified_base (324)..(324): a, c, t, g, unknown or other
  misc_feature (324)..(324): n is a, c, g, or t
  modified_base (502)..(502): a, c, t, g, unknown or other
  misc_feature (502)..(502): n is a, c, g, or t
tcagacgagtgcgtcacgaccggtgctcgatttagatagatagacaggggacccaacaaccacatccctcctcagaacgcccccagagcacaaccgccccaccatggctggacctggaggatccttctttttggtggcagcagccacgaggtcgcccactcccgaggtccagcttgtgcagtcgtgggtctggaggtgaagacgccgtggggcctgagtgtaacggtttccngacaaggtcttacgaggacttacctaccttcgacgtaaggtatcgtactaagtacgtaagtttgggtcgccgtccgaacgggaccccggaanaaacggtcttaggaggttggaagtgggagtaggactacgaacgcgtggacaagtagaaacaaactaaaaatcgaacgaagtaacgtcgaacggacgtacgacgtaccgtaaccgttacgaacggtacacgacgtaccgacggaaggttattaacgtagtacgtagtagtatggacgtnaacgtcctaggaataccgacgacgacgacggtacttagttattagttttcgacgttaccgtaccttggtacggttagggtactttacgtaagtttaacgtttacgtacgttagttacgtttacggtaccgttcccgggtacgggtacccggtaaaccgggttccccgttacggtacccttaacccggtccttcccggtaacccg

SEQ ID NO: 260621 - DNA, 807 bp, Homo sapiens
  misc_feature: GYAE6OF01DEK7B.1.5.A05.1.454.CMB.1.raw
  modified_base (137)..(137): a, c, t, g, unknown or other
  misc_feature (137)..(137): n is a, c, g, or t
  modified_base (181)..(181): a, c, t, g, unknown or other
  misc_feature (181)..(181): n is a, c, g, or t
  modified_base (230)..(230): a, c, t, g, unknown or other
  misc_feature (230)..(230): n is a, c, g, or t
tcagacgagtgcgtcacgaccggtgctcgatttagatagatagacgagggacccaacaaccacatccctcctcagaacgcccccagagcacaaccgccccaccatggactggacctggagactccttcgtttttggnggcagcacgccacgaggtcgcccacctcccaggtccagtcttgngcagtcgtgggctggaggtagaagacgccgtgggcctgagtgtagttcngacgagtctagagactaccgtaccttgacgtaggtatcgacgttatacgtggttcggtcgccgtaccgaccggacccgaagtaacggtcttaggacggtggtaggtcggtagtggtactacgtaccgcgtacgaacgtaagttaacgaaacaaaactaaaacgttacgaacgtaagtaaccggttacgaggtacgacggtacctaccgtaaccgttacggacggtactacgtacgtaccggacgtaagttacttaacgttatagtacggtacgtcgtagtaccgacgtacgacgtagacgtaacccgtacaacggtacgtcggtacttagtttacgtttacgtttcgacggttaccttaacccgggttgttaaagggttacccggggttttaagtaaccccgttttaagttttaaacccgggtaccctttaaacgttttacccgttttaacccggtttacggtaccccccggtttcggggtacccccgggtttaacccgggttaaaaccccgggtttacccgtttcccggggtaaaccccctttcccccgggttttactcccccccggttaaacccg

SEQ ID NO: 260622 - DNA, 704 bp, Homo sapiens
  misc_feature: GYAE6OF01E3P8X.1.5.A05.1.454.CMB.1.raw
  modified_base (173)..(173): a, c, t, g, unknown or other
  misc_feature (173)..(173): n is a, c, g, or t
  modified_base (192)..(192): a, c, t, g, unknown or other
  misc_feature (192)..(192): n is a, c, g, or t
  modified_base (206)..(206): a, c, t, g, unknown or other
  misc_feature (206)..(206): n is a, c, g, or t
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
  modified_base (697)..(697): a, c, t, g, unknown or other
  misc_feature (697)..(697): n is a, c, g, or t
tcagacgagtgcgtcacgaccggtgctcgatttagatagatagacaggggacccaacaaccacatccctcctcagaacgcccccagagcacaaccgccccaccatggactggacctggaggatcctcttttggtggcagcagccacaggtgcccactcccaggtccagcttgngcagtctggggctgaggtnagagcctgggcctnagtgaggttccngcacggctcaggtntacctaccttcacgttaggtatggtacctatacgtattcggggtcgtccggccctacgggccccccggaagtaaaacggtcgtacgaaggttgggtaagtgggggacttagggtacgtccgaacggcgtcgggtacaaagtcgtaaaacgtaactaaaaattcccgaaacgtaggtaacgtttacccgaaggggaccaaggtaccgtaccgtaaacccgtttacccgaagggtaccacgtacgtccgggacggtaacgtactttaacgtacgtaagtcggaacgtcgtaggtacgacgtcgacctggaacgtacgacgtaacgacgtacggtctaggtattacgttttgacgtccgtaacgtcgtaggtacggtacggttactcggttacttacgcttacaacggtttcgaaccgttccggtacgggtcccgaacgggttacccctggttaaccctcccgttccncgtaccg

SEQ ID NO: 260623 - DNA, 1040 bp, Homo sapiens
  misc_feature: GYAE6OF01B04PY.1.5.A05.1.454.CMB.1.raw
tcagacgagtgcgtcacgaccggtgctcgatttagatagatagacaggggacccaacaaccacatccctcctcagaacgccccagagcacaaccgccccaccatggactggacctggaggattccttctttttggtggcagcagccacgaggtcgcccactcccgaggtccagtcttggtgacaggtcgtggggctggaggtaggaaacgacggtccgtcggggtccctacgaggttacggtaacgggttttccctacggacgtaacgggtccttacgaacggtaacttaaccctaccctttaccgtacgttaacgggttactcggtaaccttagttaaccgtaggttttcgggggtccggaccggtaccccggaaccggggtaccccccgggaaacgtaaaacggggtcctttaggggaagggttacggggtaacggttggggggtaaacgttaggggaacctttacccgggaaacgggttacccggtacggggtaaccctaaaagggtttacggggttaaaaacccctaaaaaaccgtaaaaaaaacgttttcccgaaaacggtaaaaccggttaaacccggtttaaccccggaaaggggggtacctaaacggtaaccgggttttacccctaaaccccggttttaaaccggaacccggggttaaccacggtaaccgttacccgggacggtaagggttaaccgttttaacgtttacgtaaaggttcgggaacgtacggttacgaacggtacggtaccggtaccgtagggtaccggtaccgaacccggtaaacgggaacccgtaacgggttacgttaacgtttaacggtttacgtttttccggtaacggtacccgttaccgtttacccggttaggtacccggggtagttccgttaaatttacgttaccgtacccgttttaagttaacgtttaccggtaacccggttccgggttaacccggggtacccggtaaacccggggttaccccgttcccgggttaaaccccgttcccggtttaaccggttcccccgttaacccggg

SEQ ID NO: 260624 - DNA, 980 bp, Homo sapiens
  misc_feature: GYAE6OF01AJMUB.1.5.A05.1.454.CMB.1.raw
  modified_base (139)..(139): a, c, t, g, unknown or other
  misc_feature (139)..(139): n is a, c, g, or t
tcagacgagtgcgtcacgaccggtgctcgatttagatagatagacagggacccaacaaccacatccctcctcagaacgcccccagagcacaaccgccccaccatggactggacctgggaggtactccttctttttgggnggcagcagccacgaggtccgccccacctcccgaggtcccaggtcttgtcggactggttcgtgggggtctaggtagggtagaaagggacggcccggttcgggggccctacgtaagggttcggttaaccgggttttcccagggtaaccgtaacggggtttccttaaccggaagggtaacctttaacccctaacccgttttaccgaaacgttaacgggtttaacttcggtaacctttaaacgttaacggttacggttttcggggggtacccggcccccgaacccccggggtaacccccggggggtaaccccccggtaaacgggtaaacccgggttcggttttacggggaaggggtacgggggtaagggtaccggggttaggttacgggaaaccgtaaccggtaacccgggtccggttaacggggtaaacctaaaccgggttaaacggtaaaaacccctaaaaacttaaaaacgttacgaaaccggttaacggttaaaccggttaccgaaacgggtacaacggttaacccgttaccgtttaacccggttaaccggaccggtaaccctaccgggtaaccgtacccggacggtttaacggttaaacttttaccgtttaaagacgtttagggaacgttccgtaaggctaaccggccgttacgagtaccggtaacgaccggaacgtccgtagtagtttacgttacgttttgttaccgccgtaccgttagtggtacgggttagtacgttaccgttattacgtccgtaaagttccgtttaaggcccgttacgggccccggttggaaacccgggtcttaccccggtcgtccctaccggttccctacgacccg

SEQ ID NO: 260625 - DNA, 758 bp, Homo sapiens
  misc_feature: GYAE6OF01D3I6C.1.5.A05.1.454.CMB.1.raw
  modified_base (242)..(242): a, c, t, g, unknown or other
  misc_feature (242)..(242): n is a, c, g, or t
tcagacgagtgcgtcacgaccggtgctcgatttagatagatagacgaggggacccaacaaccacatccctcctcagaacgcccccagagcacaaccgccccaccatggactggacctggagtattccttcgtttttggtggcagcagccacgaggtcgcccactcccaggtccagtcttgtgcgtagtcgtgggtctggaggtgaaagacgccgtggggcctcgaggtagtaacggtttccngacgtaacggtcttacgaaggtactaactccttacaacgttagtatgtactaatacgtgttggtcgccgaccgaccggacccggtaagaacgtcgtaggtaggtaggtagtaggtagtagacgtacgaacgtgtacgaacgtaagtaacgtaaaaccaaaactaaaaacgtcgaagtaaacgtaacgtacgtaaggacgtacgtaacgtaccgtaaccgttaaccgaacggtactaacgtacgtaccgaggtaagttaacttaacgttagtagttacgacgtagtagtacggactacgtacgagtacggtacgtacggaaacgaccgtaacggttactttaagtttacttttaagtttacgggcgtaccgttaccgttagtacgggttaaggtacgtaacgtttaacgttaacgtacctacgttacgttacgtttaacggccgtaaccgggttccgggaaccggttaccggtaaaccggttccgttaaccgtacccgttcccgtacccgtacccgg

SEQ ID NO: 260626 - DNA, 771 bp, Homo sapiens
  misc_feature: GYAE6OF01EN35B.1.5.A05.1.454.CMB.1.raw
  modified_base (275)..(275): a, c, t, g, unknown or other
  misc_feature (275)..(275): n is a, c, g, or t
tcagacgagtgcgtcacgaccggtgctcgatttagatagatagacaggggacccaacaaccacatccctcctcagaacgcccccagagcacaaccgccccaccatggactggacctggaggatccttctttttggtggcagcagccacgaggtcgcccactcccaggtccagcttgtgctagtcgtggggctggaggtagaaagaggcccgtggggcctacgaggtcggtaaggtttcctggaccgtaaggtccttagaggtactacctaccttnaacgttaggtactgtaccttatacgtaggttgggtcgccgcccggaccggaccccggaacgaaacgggtccgttaggacggttgggtaggtacggggtagtacgggtactaccgtaacggtccgtacggacgtaacgtacggtaaaaccaaacgtaaaaaacgttcaaacgaagtaacggttaccgacgggactaaggactaccttaacccgttaccggaacggaccacacgtaccgacggtagtaactttacgtagtagtagggtacgtacgtagtacgacgtacgacgtagtacgtacgtaaccggaacgtacggacgttcgttagtttaactttgttttacggtcggtaccctaccgttcggttaggtacggttacgttactaacgttacttaccggtacttaacgttacgtttagacccgttccgggaccgggttacccggaaaccggggttaccctaccgggttaccctacccgttccttacccggtaccg

SEQ ID NO: 260627 - DNA, 188 bp, Homo sapiens
  misc_feature: GYAE6OF01B283L.1.5.A05.1.454.CMB.1.raw
  modified_base (178)..(188): a, c, t, g, unknown or other
  misc_feature (178)..(188): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctcgtactgcgctgagcgggctggcaaggcgcatagnnnnnnnnnnn

SEQ ID NO: 260628 - DNA, 944 bp, Homo sapiens
  misc_feature: GYAE6OF01AG0MQ.1.5.A05.1.454.CMB.1.raw
  modified_base (264)..(264): a, c, t, g, unknown or other
  misc_feature (264)..(264): n is a, c, g, or t
tcagacgagtgcgtcacgaccggtgctcgatttagatagatagacgacggggacccgaacaaccacatccctcctcagaacgccccagagcacaacgccccaccatggactcggacctggtacggactccttcgtttttgggcggcagcacggacccagtacggtcgcccgacgtcccgaggttccgaggtccttgtgcgagttcggtgggactggacggtagaaggtacgccggtcgggctacgaggtagtaacggtttcccnggacgtaacgggtcttacggaaggtactaaccgtaccgttccgtaacgttaggtacttcgtacctttacgttaccgtaggttcggggtaccgtccggaccgtacccgggaccccggtaataacgggtcgttacggacggttagggacgtggggactacgaggtaccgacggcgtaggagtaacgtaacggaaaactaacgtaaaactacgtaacgaaggtaacgttccgaagggctaaacggtaccgtaccgttaacccgttacggaacggtaccgtaacgaccggtttaccggaccgtaagggtttaacctttaacggttacgtaacggtcgggtaccggtaacggtacgtaacggaccctaacgggttccgttaacgtccggaacccggttaacgggtaaaccgaccggttaaccccgggttatttaaccgtttaagggttttcgtttttacccggtaacggtttaacccggttaccgtttacgggttaaccgggtacgggttttaacccggtaatttaccggttacgggttaacctacccggttttaaggtaaaccgggtttccgggtaaaccggtttccggggaccccggggttaaacccgggttaccggggttaacccccggttcccgggtaaacccggttacccccggtttccgtttaaaccccggcccccggg

SEQ ID NO: 260629 - DNA, 841 bp, Homo sapiens
  misc_feature: GYAE6OF01A49PS.1.5.A05.1.454.CMB.1.raw
  modified_base (133)..(133): a, c, t, g, unknown or other
  misc_feature (133)..(133): n is a, c, g, or t
  modified_base (151)..(151): a, c, t, g, unknown or other
  misc_feature (151)..(151): n is a, c, g, or t
  modified_base (189)..(189): a, c, t, g, unknown or other
  misc_feature (189)..(189): n is a, c, g, or t
  modified_base (195)..(195): a, c, t, g, unknown or other
  misc_feature (195)..(195): n is a, c, g, or t
  modified_base (249)..(249): a, c, t, g, unknown or other
  misc_feature (249)..(249): n is a, c, g, or t
tcagacgagtgcgtcacgaccggtgctcgatttagatagatagacaggggacccaacaaccacatccctcctcagaacgcccccagagcacaacgcccaccatggactggacctggaggatccttcttttggnggcagcagccacaggtcncccactcccgaggtccagtcttgtgcagtcgtaggacncgtagngtcgtgacgaggaacgccggtcggggccctcgaggtaggagttcggtcctccgngacgtagtcgttcgtttcgtcggttaacctcttttcctttacccgaccgttaacggttagttagtaaggtttcgggttacgaacggtacccgaccgggtcccccgggagggtacgggtcgtacggtaggtaggtacggtagggtaggtcggtactccgtaccggtacccgttaaacggaaaccgtaaagtacggttaaggtaaggtaggtaaggtaacggtaccgttacgggacgggtacgaaggtaccgtctacgtacgtacgtaacccggtaccggaccggtaaccgaacctaccggtacccgtaaccggtacgtaaccgtaccgtacgtaacgttagggtaacggttaaccggagggtaaccggtaccctaccctaggacttaccggtaccgaccgggtaacccgcccggtaacccggttacctttaaaccgtttagtaccggttccggaaccggtacgttaaacggtacgtttacgttttacggaccgtacccggttccggttccggtaccggttacggtacccgttaacccgtacccgttacggtttacggttacgggaccggtcccggtacgggggtacccccggg

SEQ ID NO: 260630 - DNA, 734 bp, Homo sapiens
  misc_feature: GYAE6OF01ELCYY.1.5.A05.1.454.CMB.1.raw
  modified_base (133)..(133): a, c, t, g, unknown or other
  misc_feature (133)..(133): n is a, c, g, or t
  modified_base (153)..(153): a, c, t, g, unknown or other
  misc_feature (153)..(153): n is a, c, g, or t
  modified_base (177)..(177): a, c, t, g, unknown or other
  misc_feature (177)..(177): n is a, c, g, or t
  modified_base (228)..(228): a, c, t, g, unknown or other
  misc_feature (228)..(228): n is a, c, g, or t
  modified_base (388)..(388): a, c, t, g, unknown or other
  misc_feature (388)..(388): n is a, c, g, or t
  modified_base (441)..(441): a, c, t, g, unknown or other
  misc_feature (441)..(441): n is a, c, g, or t
  modified_base (484)..(484): a, c, t, g, unknown or other
  misc_feature (484)..(484): n is a, c, g, or t
  modified_base (491)..(491): a, c, t, g, unknown or other
  misc_feature (491)..(491): n is a, c, g, or t
tcagacgagtgcgtcacgaccggtgctcgatttagatagatagacagggacccaacaaccacatccctcctcagaacgcccccagagcacaaccgccccacatggactggacctggagatccttctttttggnggcagcacgccagaggtccncccacctcccaggtccagtcttgngctagtcgtgggctggaggtagaagacgcgtcggctcgagtgtaacgttcngacgagtctagagtacttacctaccttatagttagtctagactagtacgtaggttggcgccgacccgacccgggacccgaagtacgtcgttcggaggtgggtagtgggagtcggtacgtacgacgtcgtaggactaaaggtacgtaaaacaaactaaaanctaacgacgtaacgcgagacgtagtacgttacctaacgtacggacgacgtacncgtccgaagtacgttaacttaactaggtacgaggtactggtanaccggtntacggaggtacgacgtaaccgaacggtaacgcgtaaccggttctttaaggttacttttacgggttttacgccggttaacccgttaaggtttccggtagggttacggttaaccgttattaccgtttaactttcccggtaatttacgggtaaccgtttacggcccggttaacccggggaaccggttcccgggtaaacccggttaccgtaccgttacccccgtgttaacccccttggtaacccccg

SEQ ID NO: 260631 - DNA, 688 bp, Homo sapiens
  misc_feature: GYAE6OF01E0A2H.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtcccagcttgtgcagtctggggctgaggtgaagagccgtggggcctcgagtgaggtttcctgcgaaggtcttcaggactacaccttcacgtaggtatgactatactagttgggtcgcgccgacggccccggaacgaaacggtcgtgaggtggagtgggatgggactcgaacggcgtggactaagtaggtaaacaaactaaaaagttcaacgtaagtaaacggttaccgaggggacaggacgtccgtaacccgtttaacgacgggaccaacgacgtccggacgaaggtactttaacgttatagtggagtcgtgaacgcgacgccgtagacgtacgtaccggaagaccgacggtacttagttaacgtttagttttacgacgtaccgtaccgttacgttaggtcggtacggttactaacgtttacgttaccgtccgttaacgttacgtttacggtaccgttcccgggtcggggtacccgtaaccgggttacccggttacgggtacccctacccggttcgtcccgtaccg

SEQ ID NO: 260632 - DNA, 651 bp, Homo sapiens
  misc_feature: GYAE6OF01ENXP1.1.5.A05.1.454.CMB.1.raw
  modified_base (285)..(285): a, c, t, g, unknown or other
  misc_feature (285)..(285): n is a, c, g, or t
  modified_base (515)..(515): a, c, t, g, unknown or other
  misc_feature (515)..(515): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggactacaccttcacgtagtatgctatacgattggtgcgcacggccccgaanaaaggcttggagtggactgggatggagtcgaacgcgtggaccaagtggtaaacaaactaaaaaattcaacagaagttccgaggacagacgtctaacccgtttacgaggacaacagtacccgaggacggtactttaacttataagtgggaatcgtagagacgaacgccgtagacgtaagtacccgaagccgaacggcgttagttacttagtttttgtcgtacgtacccttnttagggtacggaacggttctaaacttttagttaccgtcgtttaacgtaacgttttagaaccgttccgggtaccggggtaccgtaaaccggggtaccctttacgggtaccctaccccggtttcgtccccgttacccg

SEQ ID NO: 260633 - DNA, 838 bp, Homo sapiens
  misc_feature: GYAE6OF01CXLMY.1.5.A05.1.454.CMB.1.raw
  modified_base (137)..(137): a, c, t, g, unknown or other
  misc_feature (137)..(137): n is a, c, g, or t
  modified_base (155)..(155): a, c, t, g, unknown or other
  misc_feature (155)..(155): n is a, c, g, or t
  modified_base (227)..(227): a, c, t, g, unknown or other
  misc_feature (227)..(227): n is a, c, g, or t
  modified_base (659)..(659): a, c, t, g, unknown or other
  misc_feature (659)..(659): n is a, c, g, or t
tcagacgagtgcgtcacgaccggtgctcgatttagatagatagacgaggggacccaacaaccacatccctcctcagaacgccccagagcacaaccgccccaccatggactggacctggagacttccttctttttggnggcagcagccacaggtcncccactcccgaggtccagcttgtgcagtcgtgggctggagtgaagacgcgtgggcctgagtgtacgtttccngacaggtcttcgacggtactacctaccttcgaacgttaggtactcggtacttaacgttacgtaggtttcgggtcgtacccggacccggaacccgggacccccggtaaagaaacgggttccgtttaggacggggttaggtagggttacgggtagtaggtaacgttacccgaacggtcgtaacggactaaacggttaacggtaaaactaaaacgtaaaaacttccgaaacgtaacggtaacgttaccggagggtacgtaaccgtcgtaacccgttaacccgttaacgacggggtaacccactaacggtcccgtaggaggttaactttaacggttagtaggtacggacgtcgtaggtaacgcgtaaccgtcgtagtaacggtaaccgaccggtaacggaccgttaggtacgtttagtttagttttacggttttanaccggtacccgttacgttaggttaccgggtaagggttaccgtttaacctaacggttttaacctacgtccgtttaacgttaaggttttcccggtaaccggttacccggggttccgggtaaacccgtaccggggtaccccgtttacggtacccccgttccgttaccctcccggttaccccg

SEQ ID NO: 260634 - DNA, 820 bp, Homo sapiens
  misc_feature: GYAE6OF01CBD59.1.5.A05.1.454.CMB.1.raw
  modified_base (134)..(134): a, c, t, g, unknown or other
  misc_feature (134)..(134): n is a, c, g, or t
  modified_base (239)..(239): a, c, t, g, unknown or other
  misc_feature (239)..(239): n is a, c, g, or t
tcagacgagtgcgtcacgaccggtgctcgatttagatagatagacaggggacccaacaaccacatccctcctcagaacgcccccagagcacaaccgccccacatggactggacctggagatccttctttttggnggcagcagccacagatcgcccactcccgaggtccagtcttgtgcagtcgtggggctggaggtagaagacgccggtgggccctagaggttacgtaacggttttccnggactaacgggtcttacgaaggtacttacctaccctttcgaacgttaggtactgtaccttaataccgtaggtttcggggtcgacccggtacccggaaccgggaccccccggaaagaaacggtcgtttacggaggttagggaacggtggggacttcgggactccgaaaccggtcgtaggactaaggttacggtaaacaaaacgttaaaaacttcaacgtaacggtaacgtaccggagggactaaggtacgttacccgttaaccgttacgggaacgggtaccaaccgtacggtcccgaaccggtaggttaactttagttaacgtggtacggtacgtacgttacgggacgtacgtaccgttccgtaagacggacctaaccgggaacgacggtacggttcttacggtttaattttcggtttagaccggtccgttaccgttagttacgggtacgttacggtactttaacgttaccgtaacgttaccgtttacgttacgttacccggttcggtacccgggtaccgggtaacccggtaaccccgggtaccgggttaccgtccccggttaacggtccccgttaaccccg

SEQ ID NO: 260635 - DNA, 806 bp, Homo sapiens
  misc_feature: GYAE6OF01C3WPX.1.5.A05.1.454.CMB.1.raw
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (271)..(271): a, c, t, g, unknown or other
  misc_feature (271)..(271): n is a, c, g, or t
  modified_base (274)..(274): a, c, t, g, unknown or other
  misc_feature (274)..(274): n is a, c, g, or t
tcagacgagtgcgtcacgaccggtgctcgatttagatagatagacaggggacccaacaaccacatcccctcctcagaacgcccccagagcacaaccgccccaccatggactggacctggagattccttcttttgggtggcagcagccacaggtcgccccactcccaggtccagtcttgtgcaggtcgtggggctggaggtgaaagagccgtgggcctcgagtgtaacggtttccngacgagtctnaggtctaccgtaccttacactaggtntgntactactagttggtcgccgacccgaccgggaccccgaagtaaacggtcttacggaggtaggtacggtagggtagtacggtataccggaacgcggtaggacaaagttacggtaaacaaactaaaactccaaagtaacgaacggttaccggagggtaacgacggtacgttaaccctaccgtttaaccggacggaacctacgtaccggtcggtacgtaaggttaacttacggttaagtacggtaggtacgtacgtagtacgaccggttaacgaccgttacgtaaccgaacggtaaaccggaaccgtaaccgtacggttacgtttaacttttacgggtttttaacttttcggttacggtaaccgtttccgttaggttaaggggttacggttacggtattttaacccggttaagttacgttaccgtttaacgtttaacgtttacccggttacggttccccgggtaacgggggttaccccgttaacgggtaccccggttacggttaccccgtaccggttccctcccccggttaaccgg

SEQ ID NO: 260636 - DNA, 786 bp, Homo sapiens
  misc_feature: GYAE6OF01E03B4.1.5.A05.1.454.CMB.1.raw
tcagacgagtgcgtcacgaccggtgctcgatttagatagatagacaggggacccaacaaccacatccctcctcagaagcccccagagcacaaccgccccaccatggactggacctggaggatccttctttttggtggcagcagccacaggtgcccactcccgaggtccagcttgtgcagtcgtggggctgaggtgaagagccgtggggcctcgaggtgtaacggtttcctgacgaagggtccttacgaaggtactaccgtaccctttcaacgttaggtatgcttatactagtttgggtgccgccgacggcccccggaacgaaacggtcgttggaggttcgggagtgggtagtaggatacgaacggtcgtagggactaagtagggtaaacaaacgtaaaaaacttcgaaacgtaagtaaacggttaccgaaggggacgtaaggtaacgttaccctaaacccgttttaccggaaggtaaccgaactaaccgtccggtaccggtacgggttaacgtttaacgtttaacgtttaagtaggtacggtacgttaggtagaaccgtacgtaaccgtacgaacggtaacgtaaccggtaacggaaccggtaccgtacgttagttacgttttaagtttttacgttacggtaccgttaccgttaccgttaggtacggttaggttaaccttagtttaacttaccgtacgttaacgttacgtttagttaccggtccggttaccgggtaccggaccggttaacccggtacgttacgttcccgtccgtacccgttacccg

SEQ ID NO: 260637 - DNA, 728 bp, Homo sapiens
  misc_feature: GYAE6OF01AE4S1.1.5.A05.1.454.CMB.1.raw
  modified_base (452)..(452): a, c, t, g, unknown or other
  misc_feature (452)..(452): n is a, c, g, or t
  modified_base (601)..(601): a, c, t, g, unknown or other
  misc_feature (601)..(601): n is a, c, g, or t
tcagacgagtgcgtcacgaccggtgctcgatttagatagatagacagggacccaacaaccacatccctcctcagaacgcccccagagcacaaccgccccaccatggactggacctggaggatccttcttttggtggcagcagccacaggtcgcccactcccaggtccagcttgtgcagtcgtggggctgaggtgaagaagccgtggggcctcaggtgtaaggtttccctggacgtaacggtcttacgaggtataacctaccgttcaacgttaggtatcgtactatacgtagttgggtcgccgaccgtaccgggaccccggtaacgaaacggtcgttaggacggttaggtaggtggggtatcgggaataccggaaacggcgtacggtaccgtaaagttacggtaaaccaaacgtaaaaactttaccaacgaacggtaaaggttaccagggganaacggtactaccgtaaccgttaacgaacgggtaccaagtacgtcgaccgtaggtaacttacttagtagtcggatcgtagtagaccgacggtacacggtaagaacctaccggaagaccggtacggtcttagttaacgtttgtttacggtntaccgtacggttacctgggttaaggtacctagttaattacggttactacgttactaagtttccgacgttcccggacgggtactaacccgggttaccgtacggtaccctccggttccgtccgtacccg

SEQ ID NO: 260638 - DNA, 960 bp, Homo sapiens
  misc_feature: GYAE6OF01ESBRZ.1.5.A05.1.454.CMB.1.raw
  modified_base (204)..(204): a, c, t, g, unknown or other
  misc_feature (204)..(204): n is a, c, g, or t
  modified_base (781)..(781): a, c, t, g, unknown or other
  misc_feature (781)..(781): n is a, c, g, or t
tcagacgagtgcgtcacgaccggtgctcgatttagatagatagacaggggacccaacaaccacatccctcctcagaacgcccccagagcacaaccgccccaccatggactggacctggaggactccttcgttttggtggcagcagccacgaggtcgcccaccgtcccaggttcccagtcttgtcgcgtacggttcgtcgggggntggaagggtaggaaaggaacggtcccggtccgggggtcccttacggacgggttaggttaaccgggttttccgtaggtaccggaaaccggttcgtttaccggaacgggtaaccttaacccgttaccttaccgtaacggtttagggtactacgtaacttaagtaccgttacggtttcggggtaccgacccggaccccgggaacccgggtacccccggtaaaggtaaacgggttccgttagggtacggtagggtaacggttaggggacgttacggtactacggtaacgtacggtacgtaccgtaagtaaaccggtaaacaaaaacgtaaaactacgtaacgtaacggtaacggacgtaacgggtacgtaacggtaccgtaacccgttaacccgtttaaccggaacggtacccgtaacgtaccggtacccggtaagtaacgggttaacttttaacggtaagttaggttaaccggaacgttcgtagggtaaccgtaaccggtcgaaaccggtagtaaccgaccgggttaacccggaaacggtacccggtgtttccggttaagtttacggttttgtttaaccncggggttaaacccccgttagttaccggggtttaagggtccggttaaaccggttacgttaattaaccccggtttaggtccctttaaacgttcgtttaccccgtcgggttacccgggacccgttaacgggttacccgttccggttacccggttaacgccccggttttccaaccggttcccg

SEQ ID NO: 260639 - DNA, 869 bp, Homo sapiens
  misc_feature: GYAE6OF01BAO19.1.5.A05.1.454.CMB.1.raw
  modified_base (273)..(273): a, c, t, g, unknown or other
  misc_feature (273)..(273): n is a, c, g, or t
tcagacgagtgcgtcacgaccggtgctcgatttagatagatagacaggggacccaacaaccacatccctcctcagaagccccagagcacaacgccccaccatggactggacctggaggatcctctttttggtggcagcagccacaggtgcccactcccaggtccagcttgtgcagtctggggctgaggtgaagagcctggggcctcgagtgaaggtttcctgcaaggcttcaggatacaccttcacttaggtatcgctatacagtttcgggtnccgaccgacgggtacccccggaagaaacggtccttaggtacggtgggagttaggggattgggaacttacgaaccgtcgtcgggacaaagttacgggtaaaacctaaactaaaaaaacgtttacaaaccgaacggtaaacggtttaccccgaaagggggtacctaaacggtaccggttaacccgtaacccgtttttaaaccggaaacggggtaccctaaaccgtacgtaaccccggacgggtaaggttaaccgttttaacgttaattaacggtaagggtagtaccgttaggaaggacctaacgggtcccgtacggaaaggtaacccgttacccgggaaaacggacccggtaacggggtaccctttaagggtttaacgttttaggttttttaacggtaccggtacccggttaacccgtttaccggtaaacgggtttcggggtaaacgggtttccttaaaacgttttacggttaaaccggttccctttaaacgtaaacgtttttccggaaacccgtttcccgggttacggggtaccccgtaaacccggggttacccgtttacggtaccccggttacccgttcccgtttaccgaccccgg

SEQ ID NO: 260640 - DNA, 880 bp, Homo sapiens
  misc_feature: GYAE6OF01B46D2.1.5.A05.1.454.CMB.1.raw
  modified_base (226)..(226): a, c, t, g, unknown or other
  misc_feature (226)..(226): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtcgccactcccaggtccagcttgtgcagtcgtggggctgaggtgaagaagtccgtgggcctcgagtgtaagtttccngacacggtcttcgaggtactaccgtaccttcacttaggtatacgacttatacgtagttacggtcgccgtaccgaccggaccccggaagaacggtcttcggaggtcggaggtgggtagtacggactaccgaacgtcgtaggacgtaaacggttacggtaaaaccctaaacttaaaaaccgttacgaaaccgtaaacggtaaaccggttaccggtaacggggtaccgtaaaggtaaccgttacccggtttaaaccctttaaccccggaaaggggtaccctaaacccgtacggttaacccggaccggttaaacggttaaccttttaacgtttaacggtacgttaggggtaaccggtacgttaacgggaacgtaccggtaacggttacccggtaacgaacgtttaaccggaacccgtaagggtaacccgaccgggtttacttaggtttttaacgttttaccggtttttacgggaccggttaccttaccggttcccggttaaagggttccgggtaacgtttacgttaacgttttaacggttccaaggttttaaccttaacgtttccgtaaccggtttcccgggtccgggtaaacccggttacccgggttaaccgttccggggttaacccttaccccgggttcccgtccgttaaccccgg

SEQ ID NO: 260641 - DNA, 763 bp, Homo sapiens
  misc_feature: GYAE6OF01BCDBL.1.5.A05.1.454.CMB.1.raw
tcagacgagtgcgtcacgaccggtgctcgatttagatagatagacaggggacccaacaaccacatccctcctcagaacgcccccagagcacaacgccccaccatggactggacctggaggatcctctttttggtggcagcagccacaggtgcccactcccaggtccagcttgtgcagtcgtggggctggaggtgaagaagccgtggggcctcgagtgtaaggtttcctgacaaggcttacgaggataccaccttcacgttaggtatgactatactagttgggtcgccggtaccgaccgggcccccggaagaaacggtcgttaggaaggttcgggtaagtcggggtagtagggtactaccgaacggtcgtacggactaaagtacggtaaaaccgtaaaactaaaaaagtttacgaaaccgtaaggtaaacgtttaccgaacgggtacaacggtacgtacctaacccgtttaaccgaacggggtaaccctacgacgtacccggacgtaaggtaactttacgttagttagtacggacgtcgtaggacgcgtacgtccgtagacgtacgtaccgaagaccgtacggtacttaggttaatttagttttacggtagtacccgttaccgttacgttaggttaggtacgttacttaagtttacgttaccgtaccttacgttaacgttttccgtaaccggttccggtaccggggtacccgaaccgggttacccgtacggttacccgtacccgttcccgttcccgtaacccgg

SEQ ID NO: 260642 - DNA, 853 bp, Homo sapiens
  misc_feature: GYAE6OF01CCE49.1.5.A05.1.454.CMB.1.raw
tcagacgagtgcgtcacgaccggtgctcgatttagatagatagacaggggacccaacaaccacatcccctcctcagaacgcccccagagcacaacgccccaccatggactggacctggaggatcctcttttggtggcagcagccacaggtgcccacctcccacggtccagcttgtgcagtcgtggggcgtggaggtagaagaaggccgtcggggcctcaggtagtaacggtttcctgacacgggcttcgaggactacctaccttcacgtaggtatgactatactagttgggtcgtcgccgaccggaccccggaacgaaggtaccgttggaggtgggaaggtgggagtggtactacgacgcgtagacgaagtacgtaaacgaaactaaaaactaacgacaaggtaacgttaccggaacgggactacggtaacgtaccttaacccgttttaaccggaaacgggtaccgtaaccctaccggttaaccgggtaaccgggacggtttaaacgtttaaccgtttaacgtttaacggtacgggtacggtaccttacgggtaacggacgtaacggacccgttacggaacgggtaaccttaaccgggaacggtaacccgtaaccgggtacgtttagtttaacttttagggttttttacggtaccggttaccggttacccgttacggtttaacggtacggggttacggttaccgttaagttttaacggttaaccgttacgttaacgttaacgttttaccggtaccggtttaacccgggttcccgggggaacccgggttaaccggggtacccccggtttacccggttaacccgggttcccctttacccggtcccgttaccccgg

SEQ ID NO: 260643 - DNA, 933 bp, Homo sapiens
  misc_feature: GYAE6OF01B3S2W.1.5.A05.1.454.CMB.1.raw
  modified_base (133)..(133): a, c, t, g, unknown or other
  misc_feature (133)..(133): n is a, c, g, or t
tcagacgagtgcgtcacgaccggtgctcgatttagatagatagacgaggggacccaacaaccacatccctcctcagaacgccccagagcacaacgccccacatggactggacctggagatccttcgttttggngcagcagccagaggtcacccactcccgaggtccagtcttgcgcagttcgtggggctaggaggtagaacgacgccgtacggggcctacgaggtacgtaacggtttcctagaccgtaaggtccttacgaggtaactaaccgtacctttacgaacgttaaggtctagtacctaagttaccgtaggtttcgggtacgccggtacccggtacccggaccccggtaaacgtaaaacgggtccgtttagggtaagggttacgggaacggttagggggtaacttcgggtaacgttacccggtaacggtccggttacgggaacctaaaaggttaaccggtaaaaccaaaaaccgttaaaaattaccgaacgttaacggtaaccggttacccggaaaggggtaccgtaaaggtaccgtttaaaccccgttaaacccggtttaaccggaaccggggtaacctaacccggtacggttaccccgggtaacggtaacgggtttaaaccgtttaacgtttaagtaaacgggtttacggaaaccggttcggtaaggacccggtaacgtaacggtacccgttacgggaaacggtttaccggaaacccggtaaacgtacccgtaaccgggttacgtttaacggttttaaagtttacgtttttaccgggaaccgttacggtacccggtttaggttacggttcggtaacgttacgttaacgttacgttaccgacgttacgttaggttacccgcgttacccgggtggtaaaccccggtacggtacccgttacgtacccggccccgttcttcccggtacccg

SEQ ID NO: 260644 - DNA, 792 bp, Homo sapiens
  misc_feature: GYAE6OF01DN04P.1.5.A05.1.454.CMB.1.raw
  modified_base (130)..(130): a, c, t, g, unknown or other
  misc_feature (130)..(130): n is a, c, g, or t
  modified_base (181)..(181): a, c, t, g, unknown or other
  misc_feature (181)..(181): n is a, c, g, or t
  modified_base (187)..(187): a, c, t, g, unknown or other
  misc_feature (187)..(187): n is a, c, g, or t
  modified_base (229)..(229): a, c, t, g, unknown or other
  misc_feature (229)..(229): n is a, c, g, or t
  modified_base (320)..(320): a, c, t, g, unknown or other
  misc_feature (320)..(320): n is a, c, g, or t
  modified_base (704)..(704): a, c, t, g, unknown or other
  misc_feature (704)..(704): n is a, c, g, or t
tcagacgagtgcgtcacgaccggtgctcgatttagatagatagacagggacccaacaaccacatccctcctcagaacgccccagagcacaacgccccacatggactggacctggagatccttcttttggnggcagccagccacgaggtgcccactccccgaggtccagtcttgtgctagtntggggntggaggtgaaagacgccgtgggcctcgagtgtaacgtttccngtacgaaggtcttacgaggtactacctaccttacgacgttaggtatcgacttatactagttcgggagtccgaccgtaccgggaccccgaanaaacggtgttacgaggtcggagtgggactgggactcgaaacgtcgtggtactaaacggtgtaaaaactaacgtaaaaaacgtccgtaacaaacggtaaccgttaccggaagggaaccaggttaaaccgtcctaaacccgttacgtaacggggaccctaacgtaacgtcccggtaaggtaacgtttaacgttaaccgtttaacgtaggttaacgggtagtacggttacgacgtactaaccgggtcctaacggagttaaccggacgtaaacgaccggacgtaccgtttagtaattttccgtttacgggtacgtacccgttagttaaccggtaggtttaaccgggagtttaccgtaagttttaccgtccggtttacaaacggttttnttaaccggtccgttacggggtacccggtacccgttaaaccgggtacccgtttacggtccccgttaacccgtccgttcccggtaacccg

SEQ ID NO: 260645 - DNA, 848 bp, Homo sapiens
  misc_feature: GYAE6OF01CLHX3.1.5.A05.1.454.CMB.1.raw
  modified_base (146)..(146): a, c, t, g, unknown or other
  misc_feature (146)..(146): n is a, c, g, or t
  modified_base (151)..(151): a, c, t, g, unknown or other
  misc_feature (151)..(151): n is a, c, g, or t
tcagacgagtgcgtcacgaccggtgctcgatttagatagatagacaggggacccaaacaaccacactccctcctcagaacgccccagagcacaaccgcccaccatggactgacctggagactccttcttttggtggcagcagccanggtcnccactcccaggtccagtctcgtgcagtcgtgggctggaggtagaagagtccgtggggcctacgagtacgtaacggtttcctagacgtaacggtcttacgggaataccgaccttactacgtaggtacagtctaacgttactacgttggggttacgcgacccggaaccgggcccccggaaaacgtaaacgggttccgttaagggtacggtaagggtaggtagggagttacgggtactaaccgtaacggtccgcggtaagtaacgtaacgggtaaaacaaaacgtaaaaaaccttaagaaccgtaaacgttaaacggttaaccggaacggaacggtaagaaccggttaacccttaaccggttaaccggaaccggtaccacgttaaacgtccggtaaccgtaacggttaattaaacttacgttaaggtacgggtaactacgttacgaagtccgaagtccggttaagacgtaacgggtaacctaaacgggaacctacggttacgtacgttttaagtttacggtttttacgaccgttccggttaacccgtgttaagggttacggtaagtttactacgttaaacgtttacctacgttacgttaaacgtttaccgtacccgttaacgggttcccgaaccgggttaaccggttacccggttacgggtaaccccacccggtttcccaaaccgttccggtaaaccccg

SEQ ID NO: 260646 - DNA, 706 bp, Homo sapiens
  misc_feature: GYAE6OF01BR6AB.1.5.A05.1.454.CMB.1.raw
  modified_base (126)..(126): a, c, t, g, unknown or other
  misc_feature (126)..(126): n is a, c, g, or t
  modified_base (134)..(134): a, c, t, g, unknown or other
  misc_feature (134)..(134): n is a, c, g, or t
  modified_base (233)..(233): a, c, t, g, unknown or other
  misc_feature (233)..(233): n is a, c, g, or t
tcagacgagtgcgtcacgaccggtgctcgatttagatagatagacaggggacccaacaaccacatccctcctcagaacgcccccagagcacaacgccccacatggactggacctggagattccttntttttggngcagcagccactaggtcgcccactcccgaggtccagcttggtgctaggttcgtgggctaggaggtgaagacgtccgtgggcctgaggtgtaacgtttcngacgtaggtcttacgagtactacctacctttcgaacgttaggtactgtactatactagttcggtcgccgtaccgtaccggacccgaacgaaaggtcgttaggacggttaggaggtcgggtagtacggactacgacgacgtcggactaacgtaggtaacaaaacttaaaaactccgaacgtaaggtaacggttaccgaagggtacaacgtacgttacctaacccgttacggaacgggtacctaacgtacgtaccggtacgaaggttaacctttaacgttagttaacggtacggtagcgttacgaagtcgacgtccgagacgtacgtaccgaacgacggacgttcgttacttagtttcgtttacgtcgtaccgtacttagtaggtcgtagtacctagtttactacgtacttagtacgttcgaccgtcggtacggtaccgtaacggtaccgttcgtacccacgtccgtcctacccg

SEQ ID NO: 260647 - DNA, 778 bp, Homo sapiens
  misc_feature: GYAE6OF01BYP54.1.5.A05.1.454.CMB.1.raw
  modified_base (225)..(225): a, c, t, g, unknown or other
  misc_feature (225)..(225): n is a, c, g, or t
  modified_base (252)..(252): a, c, t, g, unknown or other
  misc_feature (252)..(252): n is a, c, g, or t
tcagacgagtgcgtcacgaccggtgctcgatttagatagatagacaggggacccaacaaccacatccctcctcagaacgcccccagagcacaaccgccccaccatggactggacctggagatccttcttttggtgcagcagccacaggtcgacccactcccaggtccagtcttgtgcagtcgtgggctggaggtgaagacgccgtgggcctgagtgtaagttccngacgagtctcgaggtactaccaccttnacgtaggtatcgactatacgtagttcgggtcgcccgaccgtaccgggacccccggtaacggaaacggtccgttaggtacggtggaacggtggggtagtacgggtactaccgaacggtccgtaggactaacggtaaggtaaaccaaaacgtaaaaactccaacgtaagtacgttacgagggacaggtacgtaccgtaaccgttaacgacggacacgtcgaccggtacgtacggtactttactagtacgtgggacgttctaggaacgttcgaacggtcgtaacggtagtaacccgtacggaaacgtacccgaggttacgtttagttaagtttttacgttttcgggtaccgtaccgtttacgttacggttaacgggttcggtacgttacgtttaaccgtttattaacccgggaccttttaacgttaacggtttacccgtaccggttaccggggtaccccggggttaacccggtaacccggtaccccggttacggttccccgttaacccgtaccgttccccgtaaacccg

SEQ ID NO: 260648 - DNA, 712 bp, Homo sapiens
  misc_feature: GYAE6OF01EWMTB.1.5.A05.1.454.CMB.1.raw
  modified_base (558)..(558): a, c, t, g, unknown or other
  misc_feature (558)..(558): n is a, c, g, or t
tcagacgagtgcgtcacgaccggtgctcgatttagatagatagacagggacccaacaaccacatccctcctcagaacgcccccagagcacaaccgccccaccatggactggacctggaggatccttcgtttttggtggcagcagccaacgaggtcgcccactcccaggtcccagcttgtgcgtagtccgtggggctggaggtagaacgagccgtgggcctgagtgtaacgttcctgcgaagtcgttgacgtatacagtccttcgacgttaggtatgtacttaatactagttggtgccgaccgaccggccccgaagtaacggtcgttaggacggtggtagtacgggtagtaggacgtacgaacgtcgtaggactaagtaacggtaaaacaaactaaaaactaccaactaaaggtacgttaaccggaggtaccaaggactacccgtaaccgttaccgaaggaccctacgacgttaccgaacgtacgttaagttaacctttagcgtagtacgtcgtagacgactaggaccctaggaacgtacgaacgaagtaccggacgtnttacgttagtttgtttacgtcgtaccgttacgttggtaaggtacgtcgttacttagtttacttccgtacgttacgttagttccggtacgtttcccgggacggttaacccggcccgggttaaccttcggaaccccgtttccgtacccttaccccg

SEQ ID NO: 260649 - DNA, 909 bp, Homo sapiens
  misc_feature: GYAE6OF01ASRWV.1.5.A05.1.454.CMB.1.raw
tcagacgagtgcgtcacgaccggtgctcgatttagatagatagacaggggacccaacaaccacatccctcctcagaagcccccagagcacaaccgccccaccatggactggacctggaggatccttcttttggtggcagcagccacaggtcgcccactcccaggtccagtcttgtgcagtcgtggggctggaggtagaagaaggccgtcggggcctacgaggtaggtaacggttttccgtaggaccgtaacgggtccgttacgaacgggtaacttacctaccctttaccgtaaccgttaagggttagtacggtacttaacttaacgtaggtttaggggtccgaccggcccggaaccccggggaccccccggaacgtaaaaccgggtccgtttaggacgggttacgggtaacggtaggggtagttacgggtaactaccggaaaccggtcggttacgggaacttaaacggtaacggtaaaaccaaaaccgtaaaaacttaccgaacgtaacggtaaacggttaccggaacgggacgtaacggtaacggtaccgttaacccgttaaccggaacgggtaaaccaccgtacggtacccggacggtaacggttaactttaacgttaagtacgtacgggtacgtacgttaacggacgtacgacgtaccggtaggaaccggtaaccgtaccgtaaacggaccgtaccgggagtttagtttaagttttacgttttacggacggttaccgttaccgttacggttacgggttagggtaccgttacgtaactttaacggttaccgtacgtttaacgttaacgggtttccttaacccgggttccgggtacccggggtacgttaaccccggggtacctttacccggggtaccgtaccccggttcgtttcccccggtaacccgg

SEQ ID NO: 260650 - DNA, 624 bp, Homo sapiens
  misc_feature: GYAE6OF01EUB8O.1.5.A05.1.454.CMB.1.raw
  modified_base (213)..(213): a, c, t, g, unknown or other
  misc_feature (213)..(213): n is a, c, g, or t
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (253)..(253): a, c, t, g, unknown or other
  misc_feature (253)..(253): n is a, c, g, or t
tcagacgagtgcgtcacgaccggtgctcgatttagatagatagacagggacccaacaaccacatccctcctcagaagcccccagagcacaacgccccaccatggactggacctggaggatcctctttttggtggcagcagccacaggtgcccactcccaggtccagcttgtgcagtctgggctgagtgaagagcctgggcctcagtgagttcngcagctcagatacncttcactagtatgntatacattggtncgccacggcccgacaacggctgagtggatgggatggatcgaacggcgtaggactaagtacggtaaacaaacgtaaaaaacttccaactaagtaacgttaccgaagggcagacgtccaccgtttaccgaacggtaccactacgtccgacgtaagtattaacttactatggagtctagagactagcctagacgacgtaccgaacgaccgacggtcttacgttacgttcgttttaggtacgcccgttaccgttacgtaggttacgaggttactagtttacgttaccgtacgttacgtaagtttcgaccgtttccggtacgggtaccggtacccggtaacccgtcggttaccccaccgttcccgtcctaccccgg

SEQ ID NO: 260651 - DNA, 720 bp, Homo sapiens
  misc_feature: GYAE6OF01BM68H.1.5.A05.1.454.CMB.1.raw
  modified_base (126)..(126): a, c, t, g, unknown or other
  misc_feature (126)..(126): n is a, c, g, or t
  modified_base (133)..(133): a, c, t, g, unknown or other
  misc_feature (133)..(133): n is a, c, g, or t
  modified_base (144)..(144): a, c, t, g, unknown or other
  misc_feature (144)..(144): n is a, c, g, or t
  modified_base (221)..(221): a, c, t, g, unknown or other
  misc_feature (221)..(221): n is a, c, g, or t
  modified_base (248)..(248): a, c, t, g, unknown or other
  misc_feature (248)..(248): n is a, c, g, or t
  modified_base (256)..(256): a, c, t, g, unknown or other
  misc_feature (256)..(256): n is a, c, g, or t
  modified_base (300)..(300): a, c, t, g, unknown or other
  misc_feature (300)..(300): n is a, c, g, or t
  modified_base (310)..(310): a, c, t, g, unknown or other
  misc_feature (310)..(310): n is a, c, g, or t
tcagacgagtgcgtcacgaccggtgctcgatttagatagatagacaggggacccaacaaccacatccctcctcagaacgccccagagcacaaccgccccacatggactggacctggagattccttnttttggngcagcagcacnggtcgcccactccgaggtccagcttgcgcagtcgtgggctggaggtagaagagcgtgggcctagagtggtacgttcngacgtagtctacgagtactacctactnacgtaggntgactatagtgttggacgccgaccgacggtacccgaagtaacgngttacgaggnggtagtggagttggactacgtacgcgtacggaactagtaacggtaaacaaacgtaaaacgtacgaacgtagtaaacgtcgaaggacgtacgtaaacgtacccgttaaacggttaccggaacggtacctaggtaccgtacggaaacgttacgttaatttacctagtaaggtaccgggtagtacgtcggaaccgagtaaccgacgtagtaacgacgttaacgaacgtacggtgtacgtttagtttaacgtttcgtttcgacgtaaccgtttcggttaccggtaaggttcgtaacggttacgtactttaacgtaacgtaccttacggttaattcccgggtaacggtcccggtagggttaaaccccgaccgggtttaaaccttcggaccgtttacccctcggttcgtaaccccg

SEQ ID NO: 260652 - DNA, 816 bp, Homo sapiens
  misc_feature: GYAE6OF01EH71D.1.5.A05.1.454.CMB.1.raw
  modified_base (160)..(160): a, c, t, g, unknown or other
  misc_feature (160)..(160): n is a, c, g, or t
  modified_base (720)..(720): a, c, t, g, unknown or other
  misc_feature (720)..(720): n is a, c, g, or t
  modified_base (780)..(780): a, c, t, g, unknown or other
  misc_feature (780)..(780): n is a, c, g, or t
tcagacgagtgcgtcacgaccggtgctcgatttagatagatagacgagggacccaacaaccacatccctcctcagaacgccccagagcaccaaccgccccaccatggactcggacctggaggtactccttctttttggcggcaggcacgccacgaggtcncccacttcccgaggtcccagtcttgtgctagtcgtggggtctaggaggtagaagacggccggtcgggtcctagtagtgtagtcggttctccgtagcgtgttcgtcgtttccgtaggttacctacttttcctttaacccgtacgttaggtattagtaagtttggtacgacgaccggaccgggcccggagggtacggtgttaggaggtgggtaggtgggagtcggtactaccggtaaccgtacccgtaaacgggtaaaacctaaaggacgttaagtagtaacgggtaacgaaacggttacggtacggaagggacctaaggtacgtactaacgttaacccgtaacgtaccccggaccggaccggaaacctaccgtaacggtaaccccgtaacggttaaccgtaaccgtaacccgttaccaaccggtttaaagggaaggtttaaccggaacggggacgggttaaccctcgtaaacgccggtaaacccgttagtacccggaaccctaacggtcccgtaacttaaccgtttacgtacggtcgaaccgtcgaagttagtaattccgngtcctcggttcccgtacgtcggttaccctaaccgggcttcggttacggttcggacccggngttaacccggggacgtacccggttcccgggtaaccc

SEQ ID NO: 260653 - DNA, 668 bp, Homo sapiens
  misc_feature: GYAE6OF01EU1VW.1.5.A05.1.454.CMB.1.raw
  modified_base (212)..(212): a, c, t, g, unknown or other
  misc_feature (212)..(212): n is a, c, g, or t
  modified_base (225)..(225): a, c, t, g, unknown or other
  misc_feature (225)..(225): n is a, c, g, or t
  modified_base (250)..(250): a, c, t, g, unknown or other
  misc_feature (250)..(250): n is a, c, g, or t
  modified_base (299)..(299): a, c, t, g, unknown or other
  misc_feature (299)..(299): n is a, c, g, or t
tcagacgagtgcgtcacgaccggtgctcgatttagatagatagacaggggacccaacaaccacatccctcctcagaagcccccagagcacaacgccccacatggactggacctggaggatccttctttttggtggcagcagccacgaggtgcccactcccgaggtccagcttgtgcagtcgtggggctggaggtgaagagccgtggggcctnagtgaggtttccngcaaggtcttcaggactacaccttnacgttaggtatgctatacagttgggtcgccgccgacgggcccccggaanaaacggtctttaggacgttggagtggggatggactcgaacgctgggacaagtaggtaaacaaacgtaaaaacttcgaacacgtaaacgttccgaggggacaagacgtccgtaaccctttacgaggacacacgtccgacgaaggtacttacttatacgtacggagtcgttagacgtcgagtcccgtagaacgtacgtaccgaagaccgacggtctagttagtttagttttagcgtccgtaccttacgtaggtacggacggttactaagtttacgttacgactttacgtaacgttttgacccgttccgggcggggttaacccgaacggggttacccgttcgggttacccacccgttccgttcccgtaccgg

SEQ ID NO: 260654 - DNA, 864 bp, Homo sapiens
  misc_feature: GYAE6OF01CS0PP.1.5.A05.1.454.CMB.1.raw
  modified_base (300)..(300): a, c, t, g, unknown or other
  misc_feature (300)..(300): n is a, c, g, or t
  modified_base (598)..(598): a, c, t, g, unknown or other
  misc_feature (598)..(598): n is a, c, g, or t
tcagacgagtgcgtcacgaccggtgctcgatttagatagatagacgaggggacccaacaaccacactccctcctcagaacgccccagagcacaacgccccaccatggactggacctggagatccttcttttggtggcagcagccacgaggtcgcccactcccaggtccagcttgtgctagtcgtgggctggaggtagacgacgccgttcggggcctcgaggtaggtaacgtttccgtgaccgaaggtcttacgagactacctacttcgacgtaggtatcgactagtactagtcgggtacnccggaccgacccgggtaaccccgaagaacgtcgttcgacggtgggacggtagggtagagtacgaccgtaaccggcgtaggtaccaaagttaccgaaaacgtaacgtaaaaacgttacgaacgtaactaacgtaccgagggtcaaacggtaccctaacgttaacccggtaccgaacggttaccgacgaacccgtcggaaccggtagtttaacgttacttaacggttgtacgggtaggtacggagtacgaccggttacgtaccggagtaaccggacggtaccgaacggtacccggttacncgttttaaagttccttttttaacgggtttacggtcccgtttaacccgggttagttacccgggtttttagggtaccggggttaacggtttaacttttaaccgtttaaccgggttaacttacccggtttaaacccgtttttacgggttaccccggttaaccggtttacccggggggaccccgggttaacccggggttaaacccccgggtcccggtttaacgggtttaccccccccggttaccggttccccggttccctaacccccggg

SEQ ID NO: 260655 - DNA, 185 bp, Homo sapiens
  misc_feature: GYAE6OF01AP78A.1.5.A05.1.454.CMB.1.raw
  modified_base (179)..(185): a, c, t, g, unknown or other
  misc_feature (179)..(185): n is a, c, g, or t
tcagacgagtgcgtcacgaccggtgctcgatttagatagatagacagggcaccaagggcccatcggtcttccccctggcaccctcctccaagagcacctctggggcacagcggccctgggctgcctggtcaaggactacttcctcgtactgcgctgagcgggctggcaaggcgcatagnnnnnnn

SEQ ID NO: 260656 - DNA, 307 bp, Homo sapiens
  misc_feature: GYAE6OF01A57OQ.1.5.A05.1.454.CMB.1.raw
  modified_base (271)..(307): a, c, t, g, unknown or other
  misc_feature (271)..(307): n is a, c, g, or t
tcagacgagtgcgtcacgaccggtgctcgatttagatagatagacaggggcagttccagatttcaactgctcatcagcagcctgcagtctgaagattttgctagttttattactgtcagcagtataataactggcctcgacgttcgccaagggaccaaggtgaaatcaaacgactgtggctgcacatctgtcttcacttccttcccgcctatctgattccgtactggccgtcgtgacggcggcgtacgggacgtaagggcacaagtagcannnnnnnnnnnnnnnnnnnnnnnnnnnnnnnnnnnnn

SEQ ID NO: 260657 - DNA, 736 bp, Homo sapiens
  misc_feature: GYAE6OF01CRVQ3.1.5.A05.1.454.CMB.1.raw
tcagacgagtgcgtcacgaccggtgctcgatttagatagatagacaggggacccaacaaccacatcccctcctcagaacgcccccagagcacaaccgccccaccatggactggacctggaggattcccttcttttggtggcagcagcccacaggtcgcccacctcccaggtccagcttgtgagtcgtgggctgaggtgaagagccgtgggcctcgagtaggtacggtttcctagacgtaacggtcttcgaaggacttacctaccttacacgttaggtatcgtactaattactagttggtcgccggtacccgaccggacccccggaacgaacgtccgttaggacggtggtaggtacgggtagtggactaccgaacggcgtaggactaacgtaacgtaaacaaaactaaaacgtacaacgtagtaacgttcgaaggacgtaagtacgtactaccgttacgacggaacacgtacgtccggacggtactaacgttttacgttaacgtagggtcgtaacgtacgtaggaccgacgtaaccgtacgtagacgtaaccggtaacggaacgacggttaacgtccgttaagtttaattttcgtttaagtccggtaccggttacgtggttagggttagtacgtattagtttaacgttacccgattacgtacgtttacgacggttaccggtccgggaacctcgggtaacccgtggtacccctacccgttcgttcccgtagtaccccg

SEQ ID NO: 260658 - DNA, 201 bp, Homo sapiens
  misc_feature: GYAE6OF01BJ7S3.1.5.A05.1.454.CMB.1.raw
  modified_base (184)..(201): a, c, t, g, unknown or other
  misc_feature (184)..(201): n is a, c, g, or t
tcagacgagtgcgtcacgaccggtgctcgatttagatagatagacagggcaccaagggcccatcggtcttcccctggcaccctcctccaagagcacctcgtggggcacaggcggccctgggctgcctggacaaggactacttcagtactctatctggagcgggctagggcaagggcgcaatagnnnnnnnnnnnnnnnnnn

SEQ ID NO: 260659 - DNA, 189 bp, Homo sapiens
  misc_feature: GYAE6OF01BPPVF.1.5.A05.1.454.CMB.1.raw
  modified_base (178)..(189): a, c, t, g, unknown or other
  misc_feature (178)..(189): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctacgtgagctctgagcgggctggcaaggcgcatagnnnnnnnnnnnn

SEQ ID NO: 260660 - DNA, 734 bp, Homo sapiens
  misc_feature: GYAE6OF01BQ9WM.1.5.A05.1.454.CMB.1.raw
  modified_base (245)..(245): a, c, t, g, unknown or other
  misc_feature (245)..(245): n is a, c, g, or t
  modified_base (627)..(627): a, c, t, g, unknown or other
  misc_feature (627)..(627): n is a, c, g, or t
tcagacgagtgcgtcacgaccggtgctcgatttagatagatagacaggggacccaacaaccacatccctcctcagaacgcccccagagcacaacgccccaccatggactggacctggaggactccttctttttggtggcagcagccacaggtcgcccactcccaggtccagtcttgtgcagtcgtggggctaggaggtagaaggacggtccgtcggggcctacgaggttcggtaacggttttccnggacgtaacggtcgttacgaggtactacctaccttacacgtaggtatcgtactatacgtagttgggacgccgacccgaccgggtaccccgaagtaacgtcgttacggaggtggagttagggactaggactacggacggtgtacggactaacgtaacggaaaacaaacgtaaaaactcgaacgtaacgtaacggtacgacggactaaggtactaccgtaaccgttaggacgtacacacgtccgaacgagttacttattacgtagtagagtactagacgcgtaacgtccgttaagacgaaccgtacggaaaccgccgttggtaactttagtttagttttcgtttacgacggttacctaccggtttagtaagggtcgtaacgttnttaacgttacgttacctacgttacttaaccggtagttaccccgtcgggtacccgggaaccgtaaccgggttaccgtacgtaccccgttaccgtccctaccgtacccg

SEQ ID NO: 260661 - DNA, 730 bp, Homo sapiens
  misc_feature: GYAE6OF01DTP2I.1.5.A05.1.454.CMB.1.raw
  modified_base (136)..(136): a, c, t, g, unknown or other
  misc_feature (136)..(136): n is a, c, g, or t
  modified_base (211)..(211): a, c, t, g, unknown or other
  misc_feature (211)..(211): n is a, c, g, or t
  modified_base (226)..(226): a, c, t, g, unknown or other
  misc_feature (226)..(226): n is a, c, g, or t
  modified_base (319)..(319): a, c, t, g, unknown or other
  misc_feature (319)..(319): n is a, c, g, or t
  modified_base (514)..(514): a, c, t, g, unknown or other
  misc_feature (514)..(514): n is a, c, g, or t
tcagacgagtgcgtcacgaccggtgctcgatttagatagatagacaggggacccaacaaccacatccctcctcagaagcccccagagcacaaccgccccaccagtggactggacctggaggatccttctttttggnggcagcagccacaggtgcccactcccaggtccagcttgtgcagtcgtggggctgaggtgaagagccgtgggcctnagtgaacggtttccngcgaaggtcttacgaggactacgtacctttcactaggtatcgacttatacgtagtttcggggtacgccggacccgaccgggccccccggaaanaaaccgggtcttaggaggtggaagtggggataggataccgaacgcgtggacaagtaggtaaacaaactaaaaagttcaaactagtaagttccgaggactagacgttctaaccgttaccgaaggtaccacgtaccgtccggaggaacggttaactttacttaatagtagggactcgtaggactcaagtcccgtagngtaacgtacccggaagtaaccgtcggttacttagtttaactttagtttttgacccggtacgttacccttaggttaagggtcgggtacgttacgttaacgttttacgtaccgtagttaaccttaaggtttccgtaacccggttccgggtaccggggtacccgaaaccgggttacccggttaccggttcccgaaccgtttccccgtaccgtaccccgg

SEQ ID NO: 260662 - DNA, 660 bp, Homo sapiens
  misc_feature: GYAE6OF01BRDM5.1.5.A05.1.454.CMB.1.raw
  modified_base (223)..(223): a, c, t, g, unknown or other
  misc_feature (223)..(223): n is a, c, g, or t
  modified_base (294)..(294): a, c, t, g, unknown or other
  misc_feature (294)..(294): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagccgtggggcctcgagtgtaaggtttccngacgaaggcttcgaggtactaccaccttcacgtaggtatgctatacattgggtgcgccacggccccggaanaaggcttgagtggagtgggatggatcgaacgctggcaagtacggtaaacaacaaaaacgttcaacgagtaacgttaccgagggacaacgacgttacctacccgtttaacgacgggtaaccacgactcccggacgaaggtactttacttatagtacggagtcgttagagcgacgtccgtagagacgtacggaacgaccgacgtcgtagttaatttattttcggacgtaccgttaccgtcgttaaggtaggacgttataactttacgttacgtaccttacgtagtttacgtacccggttaccggtccggggtaccgtaaccgggtacccgtcgggtaaccgtacccccgttcgtccccttaaccccgg

SEQ ID NO: 260663 - DNA, 901 bp, Homo sapiens
  misc_feature: GYAE6OF01EDDA4.1.5.A05.1.454.CMB.1.raw
  modified_base (135)..(135): a, c, t, g, unknown or other
  misc_feature (135)..(135): n is a, c, g, or t
tcagacgagtgcgtcacgaccggtgctcgatttagatagatagacaggggacccaacaaccacatccctcctcagaacgcccccagagcacaaccgccccacatggactggacctggagatccttcgtttttggnggcagcagcccacgaggtcgcccactcccaggtccaggtcttgtgcagtcgtggggctggaggtgaagagccgtgggcctgaggtgtaacggtttccagacgtaaggtccttcgaaggactacctaccttcgaacgttaggtactgtacttaatacgtaggttgggtcgaccgaccgaccggaccccggaagaacggtcgttaggacggtggagtgggtagtggactacgaacgtcgtaggactaaggtaacggaaactaaacgtaaaaaagttccaaacgtaacgtaacggttaccgaacgggactaacgtaaccgtacccgttaaacccgtttaaccggaacgggtaaacctaacggtaaccgtacccggtaacgggttaaacggttaacgtttaaaccgtttaaggtttaaacggagggtaacgttacccggttaaggaccggaaccgttaacggtacccgtaacgggtaaaccggttaacttaacccgggaaacggtaacccgtacgggttaaccggtttaagtttaacgttttacggtttttacgggtacccggtaccgtttaaccgtttacggttaagggttaccgggttaaccggggtttaatttaaccgggttaactttaccccggtaactttaacgttttaaccggtttacggtaacccggttacccggggtacggggttaaccccccgaaaccggggttccccttaaccggggttaacccccttaacccgttccccggttaaccccgttaacccgg

SEQ ID NO: 260664 - DNA, 909 bp, Homo sapiens
  misc_feature: GYAE6OF01DOGNA.1.5.A05.1.454.CMB.1.raw
  modified_base (236)..(236): a, c, t, g, unknown or other
  misc_feature (236)..(236): n is a, c, g, or t
tcagacgagtgcgtcacgaccggtgctcgatttagatagatagacagggacccaacaaccacatccctcctcagaacgcccccagagcacaaccgccccaccatggactggacctggagattccttcgtttttggtggcagcagcccacgaggtcgcccacctcccgaggtccagtcttgtgcagtcgtgggctggaggtgaagacgccgtggggcctacgagtgtacggtttccnggacaaggtcttagaggtactacctaccttacacgtaggtatcgactatactagttgggtcgccgtacccgaccggaccccggaagtaacggtcgtaggaggtcgggtaggtgggtagtacggactacgacgtcgtacggactaacgtaacggtaaaacaaaacgtaaaaactaccgaacgtaaggtaaccggttaccggaacgggtaacgtaacggttaccgttaacccgtttaaacccggttaacccggaacgggtacccgtaaacgtaaccggtcccgggaacggttaaacgggttaactttaacgttaaagttacggtaagggtacgtacggtacggacggtaccgtacggtacccggtaaggaaccggtacccggttaaccggaaaaccggtccgggttaaaccggttactttacggtttttaacggtttttacgttttaccgggttaaccggttccggttaaacccggttggttaacggttaacgggttcgtttaacgttaacgttttaacccgttaccggttaccgttaacgttttaaacggtttaccgggtaccgttttacccgggggtaacccggggtacccccgggttaaaccggggtttaacccccgggttacgggttaccccccgtttaaaccggttccccctttcccggtaaacccccgg

SEQ ID NO: 260665 - DNA, 779 bp, Homo sapiens
  misc_feature: GYAE6OF01DSXRH.1.5.A05.1.454.CMB.1.raw
  modified_base (133)..(133): a, c, t, g, unknown or other
  misc_feature (133)..(133): n is a, c, g, or t
  modified_base (408)..(408): a, c, t, g, unknown or other
  misc_feature (408)..(408): n is a, c, g, or t
  modified_base (509)..(509): a, c, t, g, unknown or other
  misc_feature (509)..(509): n is a, c, g, or t
tcagacgagtgcgtcacgaccggtgctcgatttagatagatagacgagggggacccgaacaaccacatccctcctcagaagcccccagagcacaacgcccaccatggactggacctggagatcctcttttggnggcagcagccacgaggtcgcccactcccgaggttcaccgtggtgcagtctggagcgtgagctgcagaagcctggggcctcgaggtgagttcggtccttccgtagccaggtcgtctttcggttggttaactacttccgtttaccgaccgttacggtattcggtaacttacgggttacgtaacggaccgacgggaccccccggaaggtacggggtccgttaggaggtacggtaggtgggatggtacgtcgacggtaccgtaacggtaaactaaacgngaagttagtacggtagacgtaacgtaccggaagggtacgagtaacgtcgacttacgacgtccgaacggacgtaacgactacgtaccgaacgtacgtaaccnggaacctaacggtaacgtacggaaaccgttacggacgggtaaccgtccgtaacggaacttaacggttacaacggtaaccggtaaccggaaccggttaaccgttaaacgtttaacgtaccgttaaccggtccgtaacggtaccgtaagttaaccgttagttcccggaaaccgttccggttaaccggtacggtacggttacgttaaccgggtaacgtacccggtttcggtaaaccggtccgggtaacgcccggggttcgggaaacccccggg

SEQ ID NO: 260666 - DNA, 796 bp, Homo sapiens
  misc_feature: GYAE6OF01EOQKE.1.5.A05.1.454.CMB.1.raw
  modified_base (135)..(135): a, c, t, g, unknown or other
  misc_feature (135)..(135): n is a, c, g, or t
  modified_base (230)..(230): a, c, t, g, unknown or other
  misc_feature (230)..(230): n is a, c, g, or t
  modified_base (288)..(288): a, c, t, g, unknown or other
  misc_feature (288)..(288): n is a, c, g, or t
  modified_base (306)..(306): a, c, t, g, unknown or other
  misc_feature (306)..(306): n is a, c, g, or t
  modified_base (519)..(519): a, c, t, g, unknown or other
  misc_feature (519)..(519): n is a, c, g, or t
tcagacgagtgcgtcacgaccggtgctcgatttagatagatagacaggggacccaacaaccacatccctcctcagaacgcccccagagcacaaccgccccaccatggactggacctggagatccttctttttggnggcagcagccacaggtgcccactcccaggtcccagtcttgtgcagtcgtggggctgagtgaagagtccgtggggcctcagtgtaacggttttccngcaaggtcttcgaggtactacctaccttcgacgttaggtatgactatacattgggtcncgccgaccggccccgaanaaacggtcgttagaggttggtagtgggtatgggactacgaacgctaggctaagtaggtaaacaaactaaaaattacaacgtaagtaacggttccgaagggaccgtaagtaggtacctaaccgtttaaccgaacgggtaccacgacggtaccgtacggtaagggttaacttttaaccgtaattaaacggtcggtagtacgttaggaagtaaccngttacccgaagtaacggaacgttaccgaaacgaccgtaacggttaccggttatttaagttttagtttttacgggtacctaccccggttaaccgttcgttaacggggtttacgggtacgtttaacccgtaagttttaccgttaaaccggtacttttaaaccggttacttttaaccggacccggttttccggggacccggggttaaacccgtaacccggggttaacccggttacccggttaacccgtaacccctttccccggtcccgttaaacccccgg

SEQ ID NO: 260667 - DNA, 179 bp, Homo sapiens; identical to SEQ ID NO: 259974
  misc_feature: GYAE6OF02G9ELC.1.5.A05.1.454.CMB.1.raw
  modified_base (178)..(179): a, c, t, g, unknown or other
  misc_feature (178)..(179): n is a, c, g, or t

SEQ ID NO: 260668 - DNA, 180 bp, Homo sapiens; identical to SEQ ID NO: 259970
  misc_feature: GYAE6OF02F812S.1.5.A05.1.454.CMB.1.raw
  modified_base (178)..(180): a, c, t, g, unknown or other
  misc_feature (178)..(180): n is a, c, g, or t

SEQ ID NO: 260669 - DNA, 248 bp, Homo sapiens
  misc_feature: GYAE6OF02JFJZG.1.5.A05.1.454.CMB.1.raw
  modified_base (247)..(248): a, c, t, g, unknown or other
  misc_feature (247)..(248): n is a, c, g, or t
tcagacgagtgcgtcacgaccggtgctcgatttagatagatagacagggcagttccagatttcaactgctcatcagcagcctgcagtctgaagatttgcagtttattactgtcagcagtataataactggcctccgacgttcggccaagggaccaaggtggaaatcaaacgaactgtggctgcaccatctgtcttcatcttccgccatctgatcgtactgcgctgagcggctggcaaggcgcatagnn

SEQ ID NO: 260670 - DNA, 253 bp, Homo sapiens; identical to SEQ ID NO: 259912
  misc_feature: GYAE6OF02GM6AG.1.5.A05.1.454.CMB.1.raw
  modified_base (250)..(253): a, c, t, g, unknown or other
  misc_feature (250)..(253): n is a, c, g, or t

SEQ ID NO: 260671 - DNA, 179 bp, Homo sapiens; identical to SEQ ID NO: 259879
  misc_feature: GYAE6OF02HSHSF.1.5.A05.1.454.CMB.1.raw
  modified_base (178)..(179): a, c, t, g, unknown or other
  misc_feature (178)..(179): n is a, c, g, or t

SEQ ID NO: 260672 - DNA, 180 bp, Homo sapiens; identical to SEQ ID NO: 259868
  misc_feature: GYAE6OF02JF2FD.1.5.A05.1.454.CMB.1.raw
  modified_base (178)..(180): a, c, t, g, unknown or other
  misc_feature (178)..(180): n is a, c, g, or t

SEQ ID NO: 260673 - DNA, 181 bp, Homo sapiens
  misc_feature: GYAE6OF02F4LED.1.5.A05.1.454.CMB.1.raw
  modified_base (178)..(181): a, c, t, g, unknown or other
  misc_feature (178)..(181): n is a, c, g, or t
tcagacgagtgcgtcacgaccggtgctcgatttagatagatagacaggccaccaagggcccatcggtcttcccctggcaccctcctccaagagcacctctggggcacagcggccctgggctgcctggtcaaggactacttccgagtgcgtctctgagcgggctggcaaggcgcatagnnnn

SEQ ID NO: 260674 - DNA, 180 bp, Homo sapiens; identical to SEQ ID NO: 259970
  misc_feature: GYAE6OF02I2Y88.1.5.A05.1.454.CMB.1.raw
  modified_base (178)..(180): a, c, t, g, unknown or other
  misc_feature (178)..(180): n is a, c, g, or t

SEQ ID NO: 260675 - DNA, 179 bp, Homo sapiens; identical to SEQ ID NO: 259974
  misc_feature: GYAE6OF02GI713.1.5.A05.1.454.CMB.1.raw
  modified_base (178)..(179): a, c, t, g, unknown or other
  misc_feature (178)..(179): n is a, c, g, or t

SEQ ID NO: 260676 - DNA, 177 bp, Homo sapiens
  misc_feature: GYAE6OF02FV13A.1.5.A05.1.454.CMB.1.raw
  modified_base (176)..(177): a, c, t, g, unknown or other
  misc_feature (176)..(177): n is a, c, g, or t
tcagacgagtgcgtcacgaccggtgctcgatttagatagatagacagggcaccaagggccatcggtcttccctggcaccctcctccaagagcacctctggggcacagcggccctgggctgcctggtcaaggactacttccagtactctatctgagcgggctggcaaggcgcatagnn

SEQ ID NO: 260677 - DNA, 184 bp, Homo sapiens
  misc_feature: GYAE6OF02HKCX8.1.5.A05.1.454.CMB.1.raw
  modified_base (177)..(184): a, c, t, g, unknown or other
  misc_feature (177)..(184): n is a, c, g, or t
tcagacgagtgcgtcacgaccggtgctcgatttagatagatagacagggcaccaagggcccatcggtcttcccctggcaccctcctccaagagcacctctggggcacagcggcctgggctgcctggtcaaggactacttccagtactctatctgagcgggctggcaaggcgcatagnnnnnnnn

SEQ ID NO: 260678 - DNA, 209 bp, Homo sapiens
  misc_feature: GYAE6OF02IUMNU.1.5.A05.1.454.CMB.1.raw
  modified_base (181)..(209): a, c, t, g, unknown or other
  misc_feature (181)..(209): n is a, c, g, or t
tcagacgagtgcgtcacgaccggtgctcgatttagatagatagacagggcgaccaagggcccatcggtcttcccctggcaccctcctccaagagcacctcgtcggggcacagcggccctgggctgcctggtcaaggactacttccagtactctatctgagcgggctggcaaggcgcatagnnnnnnnnnnnnnnnnnnnnnnnnnnnnn

SEQ ID NO: 260679 - DNA, 258 bp, Homo sapiens
  misc_feature: GYAE6OF02JGFAZ.1.5.A05.1.454.CMB.1.raw
  modified_base (251)..(258): a, c, t, g, unknown or other
  misc_feature (251)..(258): n is a, c, g, or t
tcagacgagtgcgtcacgaccggtgctcgatttagatagatagacagggcaggttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatctgatcgtactgcgctgagcgggctggcaaggcgcatagnnnnnnnn

SEQ ID NO: 260680 - DNA, 181 bp, Homo sapiens
  misc_feature: GYAE6OF02GGP3Q.1.5.A05.1.454.CMB.1.raw
  modified_base (178)..(181): a, c, t, g, unknown or other
  misc_feature (178)..(181): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctcgatcgcgtctgagcgggctggcaaggcgcatagnnnn

SEQ ID NO: 260681 - DNA, 179 bp, Homo sapiens; identical to SEQ ID NO: 259879
  misc_feature: GYAE6OF02IDIZS.1.5.A05.1.454.CMB.1.raw
  modified_base (178)..(179): a, c, t, g, unknown or other
  misc_feature (178)..(179): n is a, c, g, or t

SEQ ID NO: 260682 - DNA, 227 bp, Homo sapiens
  misc_feature: GYAE6OF02HQO2T.1.5.A05.1.454.CMB.1.raw
  modified_base (184)..(184): a, c, t, g, unknown or other
  misc_feature (184)..(184): n is a, c, g, or t
  modified_base (186)..(227): a, c, t, g, unknown or other
  misc_feature (186)..(227): n is a, c, g, or t
tcagacgagtgcgtcacgaccggtgctcgatttagatagatagacagggacgaccaagggcccatcggtcttcccctggccaccctcctccaagagaccacctctggggcacagcggccctgggctgcctggtcaaggactacttcctcgtactgcgtctgagcgggctggcaaggcgcatagntnnnnnnnnnnnnnnnnnnnnnnnnnnnnnnnnnnnnnnnnnn

SEQ ID NO: 260683 - DNA, 182 bp, Homo sapiens; identical to SEQ ID NO: 259863
  misc_feature: GYAE6OF02GDIC7.1.5.A05.1.454.CMB.1.raw
  modified_base (178)..(182): a, c, t, g, unknown or other
  misc_feature (178)..(182): n is a, c, g, or t

SEQ ID NO: 260684 - DNA, 179 bp, Homo sapiens; identical to SEQ ID NO: 259844
  misc_feature: GYAE6OF02HBGAS.1.5.A05.1.454.CMB.1.raw
  modified_base (178)..(179): a, c, t, g, unknown or other
  misc_feature (178)..(179): n is a, c, g, or t

SEQ ID NO: 260685 - DNA, 179 bp, Homo sapiens; identical to SEQ ID NO: 259879
  misc_feature: GYAE6OF02GHQM6.1.5.A05.1.454.CMB.1.raw
  modified_base (178)..(179): a, c, t, g, unknown or other
  misc_feature (178)..(179): n is a, c, g, or t

SEQ ID NO: 260686 - DNA, 253 bp, Homo sapiens; identical to SEQ ID NO: 259912
  misc_feature: GYAE6OF02F8ZHT.1.5.A05.1.454.CMB.1.raw
  modified_base (250)..(253): a, c, t, g, unknown or other
  misc_feature (250)..(253): n is a, c, g, or t

SEQ ID NO: 260687 - DNA, 252 bp, Homo sapiens; identical to SEQ ID NO: 259862
  misc_feature: GYAE6OF02HFGNV.1.5.A05.1.454.CMB.1.raw
  modified_base (250)..(252): a, c, t, g, unknown or other
  misc_feature (250)..(252): n is a, c, g, or t

SEQ ID NO: 260688 - DNA, 189 bp, Homo sapiens
  misc_feature: GYAE6OF02HDJPJ.1.5.A05.1.454.CMB.1.raw
  modified_base (178)..(189): a, c, t, g, unknown or other
  misc_feature (178)..(189): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctatgtatactctgagcgggctggcaaggcgcatagnnnnnnnnnnnn

SEQ ID NO: 260689 - DNA, 179 bp, Homo sapiens; identical to SEQ ID NO: 259879
  misc_feature: GYAE6OF02F6WO2.1.5.A05.1.454.CMB.1.raw
  modified_base (178)..(179): a, c, t, g, unknown or other
  misc_feature (178)..(179): n is a, c, g, or t

SEQ ID NO: 260690 - DNA, 180 bp, Homo sapiens; identical to SEQ ID NO: 259970
  misc_feature: GYAE6OF02HCFGI.1.5.A05.1.454.CMB.1.raw
  modified_base (178)..(180): a, c, t, g, unknown or other
  misc_feature (178)..(180): n is a, c, g, or t

SEQ ID NO: 260691 - DNA, 249 bp, Homo sapiens
  misc_feature: GYAE6OF02I11QE.1.5.A05.1.454.CMB.1.raw
  modified_base (249)..(249): a, c, t, g, unknown or other
  misc_feature (249)..(249): n is a, c, g, or t
tcagacgagtgcgtcacgaccggtgctcgatttagatagatagacagggcagttccagatttcaactgctcatcagcagcctgcagtctgaagattttgcagtttattactgtcagcagtataataactggcctccgacgttcggccaagggaccaaggtggaaatcaagcgaactgtggctgcaccatctgtcttcatcttccgccatctgatcgtactgcgctgagcgggctggcaaggcgcatagn

SEQ ID NO: 260692 - DNA, 186 bp, Homo sapiens
  misc_feature: GYAE6OF02INZMD.1.5.A05.1.454.CMB.1.raw
  modified_base (178)..(186): a, c, t, g, unknown or other
  misc_feature (178)..(186): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttccagtactctatctgagcgggctggcaaggcgcatagnnnnnnnnn

SEQ ID NO: 260693 - DNA, 186 bp, Homo sapiens
  misc_feature: GYAE6OF02INA88.1.5.A05.1.454.CMB.1.raw
  modified_base (178)..(186): a, c, t, g, unknown or other
  misc_feature (178)..(186): n is a, c, g, or t
tcagacgagtgcgtcacgaccggtgctcgatttagatagatagacagggcaccaagggcccatcggtcttcccctggcaccctcctccaagagcacctctggggcacagcagccctgggctgcctggtcaaggactacttccagtactctatctgagcgggctggcaaggcgcatagnnnnnnnnn

SEQ ID NO: 260694 - DNA, 179 bp, Homo sapiens; identical to SEQ ID NO: 259853
  misc_feature: GYAE6OF02FUB69.1.5.A05.1.454.CMB.1.raw
  modified_base (178)..(179): a, c, t, g, unknown or other
  misc_feature (178)..(179): n is a, c, g, or t

SEQ ID NO: 260695 - DNA, 251 bp, Homo sapiens
  misc_feature: GYAE6OF02FRC0O.1.5.A05.1.454.CMB.1.raw
  modified_base (249)..(251): a, c, t, g, unknown or other
  misc_feature (249)..(251): n is a, c, g, or t
tcagacgagtgcgtcacgaccggtgctcgatttagatagatagacagggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttccgccatctgatcgtactgcgctgagcgggctggcaaggcgcatagnnn

SEQ ID NO: 260696 - DNA, 251 bp, Homo sapiens
  misc_feature: GYAE6OF02G2SM6.1.5.A05.1.454.CMB.1.raw
  modified_base (249)..(251): a, c, t, g, unknown or other
  misc_feature (249)..(251): n is a, c, g, or t
tcagacgagtgcgtcacgaccggtgctcgatttagatagatagacagggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatctgatcgtactgcgctgagcggctggcaaggcgcatagnnn

SEQ ID NO: 260697 - DNA, 178 bp, Homo sapiens; identical to SEQ ID NO: 259891
  misc_feature: GYAE6OF02IUXV4.1.5.A05.1.454.CMB.1.raw
  modified_base (178)..(178): a, c, t, g, unknown or other
  misc_feature (178)..(178): n is a, c, g, or t

SEQ ID NO: 260698 - DNA, 180 bp, Homo sapiens; identical to SEQ ID NO: 259868
  misc_feature: GYAE6OF02G7DZ7.1.5.A05.1.454.CMB.1.raw
  modified_base (178)..(180): a, c, t, g, unknown or other
  misc_feature (178)..(180): n is a, c, g, or t

SEQ ID NO: 260699 - DNA, 178 bp, Homo sapiens; identical to SEQ ID NO: 259900
  misc_feature: GYAE6OF02GHO02.1.5.A05.1.454.CMB.1.raw
  modified_base (178)..(178): a, c, t, g, unknown or other
  misc_feature (178)..(178): n is a, c, g, or t

SEQ ID NO: 260700 - DNA, 179 bp, Homo sapiens; identical to SEQ ID NO: 259879
  misc_feature: GYAE6OF02IX0WI.1.5.A05.1.454.CMB.1.raw
  modified_base (178)..(179): a, c, t, g, unknown or other
  misc_feature (178)..(179): n is a, c, g, or t

SEQ ID NO: 260701 - DNA, 270 bp, Homo sapiens
  misc_feature: GYAE6OF02IMIQ7.1.5.A05.1.454.CMB.1.raw
  modified_base (257)..(270): a, c, t, g, unknown or other
  misc_feature (257)..(270): n is a, c, g, or t
tcagacgagtgcgtcacgaccggtgctcgatttagatagatagacgaggggcagttccagatttcaactgctcatcagcagtcctgcagtctgaagattttgcagtttattactgtcagcagtataataactggcctccgacgttcggccaagggaccaaggtggaaaatcaaacgaactgtggctgcaccatctgtcttcagtcttcccgcatctggactcgtactgcgctgagcgggctggcaaggcgcattagnnnnnnnnnnnnnn

SEQ ID NO: 260702 - DNA, 253 bp, Homo sapiens
  misc_feature: GYAE6OF02IYZDJ.1.5.A05.1.454.CMB.1.raw
  modified_base (250)..(253): a, c, t, g, unknown or other
  misc_feature (250)..(253): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttccgccatctgaacgcactcgtctgagcgggctggcaaggcgcatagnnnn

SEQ ID NO: 260703 - DNA, 205 bp, Homo sapiens
  misc_feature: GYAE6OF02FFJ1F.1.5.A05.1.454.CMB.1.raw
  modified_base (180)..(205): a, c, t, g, unknown or other
  misc_feature (180)..(205): n is a, c, g, or t
tcagacgagtgcgtcacgaccggtgctcgatttagatagatagacagggcaccaagggcccatcggtcttcccctggcaccctcctccaagacgcacctctggggcacagcggccctgggctgcctggtcaaggactacttcctcgtactgcgcttgagcgggctggcaaggcgcatagnnnnnnnnnnnnnnnnnnnnnnnnnn

SEQ ID NO: 260704 - DNA, 254 bp, Homo sapiens
  misc_feature: GYAE6OF02JHAQL.1.5.A05.1.454.CMB.1.raw
  modified_base (249)..(254): a, c, t, g, unknown or other
  misc_feature (249)..(254): n is a, c, g, or t
tcagacgagtgcgtcacgaccggtgctcgatttagatagatagacagggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgcctcctctatacgatcgctgagcgggctggcaaggcgcatagnnnnnn

SEQ ID NO: 260705 - DNA, 180 bp, Homo sapiens; identical to SEQ ID NO: 259970
  misc_feature: GYAE6OF02GRFIB.1.5.A05.1.454.CMB.1.raw
  modified_base (178)..(180): a, c, t, g, unknown or other
  misc_feature (178)..(180): n is a, c, g, or t

SEQ ID NO: 260706 - DNA, 178 bp, Homo sapiens; identical to SEQ ID NO: 259891
  misc_feature: GYAE6OF02GY8HU.1.5.A05.1.454.CMB.1.raw
  modified_base (178)..(178): a, c, t, g, unknown or other
  misc_feature (178)..(178): n is a, c, g, or t

SEQ ID NO: 260707 - DNA, 249 bp, Homo sapiens
  misc_feature: GYAE6OF02FW2I2.1.5.A05.1.454.CMB.1.raw
  modified_base (249)..(249): a, c, t, g, unknown or other
  misc_feature (249)..(249): n is a, c, g, or t
tcagacgagtgcgtcacgaccggtgctcgatttagatagatagacagggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttccgccatctgatcgtactgcgctgagcgggctggcaaggcgcatagn

SEQ ID NO: 260708 - DNA, 255 bp, Homo sapiens; identical to SEQ ID NO: 259871
  misc_feature: GYAE6OF02F9QTW.1.5.A05.1.454.CMB.1.raw
  modified_base (251)..(255): a, c, t, g, unknown or other
  misc_feature (251)..(255): n is a, c, g, or t

SEQ ID NO: 260709 - DNA, 250 bp, Homo sapiens
  misc_feature: GYAE6OF02HZYF8.1.5.A05.1.454.CMB.1.raw
  modified_base (249)..(250): a, c, t, g, unknown or other
  misc_feature (249)..(250): n is a, c, g, or t
tcagacgagtgcgtcacgaccggtgctcgatttagatagatagacagggcagttccagatttcaactgctcatcagcagcctgcagtctgaagattttgcagtttattactgtcagcagtataataactggcctccgacgttcggccaagggaccaaggtggagatcaaacgaactgtggctgcaccatctgtcttcatcttcccacctcctcatagcgtactctgagcgggctggcaaggcgcatagnn

SEQ ID NO: 260710 - DNA, 186 bp, Homo sapiens; identical to SEQ ID NO: 260692
  misc_feature: GYAE6OF02H1XBM.1.5.A05.1.454.CMB.1.raw
  modified_base (178)..(186): a, c, t, g, unknown or other
  misc_feature (178)..(186): n is a, c, g, or t

SEQ ID NO: 260711 - DNA, 178 bp, Homo sapiens; identical to SEQ ID NO: 259858
  misc_feature: GYAE6OF02IQ2Q1.1.5.A05.1.454.CMB.1.raw
  modified_base (178)..(178): a, c, t, g, unknown or other
  misc_feature (178)..(178): n is a, c, g, or t

SEQ ID NO: 260712 - DNA, 181 bp, Homo sapiens; identical to SEQ ID NO: 260680
  misc_feature: GYAE6OF02HHQP3.1.5.A05.1.454.CMB.1.raw
  modified_base (178)..(181): a, c, t, g, unknown or other
  misc_feature (178)..(181): n is a, c, g, or t

SEQ ID NO: 260713 - DNA, 180 bp, Homo sapiens
  misc_feature: GYAE6OF02HI1IG.1.5.A05.1.454.CMB.1.raw
  modified_base (178)..(180): a, c, t, g, unknown or other
  misc_feature (178)..(180): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttccgagtgcgtctctgagcgggctggcaaggcgcatagnnn

SEQ ID NO: 260714 - DNA, 186 bp, Homo sapiens; identical to SEQ ID NO: 260692
  misc_feature: GYAE6OF02IQ5F4.1.5.A05.1.454.CMB.1.raw
  modified_base (178)..(186): a, c, t, g, unknown or other
  misc_feature (178)..(186): n is a, c, g, or t

SEQ ID NO: 260715 - DNA, 251 bp, Homo sapiens; identical to SEQ ID NO: 259942
  misc_feature: GYAE6OF02G39U9.1.5.A05.1.454.CMB.1.raw
  modified_base (251)..(251): a, c, t, g, unknown or other
  misc_feature (251)..(251): n is a, c, g, or t

SEQ ID NO: 260716 - DNA, 183 bp, Homo sapiens; identical to SEQ ID NO: 260080
  misc_feature: GYAE6OF02JPYA7.1.5.A05.1.454.CMB.1.raw
  modified_base (178)..(183): a, c, t, g, unknown or other
  misc_feature (178)..(183): n is a, c, g, or t

SEQ ID NO: 260717 - DNA, 252 bp, Homo sapiens
  misc_feature: GYAE6OF02G3E2R.1.5.A05.1.454.CMB.1.raw
  modified_base (250)..(252): a, c, t, g, unknown or other
  misc_feature (250)..(252): n is a, c, g, or t
tcagacgagtgcgtcacgaccggtgctcgatttagatagatagacagggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatctgaacgcactcgtctgagcgggctggcaaggcgcatagnnn

SEQ ID NO: 260718 - DNA, 252 bp, Homo sapiens; identical to SEQ ID NO: 259961
  misc_feature: GYAE6OF02HO8J5.1.5.A05.1.454.CMB.1.raw
  modified_base (251)..(252): a, c, t, g, unknown or other
  misc_feature (251)..(252): n is a, c, g, or t

SEQ ID NO: 260719 - DNA, 179 bp, Homo sapiens; identical to SEQ ID NO: 259898
  misc_feature: GYAE6OF02F6EQD.1.5.A05.1.454.CMB.1.raw
  modified_base (178)..(179): a, c, t, g, unknown or other
  misc_feature (178)..(179): n is a, c, g, or t

SEQ ID NO: 260720 - DNA, 178 bp, Homo sapiens; identical to SEQ ID NO: 259858
  misc_feature: GYAE6OF02FE64B.1.5.A05.1.454.CMB.1.raw
  modified_base (178)..(178): a, c, t, g, unknown or other
  misc_feature (178)..(178): n is a, c, g, or t

SEQ ID NO: 260721 - DNA, 255 bp, Homo sapiens
  misc_feature: GYAE6OF02IRNUO.1.5.A05.1.454.CMB.1.raw
  modified_base (251)..(255): a, c, t, g, unknown or other
  misc_feature (251)..(255): n is a, c, g, or t
tcagacgagtgcgtcacgaccggtgctcgatttagatagatagacaggggcagttccagatttcaactgctcatcagcagcctgcagtctgaagattttgctagtttattactgtcagcagtataataactggcctccgacgttcggccaagggaccaaggtggaaatcaaacgaactgtggctgcaccatctgtcttcatcttcccgcatctgatcgtactgcgctgagcgggctggcaaggcgcatagnnnnn

SEQ ID NO: 260722 - DNA, 181 bp, Homo sapiens; identical to SEQ ID NO: 259842
  misc_feature: GYAE6OF02GWCT4.1.5.A05.1.454.CMB.1.raw
  modified_base (178)..(181): a, c, t, g, unknown or other
  misc_feature (178)..(181): n is a, c, g, or t

SEQ ID NO: 260723 - DNA, 253 bp, Homo sapiens; identical to SEQ ID NO: 259889
  misc_feature: GYAE6OF02FHWJR.1.5.A05.1.454.CMB.1.raw
  modified_base (251)..(253): a, c, t, g, unknown or other
  misc_feature (251)..(253): n is a, c, g, or t

SEQ ID NO: 260724 - DNA, 277 bp, Homo sapiens
  misc_feature: GYAE6OF02FITA9.1.5.A05.1.454.CMB.1.raw
  modified_base (262)..(277): a, c, t, g, unknown or other
  misc_feature (262)..(277): n is a, c, g, or t
tcagacgagtgcgtcacgaccggtgctcgatttagatagatagacgagggcagttccagatttcaactgtctcattcagcagcctgcagtctgaagattttgcagtttattactgtctagcagtataataactggtcctccgacgttcggcctaaagggaccaaggtggaaatcaaacgaactgtggctgcaccagtctgtcttcatcttcccgccgatctgatcgtactgcgctgagcgggctggctaaaggcgccatagnnnnnnnnnnnnnnnn

SEQ ID NO: 260725 - DNA, 184 bp, Homo sapiens
  misc_feature: GYAE6OF02I1VCC.1.5.A05.1.454.CMB.1.raw
  modified_base (178)..(184): a, c, t, g, unknown or other
  misc_feature (178)..(184): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctcgatcgcgtctgagcgggctggcaaggcgcatagnnnnnnn

SEQ ID NO: 260726 - DNA, 179 bp, Homo sapiens; identical to SEQ ID NO: 259999
  misc_feature: GYAE6OF02HJ8O9.1.5.A05.1.454.CMB.1.raw
  modified_base (178)..(179): a, c, t, g, unknown or other
  misc_feature (178)..(179): n is a, c, g, or t

SEQ ID NO: 260727 - DNA, 255 bp, Homo sapiens
  misc_feature: GYAE6OF02JG007.1.5.A05.1.454.CMB.1.raw
  modified_base (231)..(231): a, c, t, g, unknown or other
  misc_feature (231)..(231): n is a, c, g, or t
  modified_base (247)..(255): a, c, t, g, unknown or other
  misc_feature (247)..(255): n is a, c, g, or t
tcagacgagtgcgtcacgaccggtgctcgatttagatagatagacagggcagttccagatttcaactgctcatcagcagcctgcagtctgaagattttgcagtttattactgtcagcagtataataactggcctccgacgttcggccaagggaccaaggtggaaatcaaacgactgtggctgcaccatctgtcttcatcttcccgcatctgatcgtactgcgctgagcggntggcaaggcgcatagnnnnnnnnn

SEQ ID NO: 260728 - DNA, 178 bp, Homo sapiens; identical to SEQ ID NO: 259891
  misc_feature: GYAE6OF02H9PK1.1.5.A05.1.454.CMB.1.raw
  modified_base (178)..(178): a, c, t, g, unknown or other
  misc_feature (178)..(178): n is a, c, g, or t

SEQ ID NO: 260729 - DNA, 528 bp, Homo sapiens
  misc_feature: GYAE6OF02I8FRR.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcaacagaagttccagggcagagtcactttacagggacacatccgcgaggattactatatggagctgagcagcctgagatccgaagacacggctgtatatttttgtgtcgaccttctagtggaggttcattattacgctacaatttgacttccgtgggtcctagggacccttgggtcctaccgtctcctccg

SEQ ID NO: 260730 - DNA, 182 bp, Homo sapiens; identical to SEQ ID NO: 259848
  misc_feature: GYAE6OF02HSLWR.1.5.A05.1.454.CMB.1.raw
  modified_base (178)..(182): a, c, t, g, unknown or other
  misc_feature (178)..(182): n is a, c, g, or t

SEQ ID NO: 260731 - DNA, 180 bp, Homo sapiens; identical to SEQ ID NO: 259921
  misc_feature: GYAE6OF02F9L15.1.5.A05.1.454.CMB.1.raw
  modified_base (178)..(180): a, c, t, g, unknown or other
  misc_feature (178)..(180): n is a, c, g, or t

SEQ ID NO: 260732 - DNA, 180 bp, Homo sapiens
  misc_feature: GYAE6OF02JKAEN.1.5.A05.1.454.CMB.1.raw
  modified_base (179)..(180): a, c, t, g, unknown or other
  misc_feature (179)..(180): n is a, c, g, or t
tcagacgagtgcgtcacgaccggtgctcgatttagatagatagacagggcaccaagggcccatcggtcttcccctcggcaccctcctccaagagcacctctggggcacagcggccctgggctgcctggtcaaggactacttcctatgtatactctgagcgggctggcaaggcgcatagnn

SEQ ID NO: 260733 - DNA, 178 bp, Homo sapiens; identical to SEQ ID NO: 259858
  misc_feature: GYAE6OF02GXYCC.1.5.A05.1.454.CMB.1.raw
  modified_base (178)..(178): a, c, t, g, unknown or other
  misc_feature (178)..(178): n is a, c, g, or t

SEQ ID NO: 260734 - DNA, 183 bp, Homo sapiens; identical to SEQ ID NO: 260255
  misc_feature: GYAE6OF02FQDEF.1.5.A05.1.454.CMB.1.raw
  modified_base (178)..(183): a, c, t, g, unknown or other
  misc_feature (178)..(183): n is a, c, g, or t

SEQ ID NO: 260735 - DNA, 178 bp, Homo sapiens; identical to SEQ ID NO: 259858
  misc_feature: GYAE6OF02GFDZU.1.5.A05.1.454.CMB.1.raw
  modified_base (178)..(178): a, c, t, g, unknown or other
  misc_feature (178)..(178): n is a, c, g, or t

SEQ ID NO: 260736 - DNA, 183 bp, Homo sapiens
  misc_feature: GYAE6OF02HORUT.1.5.A05.1.454.CMB.1.raw
  modified_base (179)..(183): a, c, t, g, unknown or other
  misc_feature (179)..(183): n is a, c, g, or t
tcagacgagtgcgtcacgaccggtgctcgatttagatagatagacagggcaccaagggcccatcggtcttccccctggcaccctcctccaagagcacctctggggcacagcggccctgggctgcctggtcaaggactacttcctcgtactgcgctgagcgggctggcaaggcgcatagnnnnn

SEQ ID NO: 260737 - DNA, 179 bp, Homo sapiens; identical to SEQ ID NO: 259974
  misc_feature: GYAE6OF02GHLKS.1.5.A05.1.454.CMB.1.raw
  modified_base (178)..(179): a, c, t, g, unknown or other
  misc_feature (178)..(179): n is a, c, g, or t

SEQ ID NO: 260738 - DNA, 251 bp, Homo sapiens
  misc_feature: GYAE6OF02HL30W.1.5.A05.1.454.CMB.1.raw
  modified_base (247)..(251): a, c, t, g, unknown or other
  misc_feature (247)..(251): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgactgttgctgcacatctgtctcatcttccgcatctgacgtgtctgatctgagcggctggcaaggcgcaataggnnnnn

SEQ ID NO: 260739 - DNA, 181 bp, Homo sapiens
  misc_feature: GYAE6OF02IGSNY.1.5.A05.1.454.CMB.1.raw
  modified_base (179)..(181): a, c, t, g, unknown or other
  misc_feature (179)..(181): n is a, c, g, or t
tcagacgagtgcgtcacgaccggtgctcgatttagatagatagacagggcaccaagggcccatcggtcttccccctggcaccctcctccaagagcacctctggggcacagcggccctgggctgcctggtcaaggactacttcctcgtactgcgctgagcgggctggcaaggcgcatagnnn

SEQ ID NO: 260740 - DNA, 256 bp, Homo sapiens
  misc_feature: GYAE6OF02I5YUV.1.5.A05.1.454.CMB.1.raw
  modified_base (242)..(256): a, c, t, g, unknown or other
  misc_feature (242)..(256): n is a, c, g, or t
tcagacgagtgcgtcacgaccggtgctcgatttagatagatagacaggggcagttccagatttcaactgctcatcagcagcctgcagtctgaagattttgcagtttatactgtcagcagtataataactggcctcgacgttcggccaagggaccaaggtgaaatcaaacgactgtgctgcacatctgtctcatcttccgcatctgatcgtactgcgctgagcgggctggcaaggcgcatagnnnnnnnnnnnnnnn

SEQ ID NO: 260741 - DNA, 178 bp, Homo sapiens; identical to SEQ ID NO: 259891
  misc_feature: GYAE6OF02GY23B.1.5.A05.1.454.CMB.1.raw
  modified_base (178)..(178): a, c, t, g, unknown or other
  misc_feature (178)..(178): n is a, c, g, or t

SEQ ID NO: 260742 - DNA, 178 bp, Homo sapiens; identical to SEQ ID NO: 259891
  misc_feature: GYAE6OF02GIOD0.1.5.A05.1.454.CMB.1.raw
  modified_base (178)..(178): a, c, t, g, unknown or other
  misc_feature (178)..(178): n is a, c, g, or t

SEQ ID NO: 260743 - DNA, 179 bp, Homo sapiens; identical to SEQ ID NO: 259844
  misc_feature: GYAE6OF02HR6S2.1.5.A05.1.454.CMB.1.raw
  modified_base (178)..(179): a, c, t, g, unknown or other
  misc_feature (178)..(179): n is a, c, g, or t

SEQ ID NO: 260744 - DNA, 179 bp, Homo sapiens
  misc_feature: GYAE6OF02IXC9P.1.5.A05.1.454.CMB.1.raw
  modified_base (179)..(179): a, c, t, g, unknown or other
  misc_feature (179)..(179): n is a, c, g, or t
tcagacgagtgcgtcacgaccggtgctcgatttagatagatagacagggcaccaagggcccatcggtcttccccctggcaccctcctccaagagcacctctggggcacagcggccctgggctgcctggtcaaggactacttcctctctcgactctgagcgggctggcaaggcgcatagn

SEQ ID NO: 260745 - DNA, 183 bp, Homo sapiens
  misc_feature: GYAE6OF02JFFEU.1.5.A05.1.454.CMB.1.raw
  modified_base (174)..(183): a, c, t, g, unknown or other
  misc_feature (174)..(183): n is a, c, g, or t
tcagacgagtgcgtcacgaccggtgctcgatttagatagatagacagggcaccaaggccatcggtcttcccctggcaccctcctccaagagcacctctggggcacagcggcctgggctgcctggtcaaggactacttccagtactctatctgagcggctggcaaggcgcatagnnnnnnnnnn

SEQ ID NO: 260746 - DNA, 179 bp, Homo sapiens
  misc_feature: GYAE6OF02H8JPH.1.5.A05.1.454.CMB.1.raw
  modified_base (179)..(179): a, c, t, g, unknown or other
  misc_feature (179)..(179): n is a, c, g, or t
tcagacgagtgcgtcacgaccggtgctcgatttagatagatagacagggcaccaagggcccatcggtcttcccctggcaccctcctccaagagcacctctgggggcacagcggccctgggctgcctggtcaaggactacttcctcgtactgcgctgagcgggctggcaaggcgcatagn

SEQ ID NO: 260747 - DNA, 179 bp, Homo sapiens
  misc_feature: GYAE6OF02GFWB2.1.5.A05.1.454.CMB.1.raw
  modified_base (179)..(179): a, c, t, g, unknown or other
  misc_feature (179)..(179): n is a, c, g, or t
tcagacgagtgcgtcacgaccggtgctcgatttagatagatagacagggcaccaagggcccatcggtcttcccctggcaccctcctccaagagcacctctgggggcacagcggccctgggctgcctggtcaaggactacttccagtactctatctgagcgggctggcaaggcgcatagn

SEQ ID NO: 260748 - DNA, 190 bp, Homo sapiens
  misc_feature: GYAE6OF02IPHMT.1.5.A05.1.454.CMB.1.raw
  modified_base (181)..(190): a, c, t, g, unknown or other
  misc_feature (181)..(190): n is a, c, g, or t
tcagacgagtgcgtcacgaccggtgctcgatttagatagatagacagggcgaccaagggcccatcggtcttcccctggcaccctcctccaagagcacctctgggggcacgagcggccctgggctgcctggtcaaggactacttccagtactctatctgagcgggctggcaaggcgcatagnnnnnnnnnn

SEQ ID NO: 260749 - DNA, 178 bp, Homo sapiens; identical to SEQ ID NO: 259843
  misc_feature: GYAE6OF02GFTRR.1.5.A05.1.454.CMB.1.raw
  modified_base (178)..(178): a, c, t, g, unknown or other
  misc_feature (178)..(178): n is a, c, g, or t

SEQ ID NO: 260750 - DNA, 179 bp, Homo sapiens
  misc_feature: GYAE6OF02FHGZY.1.5.A05.1.454.CMB.1.raw
  modified_base (179)..(179): a, c, t, g, unknown or other
  misc_feature (179)..(179): n is a, c, g, or t
tcagacgagtgcgtcacgaccggtgctcgatttagatagatagacagggcaccaagggcccatcggtcttccccctggcaccctcctccaagagcacctctggggcacagcggccctgggctgcctggtcaaggactacttcctcgtactgcgctgagcgggctggcaaggcgcatagn

SEQ ID NO: 260751 - DNA, 250 bp, Homo sapiens
  misc_feature: GYAE6OF02JKCHW.1.5.A05.1.454.CMB.1.raw
  modified_base (216)..(216): a, c, t, g, unknown or other
  misc_feature (216)..(216): n is a, c, g, or t
  modified_base (240)..(250): a, c, t, g, unknown or other
  misc_feature (240)..(250): n is a, c, g, or t
tcagacgagtgcgtcacgaccggtgctcgatttagatagatagacagggcagttccagatttcaactgctcatcagcagcctgcagtctgaagatttgcagtttattactgtcagcagtataataactggcctcgacgttcggccaagggaccaggtgaaatcaaacgactgtggctgcacatctgtcttcatcttccgcatctgatcgtactgcnctgagcggctgcaaggcgcatagnnnnnnnnnnn

SEQ ID NO: 260752 - DNA, 180 bp, Homo sapiens
  misc_feature: GYAE6OF02G8AQW.1.5.A05.1.454.CMB.1.raw
  modified_base (178)..(180): a, c, t, g, unknown or other
  misc_feature (178)..(180): n is a, c, g, or t
tcagacgagtgcgtcacgaccggtgctcgatttagatagatagacagggcaccaagggcacatcggtcttcccctggcaccctcctccaagagcacctctggggcacagcggccctgggctgcctggtcaaggactacttccagtactctatctgagcgggctggcaaggcgcatagnnn

SEQ ID NO: 260753 - DNA, 253 bp, Homo sapiens; identical to SEQ ID NO: 259889
  misc_feature: GYAE6OF02H9UWC.1.5.A05.1.454.CMB.1.raw
  modified_base (251)..(253): a, c, t, g, unknown or other
  misc_feature (251)..(253): n is a, c, g, or t

SEQ ID NO: 260754 - DNA, 180 bp, Homo sapiens; identical to SEQ ID NO: 259868
  misc_feature: GYAE6OF02HWRSF.1.5.A05.1.454.CMB.1.raw
  modified_base (178)..(180): a, c, t, g, unknown or other
  misc_feature (178)..(180): n is a, c, g, or t

SEQ ID NO: 260755 - DNA, 181 bp, Homo sapiens
  misc_feature: GYAE6OF02JJEKZ.1.5.A05.1.454.CMB.1.raw
  modified_base (180)..(181): a, c, t, g, unknown or other
  misc_feature (180)..(181): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttcctcgtactgcgctgagcgggctggcaaggcgcatagnn

SEQ ID NO: 260756 - DNA, 179 bp, Homo sapiens
  misc_feature: GYAE6OF02H7OE7.1.5.A05.1.454.CMB.1.raw
  modified_base (179)..(179): a, c, t, g, unknown or other
  misc_feature (179)..(179): n is a, c, g, or t
tcagacgagtgcgtcacgaccggtgctcgatttagatagatagacagggcaccaagggcccatcggtcttccccctggcaccctcctccaagagcacctctggggcacagcggccctgggctgcctggtcaaggactacttccagtactctatctgagcgggctggcaaggcgcatagn

SEQ ID NO: 260757 - DNA, 252 bp, Homo sapiens; identical to SEQ ID NO: 260717
  misc_feature: GYAE6OF02GXX9J.1.5.A05.1.454.CMB.1.raw
  modified_base (250)..(252): a, c, t, g, unknown or other
  misc_feature (250)..(252): n is a, c, g, or t

SEQ ID NO: 260758 - DNA, 179 bp, Homo sapiens; identical to SEQ ID NO: 259841
  misc_feature: GYAE6OF02HOYYU.1.5.A05.1.454.CMB.1.raw
  modified_base (178)..(179): a, c, t, g, unknown or other
  misc_feature (178)..(179): n is a, c, g, or t

SEQ ID NO: 260759 - DNA, 179 bp, Homo sapiens; identical to SEQ ID NO: 259879
  misc_feature: GYAE6OF02G7CIN.1.5.A05.1.454.CMB.1.raw
  modified_base (178)..(179): a, c, t, g, unknown or other
  misc_feature (178)..(179): n is a, c, g, or t

SEQ ID NO: 260760 - DNA, 253 bp, Homo sapiens; identical to SEQ ID NO: 259889
  misc_feature: GYAE6OF02HDJ3S.1.5.A05.1.454.CMB.1.raw
  modified_base (251)..(253): a, c, t, g, unknown or other
  misc_feature (251)..(253): n is a, c, g, or t

SEQ ID NO: 260761 - DNA, 262 bp, Homo sapiens
  misc_feature: GYAE6OF02G0WJF.1.5.A05.1.454.CMB.1.raw
  modified_base (251)..(262): a, c, t, g, unknown or other
  misc_feature (251)..(262): n is a, c, g, or t
tcagacgagtgcgtcacgaccggtgctcgatttagatagatagacagggcagttccgagatttcaactgctcatcagcagcctgcagtctgaagattttgcagtttattacgtgtcagcagtataataactggcctccgacgttcggccaagggaccaaggtggaaatcaaacgaactgtggctgcaccatctgtcttcatcttcccgcatctgatcgtactgcgctgagcgggctggcaaggcgcatagnnnnnnnnnnnn

SEQ ID NO: 260762 - DNA, 179 bp, Homo sapiens; identical to SEQ ID NO: 260747
  misc_feature: GYAE6OF02GSN1T.1.5.A05.1.454.CMB.1.raw
  modified_base (179)..(179): a, c, t, g, unknown or other
  misc_feature (179)..(179): n is a, c, g, or t

SEQ ID NO: 260763 - DNA, 188 bp, Homo sapiens
  misc_feature: GYAE6OF02J032I.1.5.A05.1.454.CMB.1.raw
  modified_base (179)..(188): a, c, t, g, unknown or other
  misc_feature (179)..(188): n is a, c, g, or t
tcagacgagtgcgtcacgaccggtgctcgatttagatagatagacagggcaaccaagggcccatcggtcttcccctggcaccctcctccaagagcacctctggggcacagcggccctgggctgcctggtcaaggactacttcctcgtactgcgctgagcgggctggcaaggcgcatagnnnnnnnnnn

SEQ ID NO: 260764 - DNA, 181 bp, Homo sapiens
  misc_feature: GYAE6OF02G1NI8.1.5.A05.1.454.CMB.1.raw
  modified_base (178)..(181): a, c, t, g, unknown or other
  misc_feature (178)..(181): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctactgctagtctgagcgggctggcaaggcgcatagnnnn

SEQ ID NO: 260765 - DNA, 254 bp, Homo sapiens
  misc_feature: GYAE6OF02I39AR.1.5.A05.1.454.CMB.1.raw
  modified_base (250)..(254): a, c, t, g, unknown or other
  misc_feature (250)..(254): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgcatctgatcgtactgcgctgagcgggctggcaaggcgcatagnnnnn

SEQ ID NO: 260766 - DNA, 180 bp, Homo sapiens
  misc_feature: GYAE6OF02GUZD4.1.5.A05.1.454.CMB.1.raw
  modified_base (178)..(180): a, c, t, g, unknown or other
  misc_feature (178)..(180): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctcgtagcactctgagcgggctggcaaggcgcatagnnn

SEQ ID NO: 260767 - DNA, 179 bp, Homo sapiens; identical to SEQ ID NO: 259841
  misc_feature: GYAE6OF02GUDG4.1.5.A05.1.454.CMB.1.raw
  modified_base (178)..(179): a, c, t, g, unknown or other
  misc_feature (178)..(179): n is a, c, g, or t

SEQ ID NO: 260768 - DNA, 499 bp, Homo sapiens
  misc_feature: GYAE6OF02HAG6W.1.5.A05.1.454.CMB.1.raw
  modified_base (204)..(205): a, c, t, g, unknown or other
  misc_feature (204)..(205): n is a, c, g, or t
  modified_base (208)..(208): a, c, t, g, unknown or other
  misc_feature (208)..(208): n is a, c, g, or t
  modified_base (210)..(210): a, c, t, g, unknown or other
  misc_feature (210)..(210): n is a, c, g, or t
  modified_base (212)..(213): a, c, t, g, unknown or other
  misc_feature (212)..(213): n is a, c, g, or t
  modified_base (215)..(216): a, c, t, g, unknown or other
  misc_feature (215)..(216): n is a, c, g, or t
  modified_base (220)..(220): a, c, t, g, unknown or other
  misc_feature (220)..(220): n is a, c, g, or t
  modified_base (225)..(226): a, c, t, g, unknown or other
  misc_feature (225)..(226): n is a, c, g, or t
  modified_base (228)..(229): a, c, t, g, unknown or other
  misc_feature (228)..(229): n is a, c, g, or t
  modified_base (235)..(237): a, c, t, g, unknown or other
  misc_feature (235)..(237): n is a, c, g, or t
  modified_base (240)..(241): a, c, t, g, unknown or other
  misc_feature (240)..(241): n is a, c, g, or t
  modified_base (248)..(249): a, c, t, g, unknown or other
  misc_feature (248)..(249): n is a, c, g, or t
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (262)..(262): a, c, t, g, unknown or other
  misc_feature (262)..(262): n is a, c, g, or t
  modified_base (270)..(270): a, c, t, g, unknown or other
  misc_feature (270)..(270): n is a, c, g, or t
  modified_base (274)..(276): a, c, t, g, unknown or other
  misc_feature (274)..(276): n is a, c, g, or t
  modified_base (280)..(280): a, c, t, g, unknown or other
  misc_feature (280)..(280): n is a, c, g, or t
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
  modified_base (313)..(313): a, c, t, g, unknown or other
  misc_feature (313)..(313): n is a, c, g, or t
  modified_base (318)..(318): a, c, t, g, unknown or other
  misc_feature (318)..(318): n is a, c, g, or t
  modified_base (320)..(320): a, c, t, g, unknown or other
  misc_feature (320)..(320): n is a, c, g, or t
  modified_base (322)..(322): a, c, t, g, unknown or other
  misc_feature (322)..(322): n is a, c, g, or t
  modified_base (329)..(329): a, c, t, g, unknown or other
  misc_feature (329)..(329): n is a, c, g, or t
  modified_base (333)..(333): a, c, t, g, unknown or other
  misc_feature (333)..(333): n is a, c, g, or t
  modified_base (335)..(335): a, c, t, g, unknown or other
  misc_feature (335)..(335): n is a, c, g, or t
  modified_base (337)..(337): a, c, t, g, unknown or other
  misc_feature (337)..(337): n is a, c, g, or t
  modified_base (376)..(376): a, c, t, g, unknown or other
  misc_feature (376)..(376): n is a, c, g, or t
tcagacgagtgcgtcacgaccggtgctcgatttagatagatagacagggggcaccaagggcccgatcggtctcccctggcgaccctcctccaacgagcgaccctcgtcgggggtcacagcggtcccctgggcccttcgcctaggtccaagggactacttccgtctcgtccgactctgacgcgggctggcaacggcgccactagnngcncngnncnncacntctcnncnngacacnnnctnntgtatanncntcngnacanancagacacnccannntatngntntctatatcgtctcgtcgtcactctctctntcgcnangngcgcgcnctcncncnctctcgcgctcgcgagagagacgacgtagtatatatatncgcgctacactactacgacgacgacgacgacgacgtacgtcgtacggtacggtacggacggacgacgtacgtacgtacgtacgtacgtacgacgaccgaccgtaccgtccgtccgtaccgtcg

SEQ ID NO: 260769 - DNA, 523 bp, Homo sapiens
  misc_feature: GYAE6OF02F8IKL.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaattcacagaagttcagggcagagtcactttaccagggacacatccgcgaggattactatatggagctgagcagcctgagatccgaagacacggctgtattattttgtgtcgtactctagtgaggtcattattacgctctaatttgactccgtgggcctacgggaccctggtacctaccggtctcctaccg

SEQ ID NO: 260770 - DNA, 254 bp, Homo sapiens; identical to SEQ ID NO: 259973
  misc_feature: GYAE6OF02GOXMS.1.5.A05.1.454.CMB.1.raw
  modified_base (251)..(254): a, c, t, g, unknown or other
  misc_feature (251)..(254): n is a, c, g, or t

SEQ ID NO: 260771 - DNA, 199 bp, Homo sapiens
  misc_feature: GYAE6OF02G8AZE.1.5.A05.1.454.CMB.1.raw
  modified_base (180)..(199): a, c, t, g, unknown or other
  misc_feature (180)..(199): n is a, c, g, or t
tcagacgagtgcgtcacgaccggtgctcgatttagatagatagacgagggcaccaagggcccatcggtcttccccctggcaccctcctccaagagcacctctggggcacagcggccctgggctgcctggtcaaggactacttcctcgtactgcgctgagcgggctggcaaggcgcatagnnnnnnnnnnnnnnnnnnnn

SEQ ID NO: 260772 - DNA, 182 bp, Homo sapiens
  misc_feature: GYAE6OF02H0VH4.1.5.A05.1.454.CMB.1.raw
  modified_base (178)..(182): a, c, t, g, unknown or other
  misc_feature (178)..(182): n is a, c, g, or t
tcagacgagtgcgtcacgaccggtgctcgatttagatagatagacagggcaccaagggcccatcggtcttcccctggcaccctcctccaagagcacctctggggcacagcagccctgggctgcctggtcaaggactacttccagtactctatctgagcgggctggcaaggcgcatagnnnnn

SEQ ID NO: 260773 - DNA, 179 bp, Homo sapiens; identical to SEQ ID NO: 259879
  misc_feature: GYAE6OF02HTK5X.1.5.A05.1.454.CMB.1.raw
  modified_base (178)..(179): a, c, t, g, unknown or other
  misc_feature (178)..(179): n is a, c, g, or t

SEQ ID NO: 260774 - DNA, 178 bp, Homo sapiens; identical to SEQ ID NO: 259891
  misc_feature: GYAE6OF02FUBQS.1.5.A05.1.454.CMB.1.raw
  modified_base (178)..(178): a, c, t, g, unknown or other
  misc_feature (178)..(178): n is a, c, g, or t

SEQ ID NO: 260775 - DNA, 181 bp, Homo sapiens
  misc_feature: GYAE6OF02H5Z66.1.5.A05.1.454.CMB.1.raw
  modified_base (181)..(181): a, c, t, g, unknown or other
  misc_feature (181)..(181): n is a, c, g, or t
tcagacgagtgcgtcacgaccggtgctcgatttagatagatagacagggcaccaagggcccatcggtcttccccctggcaccctccctccaagagcacctcgtggggcacagcggccctgggctgcctggtcaaggactacttcctacgtgagctctgagcgggctggcaaggcgcatagn

SEQ ID NO: 260776 - DNA, 187 bp, Homo sapiens
  misc_feature: GYAE6OF02I0BU6.1.5.A05.1.454.CMB.1.raw
  modified_base (180)..(187): a, c, t, g, unknown or other
  misc_feature (180)..(187): n is a, c, g, or t
tcagacgagtgcgtcacgaccggtgctcgatttagatagatagacagggcgaccgaagggcccatcggtcttcccctggcaccctcctccaagagcacctctggggcacagcggccctgggctgcctggtcaaggactacttcctcgatcgcgtctgagcgggctggcaaggcgcatagnnnnnnnn

SEQ ID NO: 260777 - DNA, 186 bp, Homo sapiens
  misc_feature: GYAE6OF02HGGHA.1.5.A05.1.454.CMB.1.raw
  modified_base (179)..(186): a, c, t, g, unknown or other
  misc_feature (179)..(186): n is a, c, g, or t
tcagacgagtgcgtcacgaccggtgctcgatttagatagatagacagggcaccaagggcccatcggtcttccccctggcaccctcctccaagagcacctctggggcacagcggccctgggctgcctggtcaaggactacttccagtactctatctgagcgggctggcaaggcgcatagnnnnnnnn

SEQ ID NO: 260778 - DNA, 539 bp, Homo sapiens
  misc_feature: GYAE6OF02HLPYZ.1.5.A05.1.454.CMB.1.raw
  modified_base (222)..(222): a, c, t, g, unknown or other
  misc_feature (222)..(222): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttccngcaaggcttcaggatacaccttcactaggtatgctatacattgggtgcgccaggccccccggacaaaggcttgagtggatgggatggatcaacgctggcaatggtaacacaaaaaattcaacagaagttccagggcagagtcacctttaccagggacacatccgcgaggattacttatatggagctgagcagcctgagatccgaagacacggctgttatatttttgtgcgtacctctaagtggaggtctattattacgtctctaatttcgacttccgtgggcctacgggtaaccctggtcgacccgttctccctccg

SEQ ID NO: 260779 - DNA, 182 bp, Homo sapiens; identical to SEQ ID NO: 259848
  misc_feature: GYAE6OF02JC70U.1.5.A05.1.454.CMB.1.raw
  modified_base (178)..(182): a, c, t, g, unknown or other
  misc_feature (178)..(182): n is a, c, g, or t

SEQ ID NO: 260780 - DNA, 182 bp, Homo sapiens
  misc_feature: GYAE6OF02FUB5N.1.5.A05.1.454.CMB.1.raw
  modified_base (178)..(182): a, c, t, g, unknown or other
  misc_feature (178)..(182): n is a, c, g, or t
tcagacgagtgcgtcacgaccggtgctcgatttagatagatagacagggcaccaagggcccatcggtcttccccaggcaccctcctccaagagcacctctggggcacagcggccctgggctgcctggtcaaggactacttcctcgatcgcgtctgagcgggctggcaaggcgcatagnnnnn

SEQ ID NO: 260781 - DNA, 518 bp, Homo sapiens
  misc_feature: GYAE6OF02G7OBC.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcacagaagttccagggcagagtcacctttacagggacacatccgcgaggattactatatggagctgagcagcctgagatccgaagacacggctgtatattttgtgcgacctctagtggagtcattattacgctcaatttgactctgggccagggtaaccctggtccaccgtctcctacg

SEQ ID NO: 260782 - DNA, 180 bp, Homo sapiens
  misc_feature: GYAE6OF02HBWP4.1.5.A05.1.454.CMB.1.raw
  modified_base (179)..(180): a, c, t, g, unknown or other
  misc_feature (179)..(180): n is a, c, g, or t
tcagacgagtgcgtcacgaccggtgctcgatttagatagatagacagggcaccaagggcccatcggtcttccacctggcaccctcctccaagagcacctctggggcacagcggccctgggctgcctggtcaaggactacttccacgcactcgtctgagcgggctggcaaggcgcatagnn

SEQ ID NO: 260783 - DNA, 513 bp, Homo sapiens
  misc_feature: GYAE6OF02G56XR.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcacagaagttccagggcagagtcactttaccagggacacatccgcgaggattactatatggagctgagcagcctgagatccgaagacacggctgtatatttttgtgtcgtactctagtggaggtcattatacgctcaattgactctgggccagggaccctggtcacgtctcctcg

SEQ ID NO: 260784 - DNA, 255 bp, Homo sapiens
  misc_feature: GYAE6OF02I15R8.1.5.A05.1.454.CMB.1.raw
  modified_base (249)..(255): a, c, t, g, unknown or other
  misc_feature (249)..(255): n is a, c, g, or t
tcagacgagtgcgtcacgaccggtgctcgatttagatagatagacagggcagttccagatttcaactgctcatcagcagcctgcagtctgaagattttgcagtttattactgtcagcagtataataactggcctccgacgttcggccaagggaccaaggtgaaatcaaacgactgtggctgcaccatctgtcttcatcttcccgcatctgatcgtactgcgctagagcgggctggacaaggcgcatagnnnnnnn

SEQ ID NO: 260785 - DNA, 179 bp, Homo sapiens; identical to SEQ ID NO: 259987
  misc_feature: GYAE6OF02I3U2O.1.5.A05.1.454.CMB.1.raw
  modified_base (178)..(179): a, c, t, g, unknown or other
  misc_feature (178)..(179): n is a, c, g, or t

SEQ ID NO: 260786 - DNA, 256 bp, Homo sapiens
  misc_feature: GYAE6OF02JKAY5.1.5.A05.1.454.CMB.1.raw
  modified_base (251)..(256): a, c, t, g, unknown or other
  misc_feature (251)..(256): n is a, c, g, or t
tcagacgagtgcgtcacgaccggtgctcgatttagatagatagacagggcgagttccagattcaactgctcatcagcagcctgcagtctgaagatttgcagtttattactgtcagcagtataataactaggcctccgacgttcggccaagggaccaaggtggaaatcaaacgaactagtggctgcaccatctgtcttcatcttcccgccatctgagagtgcgtctctgagcgggctggcaaggcgcatagnnnnnn

SEQ ID NO: 260787 - DNA, 532 bp, Homo sapiens
  misc_feature: GYAE6OF02HR42W.1.5.A05.1.454.CMB.1.raw
  modified_base (448)..(448): a, c, t, g, unknown or other
  misc_feature (448)..(448): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcgaacgctggcaatggtaaacacaaaaaattcaacagaagttccagggcagagtcactttaccagggacacatccgcgaggattacttatatggagctgagcagcctgagataccgaagacacgctgtattattttgngcgtactcgtagtggagtcattattacgctacgaatttgactcgtgggccagggtaaccctggtaccaccggttctccgtaccg

SEQ ID NO: 260788 - DNA, 254 bp, Homo sapiens; identical to SEQ ID NO: 260765
  misc_feature: GYAE6OF02IGSVM.1.5.A05.1.454.CMB.1.raw
  modified_base (250)..(254): a, c, t, g, unknown or other
  misc_feature (250)..(254): n is a, c, g, or t

SEQ ID NO: 260789 - DNA, 547 bp, Homo sapiens
  misc_feature: GYAE6OF02GZZ45.1.5.A05.1.454.CMB.1.raw
  modified_base (441)..(441): a, c, t, g, unknown or other
  misc_feature (441)..(441): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaattcacagaagttcagggcagagtcacctttaccagggacacatccgcgagattactatatggagctgagcagcctgagatccgaagacacggctgtatatttttgngtcgtacctcgttagtgggtagtctattattacgcttcgtaatttcgacttccgtggggtacccacggggtaacccttgggtaccgtaccgttccgtccgttaccg

SEQ ID NO: 260790 - DNA, 253 bp, Homo sapiens; identical to SEQ ID NO: 259889
  misc_feature: GYAE6OF02F22II.1.5.A05.1.454.CMB.1.raw
  modified_base (251)..(253): a, c, t, g, unknown or other
  misc_feature (251)..(253): n is a, c, g, or t

SEQ ID NO: 260791 - DNA, 902 bp, Homo sapiens
  misc_feature: GYAE6OF02H7NJX.1.5.A05.1.454.CMB.1.raw
  modified_base (144)..(144): a, c, t, g, unknown or other
  misc_feature (144)..(144): n is a, c, g, or t
  modified_base (248)..(248): a, c, t, g, unknown or other
  misc_feature (248)..(248): n is a, c, g, or t
tcagacgagtgcgtcacgaccggtgctcgatttagatagatagactagggggtacccgaacaaccacagtccctccgtcacgaagcccccagagcaccaacgcccctaccattgggactggacctggaggatcctacttttggnggcagcagccacgagggttgcccactcccaggtccgtacgtctttgtttagcacgtctggggctgaggtgaagaggccgtggggcctggaggtgaaggtttccnggccggtaacggtcttcaggacttacgaaccttcactaggtatcgtacttatactattagggtagtcgtacctaggccccccggactaaaacggggtcctttggaacggttggaacgtgggggacgttgggtaatccgaacggtccttggtacctaaattagggttaaacgaactaaaaaagtttcgaaacgtaagtaaagtttacccgaaggggtacgtaaggacggtttacctaacccggtttttaaccgaacggggggtaaccaaccgttacgtaccccggtacggtaaccgggtaactttaaaccgttaagttaaacgttaacggggtaaacgtaacccgttaaacggaaccgtaccgtaacggtcccgttacggaaacggtaacgttacccggaaacggaacccgtacgggaccgttaagggttaattaacgttttttacggacggtaccgtacccgttaaccgttaagggtttacggttaacgggtttactaaagtttaaggtttaaccgggtacttttaaccggtaaagttttttaccggaaccggtttaacccggttaacggggggtacccgttaaacggggttaacccccggtttacgggtttaccccggtaacccggtttcccgttacccggtttaaccccggg

SEQ ID NO: 260792 - DNA, 181 bp, Homo sapiens; identical to SEQ ID NO: 259842
  misc_feature: GYAE6OF02GPJG4.1.5.A05.1.454.CMB.1.raw
  modified_base (178)..(181): a, c, t, g, unknown or other
  misc_feature (178)..(181): n is a, c, g, or t

SEQ ID NO: 260793 - DNA, 513 bp, Homo sapiens
  misc_feature: GYAE6OF02GQG8B.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatggggatggatcaacgctggcaatggtaacacaaaaattcacagaagttccagggcagagtcactttaccagggacacatccgcgaggattactatatgagctgagcagcctgagatccgaagacacggctgtatattttgtgtcgactctagtggagtcattattacgctcaatttgactctgggccagggaccctggtcacgtctctaccg

SEQ ID NO: 260794 - DNA, 536 bp, Homo sapiens
  misc_feature: GYAE6OF02G5JAN.1.5.A05.1.454.CMB.1.raw
  modified_base (443)..(443): a, c, t, g, unknown or other
  misc_feature (443)..(443): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaattcaacagaagttccagggcagagtcacctttacagggacacatccgcgaggatactatatggagctgagcagcctgagatccgaagacacggctagtattattttgngtcgtacctctagtggaggtcattattacgcttacgaattttggacttccgtggggcccaaggggtaccctggtccaccggttctccctaccg

SEQ ID NO: 260795 - DNA, 543 bp, Homo sapiens
  misc_feature: GYAE6OF02IKSXZ.1.5.A05.1.454.CMB.1.raw
  modified_base (385)..(385): a, c, t, g, unknown or other
  misc_feature (385)..(385): n is a, c, g, or t
  modified_base (447)..(447): a, c, t, g, unknown or other
  misc_feature (447)..(447): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcaacaagaagttaccaggcagagtcactttaccaggacacatccgngaggattacttatatggagctgagcagcctgagatccgaagacacggctagttatattttgngtcgtactcgtagtggtagtctattattacgtctcgtaatttgactccgtggggacctacgggaacccttggtacctaaccggttcctccgtaccg

SEQ ID NO: 260796 - DNA, 179 bp, Homo sapiens; identical to SEQ ID NO: 259841
  misc_feature: GYAE6OF02GG3DL.1.5.A05.1.454.CMB.1.raw
  modified_base (178)..(179): a, c, t, g, unknown or other
  misc_feature (178)..(179): n is a, c, g, or t

SEQ ID NO: 260797 - DNA, 253 bp, Homo sapiens; identical to SEQ ID NO: 259889
  misc_feature: GYAE6OF02I7ABR.1.5.A05.1.454.CMB.1.raw
  modified_base (251)..(253): a, c, t, g, unknown or other
  misc_feature (251)..(253): n is a, c, g, or t

SEQ ID NO: 260798 - DNA, 253 bp, Homo sapiens
  misc_feature: GYAE6OF02II7SS.1.5.A05.1.454.CMB.1.raw
  modified_base (250)..(253): a, c, t, g, unknown or other
  misc_feature (250)..(253): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgactgtggctgcaccatctgtcttcatcttcccgccatctgatcgtactgcgctgagcgggctggcaaggcgcatagnnnn

SEQ ID NO: 260799 - DNA, 180 bp, Homo sapiens; identical to SEQ ID NO: 259868
  misc_feature: GYAE6OF02HF04U.1.5.A05.1.454.CMB.1.raw
  modified_base (178)..(180): a, c, t, g, unknown or other
  misc_feature (178)..(180): n is a, c, g, or t

SEQ ID NO: 260800 - DNA, 263 bp, Homo sapiens
  misc_feature: GYAE6OF02H8AZQ.1.5.A05.1.454.CMB.1.raw
  modified_base (246)..(246): a, c, t, g, unknown or other
  misc_feature (246)..(246): n is a, c, g, or t
  modified_base (252)..(263): a, c, t, g, unknown or other
  misc_feature (252)..(263): n is a, c, g, or t
tcagacgagtgcgtcacgaccggtgctcgatttagatagatagacaggggcaggttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatctgatcgtactgcgctgagcgggctggcaaggcncatagnnnnnnnnnnnn

SEQ ID NO: 260801 - DNA, 325 bp, Homo sapiens
  misc_feature: GYAE6OF02I4KZ3.1.5.A05.1.454.CMB.1.raw
  modified_base (290)..(325): a, c, t, g, unknown or other
  misc_feature (290)..(325): n is a, c, g, or t
tcagacgagtgcgtcacgaccggtgctcgatttagatagatagacaggggcagttccgagatttcaactgctcatcagcagcctgccagtctgaagattttgcagtttattactgtcagaagtataataaactggccctccggacgttacggtcctaagggaccgaaaggtgggaaaattcaaaccgaaactcgtaggctgtcaccatcgtagtcttccactcttcccgccactcgtcgatcgtaactgcgtcgtgacgcgggcgtggcgaacggcggaccaataacggnnnnnnnnnnnnnnnnnnnnnnnnnnnnnnnnnnnn

SEQ ID NO: 260802 - DNA, 253 bp, Homo sapiens; identical to SEQ ID NO: 259912
  misc_feature: GYAE6OF02JHBK1.1.5.A05.1.454.CMB.1.raw
  modified_base (250)..(253): a, c, t, g, unknown or other
  misc_feature (250)..(253): n is a, c, g, or t

SEQ ID NO: 260803 - DNA, 254 bp, Homo sapiens
  misc_feature: GYAE6OF02F1NNK.1.5.A05.1.454.CMB.1.raw
  modified_base (250)..(254): a, c, t, g, unknown or other
  misc_feature (250)..(254): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttccgccatctgatcgtactgcgctgagcgggctggcaaggcgcatagnnnnn

SEQ ID NO: 260804 - DNA, 193 bp, Homo sapiens
  misc_feature: GYAE6OF02IX3OF.1.5.A05.1.454.CMB.1.raw
  modified_base (178)..(193): a, c, t, g, unknown or other
  misc_feature (178)..(193): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctgtactgcgctgagcgggctggcaaggcgtcatagnnnnnnnnnnnnnnnn

SEQ ID NO: 260805 - DNA, 252 bp, Homo sapiens
  misc_feature: GYAE6OF02I6F3G.1.5.A05.1.454.CMB.1.raw
  modified_base (249)..(252): a, c, t, g, unknown or other
  misc_feature (249)..(252): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttccgcatctgatcgtactgcgctgagcgggctggcaaggcgcatagnnnn

SEQ ID NO: 260806 - DNA, 592 bp, Homo sapiens
  misc_feature: GYAE6OF02IKR15.1.5.A05.1.454.CMB.1.raw
  modified_base (207)..(207): a, c, t, g, unknown or other
  misc_feature (207)..(207): n is a, c, g, or t
  modified_base (284)..(284): a, c, t, g, unknown or other
  misc_feature (284)..(284): n is a, c, g, or t
  modified_base (497)..(497): a, c, t, g, unknown or other
  misc_feature (497)..(497): n is a, c, g, or t
  modified_base (529)..(529): a, c, t, g, unknown or other
  misc_feature (529)..(529): n is a, c, g, or t
tcagacgagtgcgtcacgaccggtgctcgatttagatagatagacaggggacccaacaaccacatccctcctcagaagccccagagcacaacgccccaccatggactggacctggaggatcctctttttggtggcagcagccacaggtgcccactcccaggtccagcttgtgcagtctggggctgaggtgaagaagcctggggcctnagtgaaggtttcctgcaaggcttcaggatacaccttcactaggtatgctatacattgggtgcgccaggcccccgganaaaggcttgagtggatgggatggatcaacgctggcaagtaggtaacaacgaaaaaaattcaacaagaaagttaccgaagggacagagtcaacctttaccgaagggacaacgactaccgacgaaggtaatttaaccttaatagtagggtagtacgttaggagacaaggccgtagagaacgtccgaaagaccgacggtctagttattagttttgngtccgactcgtacgtggagtactattatacgntactaagtttcacttccgtagggacctacgggtacccgtaggtacctaccggttctcctaccg

SEQ ID NO: 260807 - DNA, 553 bp, Homo sapiens
  misc_feature: GYAE6OF02H2LPQ.1.5.A05.1.454.CMB.1.raw
  modified_base (430)..(430): a, c, t, g, unknown or other
  misc_feature (430)..(430): n is a, c, g, or t
tcagacgagtgcgtcacgaccggtgctcgatttagatagatagacaggggacccaacaaccacactccctcctcagaacgccccagagcacaaccgccccaccatggactggacctggaggatccttctttttggtggcagcagccacaggtgcccactcccaggtccagcttgtgcagtctggggctgaggtgaagagcctggggcctcagtgagtttcctgcaggcttcaggatacaccttcactaggtatgctatacattgggtgcgccaggcccccggacaaaggcttgagtggatgggatggatcgaacgcgtggcaatggtaacaacaaaaattcaacagagttaccaggcagagtcacctttacagggacacatccgcgagattactatatggagctgagcagctgagatccgaagacacggntgtattattttgtgcgtaccttcgtagtggtagtactagtttattacgcttacgtaattttcgaccttccgtggggtaccgtaacggggtacccttggtcccacccggttcctccctacccgg

SEQ ID NO: 260808 - DNA, 181 bp, Homo sapiens
  misc_feature: GYAE6OF02HR8AG.1.5.A05.1.454.CMB.1.raw
  modified_base (179)..(181): a, c, t, g, unknown or other
  misc_feature (179)..(181): n is a, c, g, or t
tcagacgagtgcgtcacgaccggtgctcgatttagatagatagacagggcaccaagggcccatcggtcttcccctggcaccctcctccaagagcacctctgggggcacagcggccctgggctgcctggtcaaggactacttcctcgatcgcgtctgagcgggctggcaaggcgcatagnnn

SEQ ID NO: 260809 - DNA, 284 bp, Homo sapiens
  misc_feature: GYAE6OF02I62SH.1.5.A05.1.454.CMB.1.raw
  modified_base (258)..(284): a, c, t, g, unknown or other
  misc_feature (258)..(284): n is a, c, g, or t
tcagacgagtgcgtcacgaccggtgctcgatttagatagatagacaggggcgagttccagatttcaactgctcatcagcagcctgcagtctgaagattttgcagtttattactgtcagcagtataataactggcctccgacgttcggcctaagggaccaaggtgaaattacaaacgaactgttgctggcaccatctgtcttcgagtcttcccgcatctggactgtctgatctgagcgggctggcaaggctcaagtagnnnnnnnnnnnnnnnnnnnnnnnnnnn

SEQ ID NO: 260810 - DNA, 180 bp, Homo sapiens; identical to SEQ ID NO: 259970
  misc_feature: GYAE6OF02G0AHD.1.5.A05.1.454.CMB.1.raw
  modified_base (178)..(180): a, c, t, g, unknown or other
  misc_feature (178)..(180): n is a, c, g, or t

SEQ ID NO: 260811 - DNA, 181 bp, Homo sapiens
  misc_feature: GYAE6OF02ITBJN.1.5.A05.1.454.CMB.1.raw
  modified_base (180)..(181): a, c, t, g, unknown or other
  misc_feature (180)..(181): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttcctctctcgactctgagcgggctggcaaggcgcatagnn

SEQ ID NO: 260812 - DNA, 178 bp, Homo sapiens
  misc_feature: GYAE6OF02H4Y0C.1.5.A05.1.454.CMB.1.raw
  modified_base (178)..(178): a, c, t, g, unknown or other
  misc_feature (178)..(178): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttccatagcgtactctgagcgggctggcaaggcgcatagn

SEQ ID NO: 260813 - DNA, 528 bp, Homo sapiens
  misc_feature: GYAE6OF02GHEBU.1.5.A05.1.454.CMB.1.raw
  modified_base (267)..(267): a, c, t, g, unknown or other
  misc_feature (267)..(267): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtncgccaggcccccggacaaaggcttgagtggatggggatggatcaacgctggcaatggtaacacaaaaaattcaacagaagttcagggcagagtcacctttacagggacacatccgcgaggattactatatggagctgagcagcctgagatccgaagacacggctgtattattttgtgtcgtaccttctaggtggaggtcattattacgctcgaatttgacttccgtggggccaggggaccctggtccgaccgtctcctacg

SEQ ID NO: 260814 - DNA, 254 bp, Homo sapiens; identical to SEQ ID NO: 259973
  misc_feature: GYAE6OF02IUYDU.1.5.A05.1.454.CMB.1.raw
  modified_base (251)..(254): a, c, t, g, unknown or other
  misc_feature (251)..(254): n is a, c, g, or t

SEQ ID NO: 260815 - DNA, 255 bp, Homo sapiens
  misc_feature: GYAE6OF02JIJM3.1.5.A05.1.454.CMB.1.raw
  modified_base (250)..(255): a, c, t, g, unknown or other
  misc_feature (250)..(255): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgactgtggctgcaccatctgtcttcatcttcccgccatctgatcgtactgcgctgagcgggctggcaaggcgcatagnnnnnn

SEQ ID NO: 260816 - DNA, 509 bp, Homo sapiens
  misc_feature: GYAE6OF02IES33.1.5.A05.1.454.CMB.1.raw
  modified_base (382)..(382): a, c, t, g, unknown or other
  misc_feature (382)..(382): n is a, c, g, or t
  modified_base (429)..(429): a, c, t, g, unknown or other
  misc_feature (429)..(429): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcacagaagttccagggcagagtcacttacagggacacatccgngaggatacttatatggagctgagcagcctgagatccgaagacaggcngtatattttgtgcgactctagtgagtcattatacgctcaatttgactctgggcacgggaccctggtccacgtctcctacg

SEQ ID NO: 260817 - DNA, 519 bp, Homo sapiens
  misc_feature: GYAE6OF02HNY5D.1.5.A05.1.454.CMB.1.raw
  modified_base (481)..(481): a, c, t, g, unknown or other
  misc_feature (481)..(481): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcacagaagttccagggcagagtcactttaccagggacacatccgcgaggattacttatatggagctgagcagcctgagatccgaagacacggctgtatatttttgtgtcgactctagtggagtcattattacgctcaatttnactcctgggccagggaccctggtccaccgtctcctccg

SEQ ID NO: 260818 - DNA, 254 bp, Homo sapiens; identical to SEQ ID NO: 259973
  misc_feature: GYAE6OF02HVJ8J.1.5.A05.1.454.CMB.1.raw
  modified_base (251)..(254): a, c, t, g, unknown or other
  misc_feature (251)..(254): n is a, c, g, or t

SEQ ID NO: 260819 - DNA, 523 bp, Homo sapiens
  misc_feature: GYAE6OF02IT7I2.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcaacagaagttaccagggcagagtcacctttaccaggacacatccgcgaggattactatatggagctgagcagcctgagatccgaagacacggctgtatattttgtgcgtacctcttagtggagttcattattacgctcgtaatttcgactccgtgggccagggacctggtcaccgtctcctcg

SEQ ID NO: 260820 - DNA, 182 bp, Homo sapiens
  misc_feature: GYAE6OF02H09R3.1.5.A05.1.454.CMB.1.raw
  modified_base (179)..(182): a, c, t, g, unknown or other
  misc_feature (179)..(182): n is a, c, g, or t
tcagacgagtgcgtcacgaccggtgctcgatttagatagatagacagggcaccaagggcccatcggtcttcccctggcaccctcctccaagagcacctctgggggcacagcggccctgggctgcctggtcaaggactacttcctctctcgactctgagcgggctggcaaggcgcatagnnnn

SEQ ID NO: 260821 - DNA, 181 bp, Homo sapiens
  misc_feature: GYAE6OF02I7UA5.1.5.A05.1.454.CMB.1.raw
  modified_base (179)..(181): a, c, t, g, unknown or other
  misc_feature (179)..(181): n is a, c, g, or t
tcagacgagtgcgtcacgaccggtgctcgatttagatagatagacagggcaccaagggcccatcggtcttccccctggcaccctcctccaagagcacctctggggcacagcggccctgggctgcctggtcaaggactacttccagtactctatctgagcgggctggcaaggcgcatagnnn

SEQ ID NO: 260822 - DNA, 253 bp, Homo sapiens; identical to SEQ ID NO: 259889
  misc_feature: GYAE6OF02GVEOH.1.5.A05.1.454.CMB.1.raw
  modified_base (251)..(253): a, c, t, g, unknown or other
  misc_feature (251)..(253): n is a, c, g, or t

SEQ ID NO: 260823 - DNA, 217 bp, Homo sapiens
  misc_feature: GYAE6OF02HZAXL.1.5.A05.1.454.CMB.1.raw
  modified_base (183)..(217): a, c, t, g, unknown or other
  misc_feature (183)..(217): n is a, c, g, or t
tcagacgagtgcgtcacgaccggtgctcgatttagatagatagacagggcaccaagggcccatcggtcttcccctggcaccctcctccaagagcacctctgggggcacagcggtccctggactgcctggtcaaggactaacgttccagtactctatctgagcgggctggcaaggcgcatacgnnnnnnnnnnnnnnnnnnnnnnnnnnnnnnnnnnn

SEQ ID NO: 260824 - DNA, 183 bp, Homo sapiens; identical to SEQ ID NO: 260080
  misc_feature: GYAE6OF02JSLC6.1.5.A05.1.454.CMB.1.raw
  modified_base (178)..(183): a, c, t, g, unknown or other
  misc_feature (178)..(183): n is a, c, g, or t

SEQ ID NO: 260825 - DNA, 538 bp, Homo sapiens
  misc_feature: GYAE6OF02IDTG1.1.5.A05.1.454.CMB.1.raw
  modified_base (405)..(405): a, c, t, g, unknown or other
  misc_feature (405)..(405): n is a, c, g, or t
  modified_base (449)..(449): a, c, t, g, unknown or other
  misc_feature (449)..(449): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggatgctatacattgggtgcgccaggcccccggacaaaggcttgagtggatgggatgggatcaacgctggcaatggtaacacaaaaaattcacagaagttaccagggcagagtcacctttaccagggacacatccgcgaggacttacttatatgganctgagcagcctgagatccgaagacacggctgtatacgtttttgngtcgtacctctagttggagtcattatacgtctactaatttgacttccgtgggcccaggggaaccctggtaccacccggtcctccctacg

SEQ ID NO: 260826 - DNA, 258 bp, Homo sapiens
  misc_feature: GYAE6OF02JV67M.1.5.A05.1.454.CMB.1.raw
  modified_base (250)..(258): a, c, t, g, unknown or other
  misc_feature (250)..(258): n is a, c, g, or t
tcagacgagtgcgtcacgaccggtgctcgatttagatagatagacagggcagttccagatttcaactgctcatcagcagcctgcagtctgaagattttgcagtttattactgtcagcagtataataactggcctccgacgttcggccaagggaccaaggtggaaatcaaacgactgtggctgcaccatctgtcttcatcttcccgcatctgactcgtactgcgctggagcgggctggcaaggcgcatagnnnnnnnnn

SEQ ID NO: 260827 - DNA, 249 bp, Homo sapiens
  misc_feature: GYAE6OF02HBU58.1.5.A05.1.454.CMB.1.raw
  modified_base (248)..(249): a, c, t, g, unknown or other
  misc_feature (248)..(249): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgactgtggctgcacatctgtcttcatcttcccgcatctgatcgtactgcgctgagcgggctggcaaggcgcatagnn

SEQ ID NO: 260828 - DNA, 179 bp, Homo sapiens
  misc_feature: GYAE6OF02HOA5K.1.5.A05.1.454.CMB.1.raw
  modified_base (178)..(179): a, c, t, g, unknown or other
  misc_feature (178)..(179): n is a, c, g, or t
tcagacgagtgcgtcacgaccggtgctcgatttagatagatagacagggcaccaagggcccatcggtcttccccctggcaccctcctccaagagcacctctggggcacagcggccctgggctgcctggtcaaggactacttcctcgatcgcgctgagcgggctggcaaggcgcatagnn

SEQ ID NO: 260829 - DNA, 201 bp, Homo sapiens
  misc_feature: GYAE6OF02JBUFF.1.5.A05.1.454.CMB.1.raw
  modified_base (177)..(201): a, c, t, g, unknown or other
  misc_feature (177)..(201): n is a, c, g, or t
tcagacgagtgcgtcacgaccggtgctcgatttagatagatagacagggcaccaagggcccatcggtcttcccctggcaccctcctccaagagcacctctggggcacagcggcctgggctgcctggtcaaggactacttccagtactctatctgagcgggctggcaaggcgcatagnnnnnnnnnnnnnnnnnnnnnnnnn

SEQ ID NO: 260830 - DNA, 543 bp, Homo sapiens
  misc_feature: GYAE6OF02GLK86.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcaacagaagttccagggcagagtcacttacagggacacatccgcgaggattacttatatggagctgagcgacgcctgagataccgaagacacggctgtattattttgtgtcgaccttcgtagtggaggtctagttacttacgctacgtaatttacgtactccgtgggtccacgggtaccctggtccaccggttcctccgtaccg

SEQ ID NO: 260831 - DNA, 181 bp, Homo sapiens
  misc_feature: GYAE6OF02HGCN2.1.5.A05.1.454.CMB.1.raw
  modified_base (179)..(181): a, c, t, g, unknown or other
  misc_feature (179)..(181): n is a, c, g, or t
tcagacgagtgcgtcacgaccggtgctcgatttagatagatagacagggcaccaagggcccatcggtcttccctctggcaccctcctccaagagcacctctggggcacagcggccctgggctgcctggtcaaggactacttccagtactctatctgagcgggctggcaaggcgcatagnnn

SEQ ID NO: 260832 - DNA, 531 bp, Homo sapiens
  misc_feature: GYAE6OF02HFKYE.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatggggatggatcaacgctggcaatggtaacacaaaaattcacagaagttccagggcagagtcactttaccagggacacatccgcgaggattacttatatggagctgagcagcctgagatccgaagacacggctggtattattttgtgtcgacctctagtggaggtcattattacgctctaatttcgactccgtggggcctagggacccgtggtccaccggttcctcctaccg

SEQ ID NO: 260833 - DNA, 566 bp, Homo sapiens
  misc_feature: GYAE6OF02G75EM.1.5.A05.1.454.CMB.1.raw
  modified_base (286)..(286): a, c, t, g, unknown or other
  misc_feature (286)..(286): n is a, c, g, or t
  modified_base (401)..(401): a, c, t, g, unknown or other
  misc_feature (401)..(401): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccccgganaaaggcttgaggtggatgggatggatcaacgctggcaatggtaacacaaaaaattcaacagaagttccaagggcagagtacacctttacaggacacatccgacgaggatacttanatggagctgagcagcctgagatccgaagcacggctgtatagtttttgagtcgtacctcgttagtgggtaggtctattacttacgtctacgtaatttcgtaacttccgtacggggtccgtaacggggtaaccccgttagggtacctacccggttctaccctaccgg

SEQ ID NO: 260834 - DNA, 267 bp, Homo sapiens
  misc_feature: GYAE6OF02G38IU.1.5.A05.1.454.CMB.1.raw
  modified_base (252)..(253): a, c, t, g, unknown or other
  misc_feature (252)..(253): n is a, c, g, or t
  modified_base (255)..(267): a, c, t, g, unknown or other
  misc_feature (255)..(267): n is a, c, g, or t
tcagacgagtgcgtcacgaccggtgctcgatttagatagatagacaggggcagttccagatttcaactgctcactcagcagcctgcagtctgaagattttgcagttttattacttgtcagcagtataataactggcctccgacgttcggccaagggaccaaggtggaaatcaaacgactggtggctgcacatctgtcttcatcttcccgcatctgagagtgcgtctctgagcgggctggcaaggcgcatagnncnnnnnnnnnnnnn

SEQ ID NO: 260835 - DNA, 544 bp, Homo sapiens
  misc_feature: GYAE6OF02I7MJX.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcaacagaagttccaagggcagagtcacctttaccagggacacatccgcgaggattacttatatggagctgagcagcctgagatcgaagacacggctagttatattttgtgtcgtacctcgtagtggtaggtctagttattacgctacgtaatttcgactcccgtgggtacccgagggtaacccgtggtccgaccgttcctcctccg

SEQ ID NO: 260836 - DNA, 502 bp, Homo sapiens
  misc_feature: GYAE6OF02IGD5W.1.5.A05.1.454.CMB.1.raw
  modified_base (399)..(399): a, c, t, g, unknown or other
  misc_feature (399)..(399): n is a, c, g, or t
  modified_base (409)..(409): a, c, t, g, unknown or other
  misc_feature (409)..(409): n is a, c, g, or t
  modified_base (434)..(434): a, c, t, g, unknown or other
  misc_feature (434)..(434): n is a, c, g, or t
tcagacgagtgcgtcacgaccggtgctcgatttagatagatagacagggacccaacaaccacatccctcctcagaagccccagagcacaacgccccaccatggactggacctggaggatcctcttttggtggcagcagccacaggtgcccactcccaggtccagcttgtgcagtctggggctgagtgaagagcctgggcctcagtgaaggtttcctgcaaggcttcaggatacaccttcactaggtatgctatacattggtgcgccacggcccccggacaaacggcttgagtggatgggatggatcgaacgctggcaagtggtaaacacgaaaaattcaacagaagttcaggcagagtacacttacaggacacatcgcgagattactatatgagctgancagcctgagntacgaagcagctggtattagtttgntcgactcgtagtggtagctattatagctacaatttcgactcgtggcctaggacctggtcacgtctctc

SEQ ID NO: 260837 - DNA, 180 bp, Homo sapiens
  misc_feature: GYAE6OF02H7M9X.1.5.A05.1.454.CMB.1.raw
  modified_base (179)..(180): a, c, t, g, unknown or other
  misc_feature (179)..(180): n is a, c, g, or t
tcagacgagtgcgtcacgaccggtgctcgatttagatagatagacagggcaccaagggcccatcggtcttcccctggcaccctcctccaagagcacctctgggggcacagcggccctgggctgcctggtcaaggactacttcctcgtactgcgctgagcgggctggcaaggcgcatagnn

SEQ ID NO: 260838 - DNA, 181 bp, Homo sapiens
  misc_feature: GYAE6OF02FZDGJ.1.5.A05.1.454.CMB.1.raw
  modified_base (180)..(181): a, c, t, g, unknown or other
  misc_feature (180)..(181): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttccagtactctatctgagcgggctggcaaggcgcatagnn

SEQ ID NO: 260839 - DNA, 254 bp, Homo sapiens
  misc_feature: GYAE6OF02I8EDP.1.5.A05.1.454.CMB.1.raw
  modified_base (222)..(222): a, c, t, g, unknown or other
  misc_feature (222)..(222): n is a, c, g, or t
  modified_base (247)..(254): a, c, t, g, unknown or other
  misc_feature (247)..(254): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtgaaatcaaacgactgtggctgcaccatctgtcttcatcttcccgcatctgatcgtactgcnctgagcggctggcaaggcgcatagnnnnnnnn

SEQ ID NO: 260840 - DNA, 252 bp, Homo sapiens
  misc_feature: GYAE6OF02HPPPL.1.5.A05.1.454.CMB.1.raw
  modified_base (249)..(252): a, c, t, g, unknown or other
  misc_feature (249)..(252): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtgaaatcaaacgaactgtggctgcaccatctgtcttcatcttcccgcatctgatcgtactgcgctgagcgggctggcaaggcgcatagnnnn

SEQ ID NO: 260841 - DNA, 515 bp, Homo sapiens
  misc_feature: GYAE6OF02ITJQH.1.5.A05.1.454.CMB.1.raw
tcagacgagtgcgtcacgaccggtgctcgatttagatagatagacaggggacccaacaaccacatccctcctcagaagccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcacagaagttccagggcagagtcactttacagggacacatccgcgaggattacttatatggagctgagcagcctgagatccgaagacacggctgtatattttgtgcgacctctagtggaggtcattattacgctcaatttgactcctgggccagggaccctggtcaccgtctcctacg

SEQ ID NO: 260842 - DNA, 541 bp, Homo sapiens
  misc_feature: GYAE6OF02GCJJC.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcaacagaagttcgagggcagagtcacctttaccaggacacatccgcgagattacttatatggagctgagcagcctgagatccgaagacacggctggtatagttttgtgcgtactctagtggagtctattattacgctactaatttgacttccgtaggggtccctacggggtacccgttggttccacccggttctcccgtaccg

SEQ ID NO: 260843 - DNA, 279 bp, Homo sapiens
  misc_feature: GYAE6OF02FY5XS.1.5.A05.1.454.CMB.1.raw
  modified_base (255)..(256): a, c, t, g, unknown or other
  misc_feature (255)..(256): n is a, c, g, or t
  modified_base (258)..(279): a, c, t, g, unknown or other
  misc_feature (258)..(279): n is a, c, g, or t
tcagacgagtgcgtcacgaccggtgctcgatttagatagatagacaggggtcggagttccagatttcaactgctcatcagcagcctgcagtctgaagattttgcagtttattactgtcagcagtataataactggcctccgacgttcggccaagggaccaaggtggaaatcaaacgactgtggctgcacatctgtcttcatcttcccgccatctgactcgtactgcgctgagcgggctggctaaggcgcattagnncnnnnnnnnnnnnnnnnnnnnnn

SEQ ID NO: 260844 - DNA, 182 bp, Homo sapiens
  misc_feature: GYAE6OF02F385Z.1.5.A05.1.454.CMB.1.raw
  modified_base (180)..(182): a, c, t, g, unknown or other
  misc_feature (180)..(182): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttcctcgtactgcgctgagcgggctggcaaggcgcatagnnn

SEQ ID NO: 260845 - DNA, 560 bp, Homo sapiens
  misc_feature: GYAE6OF02HZSKS.1.5.A05.1.454.CMB.1.raw
tcagacgagtgcgtcacgaccggtgctcgatttagatagatagacagggggacccgaacaaccacatccctcctcagaagcccccagagcacaaccgccccaccatggactggacctggaggatcctcttttggtggcagcagccacaggtgcccactcccaggtccagctgtgcagtctggggctgaggtgaagaagcctggggcctcagtgaaggttcctgcaaggcttcaggatacaccttcactaggtatgctatacaattggtgcgccaggcccccggcaaaggcttgagtggatgggatggatcaacgctggcaatggtaacacaaaaaattacaacagaagttaccagggacagagtacactttaccagggacacatccgacgaggacttacttatatgggagcgtgagcgagcctgagtatccgaagacacggtctaggtatattttggtgcgtaccttcgtaacgttgggagtacgagttattacgtctacaatttgacttccgtggggacccacggggtaaccctggttccgaccgttacgtccctaccg

SEQ ID NO: 260846 - DNA, 182 bp, Homo sapiens
  misc_feature: GYAE6OF02FOR3J.1.5.A05.1.454.CMB.1.raw
  modified_base (180)..(182): a, c, t, g, unknown or other
  misc_feature (180)..(182): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttccagtactctatctgagcgggctggcaaggcgcatagnnn

SEQ ID NO: 260847 - DNA, 529 bp, Homo sapiens
  misc_feature: GYAE6OF02GBJP1.1.5.A05.1.454.CMB.1.raw
  modified_base (523)..(523): a, c, t, g, unknown or other
  misc_feature (523)..(523): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcacagaagttccagggcagagtcactttacaggacacatccgcgaggattacttatatggagctgagcagcctgagatcgaagacacggctagtattattttgtgtcgaccttctagtggagtcattagttacgctctaatttgaccttccgtgggcctagggtaccctgggtaccaccgttcnccctcg

SEQ ID NO: 260848 - DNA, 524 bp, Homo sapiens
  misc_feature: GYAE6OF02GGLIC.1.5.A05.1.454.CMB.1.raw
  modified_base (518)..(518): a, c, t, g, unknown or other
  misc_feature (518)..(518): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgagagcctggggcctcagtgaggtttcctgcaaggcttcaggatacaccttcactaggtatgctatacattgggtgcgccaggcccccggacaaaggcttgagtggatgggatggatcaacgctggcaatggtaacacaaaaaattcaacagaagttaccagggcagagtcactttaccagggacacatccgcgaggattacttatatggagctgagcagcctgagatccgaagacacggctgtattattttgtgtcgtaccttctagtggtaggtctattattacgctctaatttgactccgtgggccagggaccctggtcaccgtcncctccg

SEQ ID NO: 260849 - DNA, 542 bp, Homo sapiens
  misc_feature: GYAE6OF02GN22X.1.5.A05.1.454.CMB.1.raw
  modified_base (442)..(442): a, c, t, g, unknown or other
  misc_feature (442)..(442): n is a, c, g, or t
  modified_base (452)..(452): a, c, t, g, unknown or other
  misc_feature (452)..(452): n is a, c, g, or t
  modified_base (462)..(462): a, c, t, g, unknown or other
  misc_feature (462)..(462): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaattcacagaagttccagggcagagtcaccttaccagggacacatccgcgaggattacttatatggagctgagcagcctgagatccgaagacacgctgtatattttgngtcgtacctntagtggagtnattattacgcttactaatttgaccttccgtaggggcctaacggggtaccccttgggtacctaccggttcctcccgtaccg

SEQ ID NO: 260850 - DNA, 530 bp, Homo sapiens
  misc_feature: GYAE6OF02HEXIN.1.5.A05.1.454.CMB.1.raw
  modified_base (444)..(444): a, c, t, g, unknown or other
  misc_feature (444)..(444): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcaacagaagttccagggcagagtcacctttacagggacacatccgcgaggattactatatggagctgagcagcctgagatccgaagacacggctgtattattttgngtcgtactcgtagtggagtcagttatacgctactaatttgactccgtcgggcctacgggtaccctggtccaccggttctcctaccg

SEQ ID NO: 260851 - DNA, 258 bp, Homo sapiens
  misc_feature: GYAE6OF02I3QQW.1.5.A05.1.454.CMB.1.raw
  modified_base (251)..(258): a, c, t, g, unknown or other
  misc_feature (251)..(258): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatctgatcgtactgcgctgagcgggctggcaaggcgcatagnnnnnnnn

SEQ ID NO: 260852 - DNA, 182 bp, Homo sapiens
  misc_feature: GYAE6OF02FYWBY.1.5.A05.1.454.CMB.1.raw
  modified_base (180)..(182): a, c, t, g, unknown or other
  misc_feature (180)..(182): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttcctacgtgagctctgagcgggctggcaaggcgcatagnnn

SEQ ID NO: 260853 - DNA, 184 bp, Homo sapiens
  misc_feature: GYAE6OF02FPOYS.1.5.A05.1.454.CMB.1.raw
  modified_base (178)..(184): a, c, t, g, unknown or other
  misc_feature (178)..(184): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctcgtactgcgctgagcgggctggcaaggcgcatagnnnnnnn

SEQ ID NO: 260854 - DNA, 513 bp, Homo sapiens
  misc_feature: GYAE6OF02GG1E0.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcacagaagttccaggcagagtcacttacaggacacatcgcgagattactatatggagctgagcagcctgagatccgaagacacgctgtatattttgtgtacgtacctctagtggaggttcattattagctacaatttgactcgtgggccagggaccctggtcaccgtctctaccg

SEQ ID NO: 260855 - DNA, 252 bp, Homo sapiens; identical to SEQ ID NO: 259862
  misc_feature: GYAE6OF02FQTXK.1.5.A05.1.454.CMB.1.raw
  modified_base (250)..(252): a, c, t, g, unknown or other
  misc_feature (250)..(252): n is a, c, g, or t

SEQ ID NO: 260856 - DNA, 518 bp, Homo sapiens
  misc_feature: GYAE6OF02HIDZB.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcaacagaagttccagggcagagtcactttacagggacacatccgcgaggattactatatggagctgagcagcctgagatccgaagacacggctgtatattttgtgcgtacctctagtggaggtcattattacgctacaatttgactccgtgggccagggacctggtacaccgtctctcg

SEQ ID NO: 260857 - DNA, 179 bp, Homo sapiens; identical to SEQ ID NO: 259879
  misc_feature: GYAE6OF02FG1F0.1.5.A05.1.454.CMB.1.raw
  modified_base (178)..(179): a, c, t, g, unknown or other
  misc_feature (178)..(179): n is a, c, g, or t

SEQ ID NO: 260858 - DNA, 253 bp, Homo sapiens; identical to SEQ ID NO: 259990
  misc_feature: GYAE6OF02G1B69.1.5.A05.1.454.CMB.1.raw
  modified_base (250)..(253): a, c, t, g, unknown or other
  misc_feature (250)..(253): n is a, c, g, or t

SEQ ID NO: 260859 - DNA, 530 bp, Homo sapiens
  misc_feature: GYAE6OF02I3SCF.1.5.A05.1.454.CMB.1.raw
  modified_base (446)..(446): a, c, t, g, unknown or other
  misc_feature (446)..(446): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatggggatgggatcaacgctggcaatggtaacacaaaaaattcaacagaagttccagggcagagtcactttacagggacacatccgcgaggattacttatatggagctgagcagcctgagatccgaagacacggctgtatattttgngtcgactctagtggagtctattattacgctacgtaatttgacttccgtggggcctagggaccctggtccaccgtctccctaccg

SEQ ID NO: 260860 - DNA, 522 bp, Homo sapiens
  misc_feature: GYAE6OF02GFLEV.1.5.A05.1.454.CMB.1.raw
  modified_base (480)..(480): a, c, t, g, unknown or other
  misc_feature (480)..(480): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcacagaagttccaggggcagagtcacctttaccagggtacacatccgcgaggattacttatattggagctgagcagcctgagatccgaagacacggctgtatattttgtagcgacctctagtggaggttcattattacgctnaatttgactcctgggccacgggaccctggtcaccgtctctcg

SEQ ID NO: 260861 - DNA, 199 bp, Homo sapiens
  misc_feature: GYAE6OF02G99CT.1.5.A05.1.454.CMB.1.raw
  modified_base (180)..(199): a, c, t, g, unknown or other
  misc_feature (180)..(199): n is a, c, g, or t
tcagacgagtgcgtcacgaccggtgctcgatttagatagatagacagggcgaccaagggcccatcggtcttccccctggcaccctcctccaagagcacctctgggggcacagcggcctgggctgcctggtcaaggactacttcctatgtatactctgagcgggctggcaaggcgcatagnnnnnnnnnnnnnnnnnnnn

SEQ ID NO: 260862 - DNA, 617 bp, Homo sapiens
  misc_feature: GYAE6OF02J0B8T.1.5.A05.1.454.CMB.1.raw
  modified_base (208)..(208): a, c, t, g, unknown or other
  misc_feature (208)..(208): n is a, c, g, or t
  modified_base (442)..(442): a, c, t, g, unknown or other
  misc_feature (442)..(442): n is a, c, g, or t
  modified_base (469)..(469): a, c, t, g, unknown or other
  misc_feature (469)..(469): n is a, c, g, or t
tcagacgagtgcgtcacgaccggtgctcgatttagatagatagacaggggacccaacaaccacatccctcctcagaagcccccagagcacaacgccccaccactggactggacctggaggatcctctttttggtggcagcagccacaggtgcccactcccaggtccagcttgtgcagtctggggctgaggtgaagagcctggggcctnagtgaaggtttcctgcaaggcttcaggatacaccttcactaggtatgctatacattgggtgcgcaggcccccggacaaaggcttgagtggagtgggatggatcgaacgctggcaatggtaacaacaaaaattcaactagaagttaccgagggcaagagtcacctttacaagggacacatccggacgaggattacttatagtaggagctggagacagcctagacgataccggaanaccgacggctagtatttatttttaggngtacgtaccttagttaggttggtaaggttctaagtttaacgttacgtactttacgtaaagtttttcgaccgttacccggttgggggtacccgtaagggggtaacccccttggggttaaccctacccggtttacccgttcctaacccgg

SEQ ID NO: 260863 - DNA, 248 bp, Homo sapiens
  misc_feature: GYAE6OF02GMYPK.1.5.A05.1.454.CMB.1.raw
  modified_base (247)..(248): a, c, t, g, unknown or other
  misc_feature (247)..(248): n is a, c, g, or t
tcagacgagtgcgtcacgaccggtgctcgatttagatagatagacaggggcagttccagatttcaactgctcatcagcagcctgcagtctgaagattttgcagtttattactgtcagcgagtataataactggcctccgacgttcggccaagggaccaaggtggaaatcaaacgactgtggctgcaccatctgtctcatcttccgcatctgatcgtactgcgctgagcggctggcaaggcgcatagnn

SEQ ID NO: 260864 - DNA, 253 bp, Homo sapiens; identical to SEQ ID NO: 260086
  misc_feature: GYAE6OF02F93VV.1.5.A05.1.454.CMB.1.raw
  modified_base (249)..(253): a, c, t, g, unknown or other
  misc_feature (249)..(253): n is a, c, g, or t

SEQ ID NO: 260865 - DNA, 514 bp, Homo sapiens
  misc_feature: GYAE6OF02HX5RN.1.5.A05.1.454.CMB.1.raw
  modified_base (335)..(335): a, c, t, g, unknown or other
  misc_feature (335)..(335): n is a, c, g, or t
  modified_base (413)..(413): a, c, t, g, unknown or other
  misc_feature (413)..(413): n is a, c, g, or t
  modified_base (455)..(455): a, c, t, g, unknown or other
  misc_feature (455)..(455): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggttcacctggtgcagtctggagctgagctgcagaagcctggggcctcagtgatggtctcctgcagtgcttctggttacatcttttccaccttacggtatgaattggttgagtacaggcccccggagaggggcttgagtggatggggatggatcagcccttacggaactaaaacngagtatggagagagttccagggcagagtcatcatcaccgcgacacatccacgagtacagcctacatggaactgagganccgtcagatctgacgacacggaccacttatactgcgcgaganattattgcacgtggtcctggcttacgtaaccacgcttggtgggctacgtggggtacccg

SEQ ID NO: 260866 - DNA, 183 bp, Homo sapiens; identical to SEQ ID NO: 260080
  misc_feature: GYAE6OF02F2LA0.1.5.A05.1.454.CMB.1.raw
  modified_base (178)..(183): a, c, t, g, unknown or other
  misc_feature (178)..(183): n is a, c, g, or t

SEQ ID NO: 260867 - DNA, 221 bp, Homo sapiens
  misc_feature: GYAE6OF02F34Q7.1.5.A05.1.454.CMB.1.raw
  modified_base (186)..(188): a, c, t, g, unknown or other
  misc_feature (186)..(188): n is a, c, g, or t
  modified_base (190)..(221): a, c, t, g, unknown or other
  misc_feature (190)..(221): n is a, c, g, or t
tcagacgagtgcgtcacgaccggtgctcgatttagatagatagacaggggcaaccaagggcccatcggtcttccccctggcaccctcctccaagacgcacctctgggggcacagcggccctgggctgcctgggtcaaggactacttccagtactctaatcttgagcgggctggcaaggcgcatagnnngnnnnnnnnnnnnnnnnnnnnnnnnnnnnnnnn

SEQ ID NO: 260868 - DNA, 529 bp, Homo sapiens
  misc_feature: GYAE6OF02HIJO4.1.5.A05.1.454.CMB.1.raw
  modified_base (445)..(445): a, c, t, g, unknown or other
  misc_feature (445)..(445): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcacagaagttccagggcagagtcactttacagggacacatccgcgaggattactatatggagctgagcagcctgagatccgaagaccgacgctgtattatttttgngtcgaccttctaagtggaggttcattattacgcttctaatttgacttccgtgggccagggtaccctggtccaccgtctccgtcc

SEQ ID NO: 260869 - DNA, 251 bp, Homo sapiens
  misc_feature: GYAE6OF02H1VMH.1.5.A05.1.454.CMB.1.raw
  modified_base (248)..(251): a, c, t, g, unknown or other
  misc_feature (248)..(251): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctcgacgttcggccaagggaccaaggtggaaatcaaacgaactgtggctgcaccatctgtcttcatcttccgcatctgatcgtactgcgctgagcgggctggcaaggcgcatagnnnn

SEQ ID NO: 260870 - DNA, 278 bp, Homo sapiens
  misc_feature: GYAE6OF02GZJPY.1.5.A05.1.454.CMB.1.raw
  modified_base (256)..(256): a, c, t, g, unknown or other
  misc_feature (256)..(256): n is a, c, g, or t
  modified_base (258)..(278): a, c, t, g, unknown or other
  misc_feature (258)..(278): n is a, c, g, or t
tcagacgagtgcgtcacgaccggtgctcgatttagatagatagacagggggtcgagttccagactttcaactgctcatcagcagcctgccagtctgaagattttgcgagtttattactgtcagcagtataataactggcctcgacgttcggccaagggaccaaggtggaaatcaaacgactgtggctgccaccatctgtcttcatcttcccgcatctgatcgtactgcgctggagcgggctggcaaggcgcatagnannnnnnnnnnnnnnnnnnnnn

SEQ ID NO: 260871 - DNA, 180 bp, Homo sapiens
  misc_feature: GYAE6OF02GE13N.1.5.A05.1.454.CMB.1.raw
  modified_base (180)..(180): a, c, t, g, unknown or other
  misc_feature (180)..(180): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttccagtactctatctgagcgggctggcaaggcgcatagn

SEQ ID NO: 260872 - DNA, 273 bp, Homo sapiens
  misc_feature: GYAE6OF02IMAK9.1.5.A05.1.454.CMB.1.raw
  modified_base (259)..(273): a, c, t, g, unknown or other
  misc_feature (259)..(273): n is a, c, g, or t
tcagacgagtgcgtcacgaccggtgctcgatttagatagatagacaggggcgagttccagatttcaactgctcgatcagcagcctgcagtctgaagattttgctagtttattactgtcagcagtataataactggcctccggacgttcggccaagggaccaaggtcggaaatcaaacgactgtcggctgcaccatctgtcttcatccttcccgcatctgatcgtactgccgctgacgtcgggctggcaaggcgcatagnnnnnnnnnnnnnnn

SEQ ID NO: 260873 - DNA, 571 bp, Homo sapiens
  misc_feature: GYAE6OF02JPO07.1.5.A05.1.454.CMB.1.raw
  modified_base (285)..(285): a, c, t, g, unknown or other
  misc_feature (285)..(285): n is a, c, g, or t
  modified_base (400)..(400): a, c, t, g, unknown or other
  misc_feature (400)..(400): n is a, c, g, or t
  modified_base (445)..(445): a, c, t, g, unknown or other
  misc_feature (445)..(445): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccgganaaaggcttgagtggatgggatggatcaacgctggcaatggtaacacaaaaattcaacagaagttccagggcagagtcactttacagggacacatccgcaggatacttatatgganctgagcagcctgagatccgaagacgacgctgtaacttagttttgngtcgtaccttcgtaagttgggaggttacgtagtttattacgtcttaccgtaagttttcgacttccgtaggggtacccgtaacggggtaacccgttcgggttaccacccggttctacccgttaccgg

SEQ ID NO: 260874 - DNA, 537 bp, Homo sapiens
  misc_feature: GYAE6OF02I85BT.1.5.A05.1.454.CMB.1.raw
  modified_base (484)..(484): a, c, t, g, unknown or other
  misc_feature (484)..(484): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggcccccggacaaaggcttgagtggatggggatgggatcaacgctggcaatggtaacacaaaaaattcaacagaaagttccagggcagagtcacctttacagggacacatccgcgaggattacttatatggagctgagcagcctgagatccgaagaccacggctatattattttgtgtcgtacctcgtagtggacggttcagttattacgntactaatttgacgttctgggaccagggaaccctggtacaccggttctcctccg

SEQ ID NO: 260875 - DNA, 550 bp, Homo sapiens
  misc_feature: GYAE6OF02JJ6AV.1.5.A05.1.454.CMB.1.raw
  modified_base (482)..(482): a, c, t, g, unknown or other
  misc_feature (482)..(482): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattggtgcgccaggcccccggacaaaggcttgagtggatgggatggatcaacgcgtggcaagtggtaacacaaaaaattcaacagaagttccagggcagagtcactttacgaggaccacactaccgcgagattactatatggagcgtgagcagcctagagatcgaagacgacggctagtattattttgtgtcgtacctgtagtggtagtcagtttatacgtntacgtaatttgaacgttcgttcgggacctagggtaaccccgtggttaccgacccgttcgtccctacgg

SEQ ID NO: 260876 - DNA, 185 bp, Homo sapiens
  misc_feature: GYAE6OF02JX4RI.1.5.A05.1.454.CMB.1.raw
  modified_base (174)..(185): a, c, t, g, unknown or other
  misc_feature (174)..(185): n is a, c, g, or t
tcagacgagtgcgtcacgaccggtgctcgatttagatagatagacagggcaccaaggcccatcggtcttcccctggcaccctcctccaagagcacctctggggcacagcggcctggctgcctggtcaaggactactcctcgtactgcgctgagcggctaggcaaggcgcatagnnnnnnnnnnnn

SEQ ID NO: 260877 - DNA, 182 bp, Homo sapiens
  misc_feature: GYAE6OF02HADMR.1.5.A05.1.454.CMB.1.raw
  modified_base (180)..(182): a, c, t, g, unknown or other
  misc_feature (180)..(182): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttcctctctcgactctgagcgggctggcaaggcgcatagnnn

SEQ ID NO: 260878 - DNA, 623 bp, Homo sapiens
  misc_feature: GYAE6OF02GB23U.1.5.A05.1.454.CMB.1.raw
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtncgccacggcccccgganaaaggcttgagtggagtgggatggatcgaacgcgtggcaagtggtaaaccaaacgtaaaaaacttcaacaagtaacgttaccgaaggggacaggacgtactaacctttaaccgaaggggaccacactccgacgaggtactttacttatagtggagtctagagacagcctaggagtactaccgaagaccgacggctagttaattatttttggcgtaccgtaccttcgttagggtgggtacggtctaagtttacgttacgtcttacttaaagtttcgaccttccggtcggggtacccgacggggtaacccttgggtacccacccgttccgtccctaccg

SEQ ID NO: 260879 - DNA, 542 bp, Homo sapiens
  misc_feature: GYAE6OF02I1J85.1.5.A05.1.454.CMB.1.raw
  modified_base (459)..(459): a, c, t, g, unknown or other
  misc_feature (459)..(459): n is a, c, g, or t
  modified_base (472)..(472): a, c, t, g, unknown or other
  misc_feature (472)..(472): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcgagtgaaggtttcctgcaaggcttcaggatacaccttcactaggtatgctatacattgggtgcgccaggcccccggacaaaggcttgacgtggatgggatgggatcgaacgctggcaagtggtaacacaaaaaattcaacagaagttccagggtcagagtcactttacagggacacatccgcgagatacttatatggagctgagcagcctgagatccgaagacacggctgtattattttacgtgtcgaccttntagtggacggttnatttattacgctacgtaatttgaccttccgtgggaccgtagggacccttggtaccaccgttctccctacg

SEQ ID NO: 260880 - DNA, 301 bp, Homo sapiens
  misc_feature: GYAE6OF02IDTNJ.1.5.A05.1.454.CMB.1.raw
  modified_base (265)..(301): a, c, t, g, unknown or other
  misc_feature (265)..(301): n is a, c, g, or t
tcagacgagtgcgtcacgaccggtgctcgatttagatagatagacaggggcaggttccagatttcaactgctcatcaggcagcctgcagtctgaacgatttttgcagtttatttactgtcagcagtataataacctggcctccggacgttcggccaagggaccaaggtggaaattcaaacgtaactgtggctgctaccatctgtcttcatcttcccgcatctgatcgtactgcgtctgagcgggatggcaaggcgacacttaggnnnnnnnnnnnnnnnnnnnnnnnnnnnnnnnnnnnnn

SEQ ID NO: 260881 - DNA, 561 bp, Homo sapiens
  misc_feature: GYAE6OF02IZQY3.1.5.A05.1.454.CMB.1.raw
  modified_base (339)..(339): a, c, t, g, unknown or other
  misc_feature (339)..(339): n is a, c, g, or t
  modified_base (393)..(393): a, c, t, g, unknown or other
  misc_feature (393)..(393): n is a, c, g, or t
  modified_base (406)..(406): a, c, t, g, unknown or other
  misc_feature (406)..(406): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattggtgcgccaggcccccgacaaaggcttgagtggatgggatggatcaacgctggcaatggtaacacaaaaaattcanagaagttcaggcagagtcactttacaggacacatcgcgagattactatatgagntgagcagcctganatcgaagacacggctagtatatttttgcgtacgtaccttcgtagttggaggttacgtattacgttacgcttactaaattttagacgtttaccgtgggggtacccctaaggggaaccccgttcgggtacctacccggttaccgtcccgttacccgg

SEQ ID NO: 260882 - DNA, 536 bp, Homo sapiens
  misc_feature: GYAE6OF02HG0L1.1.5.A05.1.454.CMB.1.raw
  modified_base (406)..(406): a, c, t, g, unknown or other
  misc_feature (406)..(406): n is a, c, g, or t
  modified_base (418)..(418): a, c, t, g, unknown or other
  misc_feature (418)..(418): n is a, c, g, or t
  modified_base (450)..(450): a, c, t, g, unknown or other
  misc_feature (450)..(450): n is a, c, g, or t
  modified_base (488)..(488): a, c, t, g, unknown or other
  misc_feature (488)..(488): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcaacagaagttccgagggcagagtacacctttacagggacacatccgcgaggattacttatatgganctgagcagtccngagatccgaagacacggctagttatattttgngcgaccttgtagtggagtcattatacgctactaatttntactccgtgggacctagggaaccccgttggtaccaccgtctcctaccg

SEQ ID NO: 260883 - DNA, 529 bp, Homo sapiens
  misc_feature: GYAE6OF02JC6YA.1.5.A05.1.454.CMB.1.raw
  modified_base (268)..(268): a, c, t, g, unknown or other
  misc_feature (268)..(268): n is a, c, g, or t
  modified_base (440)..(440): a, c, t, g, unknown or other
  misc_feature (440)..(440): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtncgccaggcccccggacaaaggcttgagtggatgggatggatcaacgctggcaatggtaacacaaaaattcaacagaagttccaggcagagtcacctttacagggacacatccgcgagattactatatgagctgagcagcctgagatccgaagacacgctgtacttattttgngcgactctagttggaggtctattattacgtctactaatttcgactccgtgggaccgacgggtacccgtggtacaccggtcctcctaccg

SEQ ID NO: 260884 - DNA, 182 bp, Homo sapiens
  misc_feature: GYAE6OF02HL7GQ.1.5.A05.1.454.CMB.1.raw
  modified_base (179)..(182): a, c, t, g, unknown or other
  misc_feature (179)..(182): n is a, c, g, or t
tcagacgagtgcgtcacgaccggtgctcgatttagatagatagacagggcaccaagggcccatcggtcttcccctggcaccctcctccaagagcacctctgggggcacagcggccctgggctgcctggtcaaggactacttccagtactctatctgagcgggctggcaaggcgcatagnnnn

SEQ ID NO: 260885 - DNA, 252 bp, Homo sapiens
  misc_feature: GYAE6OF02HW338.1.5.A05.1.454.CMB.1.raw
  modified_base (248)..(252): a, c, t, g, unknown or other
  misc_feature (248)..(252): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctcgacgttcggccaagggaccaaggtggaaatcaaacgactgtggctgcaccatctgtcttcatcttcccgcatctgatcgtactgcgctgagcgggctggcaaggcgcatagnnnnn

SEQ ID NO: 260886 - DNA, 522 bp, Homo sapiens
  misc_feature: GYAE6OF02ILBM3.1.5.A05.1.454.CMB.1.raw
  modified_base (437)..(437): a, c, t, g, unknown or other
  misc_feature (437)..(437): n is a, c, g, or t
  modified_base (445)..(445): a, c, t, g, unknown or other
  misc_feature (445)..(445): n is a, c, g, or t
tcagacgagtgcgtcacgaccggtgctcgatttagatagatagacagggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcacagaattcaggcagagtcactttacagggacacatccgcgaggattactatatggagctgagcagcctgagatcgaagacaggctgtatattttgngcgacctntagtggagtcattattacgcttcaatttcgacttccgtggggccctacgggacccttggtccaccgttctcctaccg

SEQ ID NO: 260887 - DNA, 251 bp, Homo sapiens; identical to SEQ ID NO: 259942
  misc_feature: GYAE6OF02FNUJP.1.5.A05.1.454.CMB.1.raw
  modified_base (251)..(251): a, c, t, g, unknown or other
  misc_feature (251)..(251): n is a, c, g, or t

SEQ ID NO: 260888 - DNA, 520 bp, Homo sapiens
  misc_feature: GYAE6OF02FVAV4.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcacagaagttccaggcagagtcactttacagggacacatccgcgagattacttatatggagctgagcagcctgagatcgaagacacggctgtattattttgtgtcgactctagtggagtcattattacgctctaatttgactccgtagggcctacgggaccctggtcaccgtctccgtccg

SEQ ID NO: 260889 - DNA, 526 bp, Homo sapiens
  misc_feature: GYAE6OF02HWLCT.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattggtgcgccaggcccccggacaaaaggcttgagtggatgggatgggatcaacgctggcaatggtaacacaaaaaattcaacagaagttccagggcagagtcacctttacagggacacatccgcgagatacttatatggagctgagcagcctgagatccgaagacacggctgtattattttgtgtcgaccttcgtagtggagtcattattacgctactaatttgactccgtgggaccagggaccctggtcctaccgtctcctcg

SEQ ID NO: 260890 - DNA, 269 bp, Homo sapiens
  misc_feature: GYAE6OF02IILVL.1.5.A05.1.454.CMB.1.raw
  modified_base (250)..(269): a, c, t, g, unknown or other
  misc_feature (250)..(269): n is a, c, g, or t
tcagacgagtgcgtcacgaccggtgctcgatttagatagatagacgaggggcagttccagatttcaactgctcatcagcagcctgcagtctgaagattttgcagtttattactgtcagcagtataataactggcctccgacgttcggccaagggaccaaggtgaaatcaaacgaactgtgctgcaccatctgtcttcatcttcccgcatctgatcgtactgccgctgagcgggctggcaaggcgcatagnnnnnnnnnnnnnnnnnnnn

SEQ ID NO: 260891 - DNA, 542 bp, Homo sapiens
  misc_feature: GYAE6OF02F1SQO.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaaggcttgagtggatggggatggatcaacgctggcaatggtaacacaaaaaattcacagaagttccagggcagagtcactttaccagggtacacatccgcgaggattacttatatggagctgagcagcctgagatccgaagacacggctgtatattttgtgtcgacctctagtggaggttcattattacgctctaatttgacttccgtggggtacccaggggaaccccttgggtccacccggttctcccgtaccg

SEQ ID NO: 260892 - DNA, 536 bp, Homo sapiens
  misc_feature: GYAE6OF02F8OW4.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattggtgcgccaggcccccggacaaaggcttgagtggatgggatggatcaacgctgggcaatggtaacacaaaaaattcaacagaagttccagggcagagtcactttaccagggacacatccgcgagattactatatggagctgagcagcctgagatccgaagacacggctgtatattttgtgcgtacctctagtggaggtcattattacgctacgtaatttgactccgttcggggacctagggaacccttgggtacctaccggttctccctaccg

SEQ ID NO: 260893 - DNA, 250 bp, Homo sapiens
  misc_feature: GYAE6OF02F5HZC.1.5.A05.1.454.CMB.1.raw
  modified_base (250)..(250): a, c, t, g, unknown or other
  misc_feature (250)..(250): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgcatctgaacgcactcgtctgagcgggctggcaaggcgcatagn

SEQ ID NO: 260894 - DNA, 180 bp, Homo sapiens; identical to SEQ ID NO: 260296
  misc_feature: GYAE6OF02FP93L.1.5.A05.1.454.CMB.1.raw
  modified_base (179)..(180): a, c, t, g, unknown or other
  misc_feature (179)..(180): n is a, c, g, or t

SEQ ID NO: 260895 - DNA, 557 bp, Homo sapiens
  misc_feature: GYAE6OF02H323D.1.5.A05.1.454.CMB.1.raw
  modified_base (450)..(450): a, c, t, g, unknown or other
  misc_feature (450)..(450): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaagtggtaacaacaaaaaattcaacagaagttccgaggcagagtcacttacaggacacatccgcgagtatacttatatggagctgagcagcctgagataccgaagacacggctagttattagtttttcgngtcgtacctcgtagttggaggtctattattacgcttacgtaatttcgacttccggtcgggacccgtaagggtaaccccgttggtccctaacccgttcgtaccctccg

SEQ ID NO: 260896 - DNA, 179 bp, Homo sapiens; identical to SEQ ID NO: 260750
  misc_feature: GYAE6OF02F3T9N.1.5.A05.1.454.CMB.1.raw
  modified_base (179)..(179): a, c, t, g, unknown or other
  misc_feature (179)..(179): n is a, c, g, or t

SEQ ID NO: 260897 - DNA, 542 bp, Homo sapiens
  misc_feature: GYAE6OF02GJV3F.1.5.A05.1.454.CMB.1.raw
  modified_base (448)..(448): a, c, t, g, unknown or other
  misc_feature (448)..(448): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcacagaagttccagggcagagtcactttaccagggacacatccgcgaggattacttatatggagctgagcagcctgagatcccgaagacacggctaggtattatttttgngcgtaccttcgtagtggtaggtcagttattacgtctacgtaatttcgacttccgtgggccgacgggtacccgtggtacaccggttctcccgtcg

SEQ ID NO: 260898 - DNA, 513 bp, Homo sapiens
  misc_feature: GYAE6OF02GD9WS.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcacagaagttccagggcagagtcactttacagggacacatccgcgagatacttatatggagctgagcagcctgagatccgaagacacggctgtatattttgtgcgacctctagtggaggtcattatacgctcaatttgactcctgggccagggaccctggtcaccgtctcctccg

SEQ ID NO: 260899 - DNA, 257 bp, Homo sapiens
  misc_feature: GYAE6OF02JVT7Z.1.5.A05.1.454.CMB.1.raw
  modified_base (252)..(257): a, c, t, g, unknown or other
  misc_feature (252)..(257): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatccttcccgcatctgatcgtactgcgctgagcgggctggcaaggcgacatagnnnnnn

SEQ ID NO: 260900 - DNA, 544 bp, Homo sapiens
  misc_feature: GYAE6OF02JL0FV.1.5.A05.1.454.CMB.1.raw
  modified_base (318)..(318): a, c, t, g, unknown or other
  misc_feature (318)..(318): n is a, c, g, or t
  modified_base (481)..(481): a, c, t, g, unknown or other
  misc_feature (481)..(481): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaacggctgacggtggatgggatggatcaacgntggcaatggtaacacaaaaattcaacagaagtccagggcagacgtacactttacaggtacacatccgcgagattactatatggagctagagcagccgtgagatccgaagaccacggctagtattattttgagtcgtactcgtagtggagtcgtattactacgnttacgtaagtttgtacgtccgtgggtaccgtagggtacccgtgttccgacgttctaccctacg

SEQ ID NO: 260901 - DNA, 525 bp, Homo sapiens
  misc_feature: GYAE6OF02GHOS5.1.5.A05.1.454.CMB.1.raw
  modified_base (431)..(431): a, c, t, g, unknown or other
  misc_feature (431)..(431): n is a, c, g, or t
  modified_base (444)..(444): a, c, t, g, unknown or other
  misc_feature (444)..(444): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatggggatggatcaacgctggcaatggtaacacaaaaatcaacagaagttccaggcagagtcactttaccagggacacatccgcgaggattacttatatggagctgagcagcctgagatccgaagacacggntgtattattttgngtcgacctcgttagtggagtcattatacgctctaattgactcgtgggccacgggtaccctggtaccaccgttctcctaccg

SEQ ID NO: 260902 - DNA, 212 bp, Homo sapiens
  misc_feature: GYAE6OF02GQ27R.1.5.A05.1.454.CMB.1.raw
  modified_base (181)..(212): a, c, t, g, unknown or other
  misc_feature (181)..(212): n is a, c, g, or t
tcagacgagtgcgtcacgaccggtgctcgatttagatagatagacagggcaccaagggcccatcggtcttcccctggcaccctcctccaagagcacctctgggggcacagcggccctgggctgcctggtcaaggactacttccagtactctatctgagtcgggctggcaaggtcgcatagnnnnnnnnnnnnnnnnnnnnnnnnnnnnnnnn

SEQ ID NO: 260903 - DNA, 215 bp, Homo sapiens
  misc_feature: GYAE6OF02GT4DP.1.5.A05.1.454.CMB.1.raw
  modified_base (182)..(215): a, c, t, g, unknown or other
  misc_feature (182)..(215): n is a, c, g, or t
tcagacgagtgcgtcacgaccggtgctcgatttagatagatagacgagggcaccaagggcccatcggtcttccccctggcaccctcctccaagagcacctcctgggggcacagcggccctgggctgcctggtcaaggactacttccagtactctatctgagcgggctggcaaggcgcatagnnnnnnnnnnnnnnnnnnnnnnnnnnnnnnnnnn

SEQ ID NO: 260904 - DNA, 183 bp, Homo sapiens
  misc_feature: GYAE6OF02HRXZL.1.5.A05.1.454.CMB.1.raw
  modified_base (179)..(183): a, c, t, g, unknown or other
  misc_feature (179)..(183): n is a, c, g, or t
tcagacgagtgcgtcacgaccggtgctcgatttagatagatagacagggcaccaagggcccatcggtcttcccctggcaccctcctccaagagcacctctgggggcacagcggccctgggctgcctggtcaaggactacttcctcgtactgcgctgagcgggctggcaaggcgcatagnnnnn

SEQ ID NO: 260905 - DNA, 525 bp, Homo sapiens
  misc_feature: GYAE6OF02G06WN.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaattcacagaagttccagggcagagtcaccttaccagggacacatccgcgaggattactatatggagctagagcagcctgagatccgaagacacggctgtatattttgtgtcgtacctctagtggaggtcattattacgctactaatttgacttccgtgggcctagggtaccctggtccaccgtctcctccg

SEQ ID NO: 260906 - DNA, 255 bp, Homo sapiens; identical to SEQ ID NO: 259871
  misc_feature: GYAE6OF02GXDIG.1.5.A05.1.454.CMB.1.raw
  modified_base (251)..(255): a, c, t, g, unknown or other
  misc_feature (251)..(255): n is a, c, g, or t

SEQ ID NO: 260907 - DNA, 249 bp, Homo sapiens
  misc_feature: GYAE6OF02IF344.1.5.A05.1.454.CMB.1.raw
  modified_base (249)..(249): a, c, t, g, unknown or other
  misc_feature (249)..(249): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgttgctgcaccatctgtcttcatcttccgcatctgacgtgtctgatctgagcgggctggcaaggcgcatagn

SEQ ID NO: 260908 - DNA, 526 bp, Homo sapiens
  misc_feature: GYAE6OF02F44VU.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcaacagaagttcagggcagagtcactttacagggacacatccgcgaggatacttatatggagctgagcagctgagatccgaagacacggctaggtattattttgtgcgtacgtctagtgaggtcattattagctctaatttgacttccgtgggtccagggtaaccctggtccaccgtctccgtaccg

SEQ ID NO: 260909 - DNA, 531 bp, Homo sapiens
  misc_feature: GYAE6OF02G3SRD.1.5.A05.1.454.CMB.1.raw
  modified_base (405)..(405): a, c, t, g, unknown or other
  misc_feature (405)..(405): n is a, c, g, or t
  modified_base (441)..(441): a, c, t, g, unknown or other
  misc_feature (441)..(441): n is a, c, g, or t
tcagacgagtgcgtcacgaccggtgctcgatttagatagatagacagggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttcctgcaagggcttcaggatacacctttcactaggtatgactatacattgggtgcgtccaggcccccggacaaaggcttgagtggatgggatggatcaacgctggcaatggaacacaaaaatcacagaattccaggcagagtcacctttacaggacacactccgcgagattactatatggagctgagnagcctagagatccgaagacacggctgtatagttttntgtcgtacctgtagtggacgtcattatacgcgtactaagtttgactccgtagggacctacgggtaccctggtccacggtcctaccgtccg

SEQ ID NO: 260910 - DNA, 700 bp, Homo sapiens
  misc_feature: GYAE6OF02H25CU.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacagttgggtgcgccgacggcccccggacaaaggccttgagtggagtgggagtggatcgaacgctggcaagtaggtaaacaactaaaaaattcaacaaggtaacgttccgaagggacgaggaacgtctaaccgtttaccgagggaaccacacgtccgacggaaggtatttacgttatagtaggagtctagagacacgcgtaggaagacttacccggaaagtaccgtaacggggtttagtaagttttagtttttttacgggtacgttacccggttacccgttacgttaacgggttaggggtaacggtttacgaagttttacgttaaccgttcttaccgtttaagttttcgtaaccgttcccggttacgggggtaccccgtaacggggtaccccttcggggttacccgtaccccggtttccgttacccgtaccgtaaccccgg

SEQ ID NO: 260911 - DNA, 529 bp, Homo sapiens
  misc_feature: GYAE6OF02JG18B.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcacagaagttccagggcagagtcactttacagggacacatccgcgagattactatatgagctgagcagcctgagatccgaagacacggctgtatagttttgtgtcgacctcgtagtggagtcattattacgctctaatttcgacgttcgtgggtaccagggtaaccctgggtacaccggtctccgtaccg

SEQ ID NO: 260912 - DNA, 539 bp, Homo sapiens
  misc_feature: GYAE6OF02G31R6.1.5.A05.1.454.CMB.1.raw
  modified_base (445)..(445): a, c, t, g, unknown or other
  misc_feature (445)..(445): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggccccccggacaaaggcttgagtggatgggatggatcaacgctggcaatggtaacacaaaaaattcaacagaagttccagggcagagtcacctttacagggacacatccgcgaggattactatatggagctgagcagcctgagatccgaagacacggctgtatatttttgngtcgtaccttcgtagtggtaggtctattattacgcttacgtaatttcgacttccgtgggcctagggtaccctggtacctaccgtctccctaccg

SEQ ID NO: 260913 - DNA, 518 bp, Homo sapiens
  misc_feature: GYAE6OF02GQJ56.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcacagaagttccagggcagagtcactttaccagggacacatccgcgagattactatatggagctgagcagcctgagatccgaagacacggctgtattattttgtgtcgacttctagtggaggtcattattacgctcaatttgactccgtagggcagggaccctggtcaccgtctcctcg

SEQ ID NO: 260914 - DNA, 255 bp, Homo sapiens
  misc_feature: GYAE6OF02IZWDW.1.5.A05.1.454.CMB.1.raw
  modified_base (251)..(255): a, c, t, g, unknown or other
  misc_feature (251)..(255): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatctgatcgtactgcgctgagcggctggcaagggcgcatagnnnnn

SEQ ID NO: 260915 - DNA, 533 bp, Homo sapiens
  misc_feature: GYAE6OF02GSX2T.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccccggacaaaggcttgagtggatgggatggatcaacgctggcaatggtaacacaaaaaattcacagaagttccagggcagagtcacctttaccagggacacatccgcgaggattacttatatggagctgagcagcctgagatccgaagacacggctgtattattttgtgtcgacctctagtggaggtcattattacgttctaagtttgacttccgtgggtccagggtaccctggtccaccggtctcctctaccg

SEQ ID NO: 260916 - DNA, 183 bp, Homo sapiens
  misc_feature: GYAE6OF02I6RUD.1.5.A05.1.454.CMB.1.raw
  modified_base (180)..(183): a, c, t, g, unknown or other
  misc_feature (180)..(183): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttcctcgtactgcgctgagcgggctggcaaggcgcatagnnnn

SEQ ID NO: 260917 - DNA, 761 bp, Homo sapiens
  misc_feature: GYAE6OF02JI304.1.5.A05.1.454.CMB.1.raw
  modified_base (286)..(286): a, c, t, g, unknown or other
  misc_feature (286)..(286): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccacggcccccgganaaaggcttgagtggagtggggatggactacgaacgcgtggactaagtaggtaaacaaacgtaaaaagttacaacgaaaggtaaacgttaccgaacgggacaacggtacgtaccgtaaaccgtttaaccggaacgggtaacctaccgtaacgtacccggacggtaaggttaacgtttaaccgtttaagtagtacgggtaacgtacgttaggacgacgtaacgccgtaggaacgtacgttaccggaaacgaaccgtaccggacgttaaggttaagttttagttttacggttacggtaccgttaccgttacgttagggttacgggtaacggttacgttaacgttttacgttaccggtaccttaacgtttaaacgttttacggtaccgtttacccgggtacggggttacccggttaaccggggtaaccccgtttcgggtaaccccggttacccggtttacccgtacccgttaaccccgg

SEQ ID NO: 260918 - DNA, 530 bp, Homo sapiens
  misc_feature: GYAE6OF02HLL7I.1.5.A05.1.454.CMB.1.raw
  modified_base (269)..(269): a, c, t, g, unknown or other
  misc_feature (269)..(269): n is a, c, g, or t
  modified_base (407)..(407): a, c, t, g, unknown or other
  misc_feature (407)..(407): n is a, c, g, or t
  modified_base (446)..(446): a, c, t, g, unknown or other
  misc_feature (446)..(446): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtncgccaggcccccggacaaaaggcttgagtggatggggatgggatcaacgctggcaatggtaacacaaaaaattcaacagaagttccagggcagagtcactttaccagggacacatccgcgaggattacttatatgganctgagcagcctgagatcgaagacacgctgtatattttgngtcgactctagtggagtcattatacgtctcaatttgactccgtcggggacctagggtaccctggtaccaccgttctccctaccg

SEQ ID NO: 260919 - DNA, 268 bp, Homo sapiens
  misc_feature: GYAE6OF02HP2B8.1.5.A05.1.454.CMB.1.raw
  modified_base (246)..(246): a, c, t, g, unknown or other
  misc_feature (246)..(246): n is a, c, g, or t
  modified_base (253)..(268): a, c, t, g, unknown or other
  misc_feature (253)..(268): n is a, c, g, or t
tcagacgagtgcgtcacgaccggtgctcgatttagatagatagacaggggcagttccgaggatttcaactgctcatcgagcagcctgcagtctgaagatttttgctagtttattactgtcagcagtataataactggcctccgacgttcggccaagggaccaaggtgaaatcaaacgactgtggctgcaccatctgtcttcatcttcccgcatctgaacgcactgctgagcgggactggcaaggcncataagnnnnnnnnnnnnnnnn

SEQ ID NO: 260920 - DNA, 559 bp, Homo sapiens
  misc_feature: GYAE6OF02IO6BP.1.5.A05.1.454.CMB.1.raw
  modified_base (433)..(433): a, c, t, g, unknown or other
  misc_feature (433)..(433): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggcccccggacaaaggcttgagtggatgggatggagtcaacgctggcaatggtaacaacaaaaattcacaagaagttccaggcagagtcactttacgagggactacagtccgacgagattactatagtaggagctagagcagctgagactcgaagccagntagtatattttgcgtcgaccttcgtagtggtagtctaattactacgtacttacgaagtttcgacgttacccgttggggaccctaacggggtaacccttggtaccgtacccgttacctcccttacgg

SEQ ID NO: 260921 - DNA, 559 bp, Homo sapiens
  misc_feature: GYAE6OF02GGH8U.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcaacagaagttccagggcagagtcactttaccagggacacatccgcgaggattacttatatggagctgagcagcctgagatccgaagacacggctgtattattttgcgtcgtaccttcgtagttggaggttcagttattacgctacgtaatttcgacttccgtggggtaccgtaacggggtaacccttcgggttacctacccggttcctcccgttacccg

SEQ ID NO: 260922 - DNA, 539 bp, Homo sapiens
  misc_feature: GYAE6OF02HTFCU.1.5.A05.1.454.CMB.1.raw
  modified_base (447)..(447): a, c, t, g, unknown or other
  misc_feature (447)..(447): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcaacagaagttccagggcagagtcactttacaggacacatccgcgaggattacttatatggagctgagcagcctagagatccgaagacgacggctagtattattttgngtcgaccttctagttggagtctatttatacgtctacgtaatttcgactccgtgggacctacgggtaccctggtaccaccgttcctcctaccg

SEQ ID NO: 260923 - DNA, 763 bp, Homo sapiens
  misc_feature: GYAE6OF02I5MFJ.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaggtttcctgcaaggcttacaggtatacaccttcacgtaggtatgctatacattgggtgcgccacggccccggacaaaggcttagagtggagtgggagtcggatcgaacgcgtagcgtaaatggtaaacaaactaaaaaattcaaactaagaaacgttaccgaaggggacaaggacgtacctaaccgtttacgaacgggtacaactaacgtcccggacggtaaggtaactttaacgtttaagtaagtttgggaacgtccgtaggtaaacgtaccgaagacccgtaaggaacggtaacgttacccggaaaacggtaacccgttaaccggggactttaagggttaaactttttaaacgttttttacgggtcgtaccggttaaccgttacgttaacggggttcgggtaacgggtttacgtaattttaacgttaccggttactttaaccggttaattttaccgtaaacccggttcccggttacgggggaacccgttaaccggggtaacccggttaccgggtttacccgtaacccgttccgttacccgttaacccgg

SEQ ID NO: 260924 - DNA, 179 bp, Homo sapiens; identical to SEQ ID NO: 259879
  misc_feature: GYAE6OF02HRNZO.1.5.A05.1.454.CMB.1.raw
  modified_base (178)..(179): a, c, t, g, unknown or other
  misc_feature (178)..(179): n is a, c, g, or t

SEQ ID NO: 260925 - DNA, 180 bp, Homo sapiens; identical to SEQ ID NO: 260296
  misc_feature: GYAE6OF02HL6MG.1.5.A05.1.454.CMB.1.raw
  modified_base (179)..(180): a, c, t, g, unknown or other
  misc_feature (179)..(180): n is a, c, g, or t

SEQ ID NO: 260926 - DNA, 559 bp, Homo sapiens
  misc_feature: GYAE6OF02F9MJ0.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcaacagaagttccagggcagagtcacctttacagggacacatccgcgaggattacttatatggagctgagcagcctgagatccgaagacacggctgtaacttattttgtgtcgtaccttcgttagtggaggtctagtttacttacgcttacgtaatttgacttccgtaggggtacccgtacggggtaacccttgggtacctacccggttcctcccgtaccg

SEQ ID NO: 260927 - DNA, 256 bp, Homo sapiens; identical to SEQ ID NO: 260111
  misc_feature: GYAE6OF02FNO0D.1.5.A05.1.454.CMB.1.raw
  modified_base (251)..(256): a, c, t, g, unknown or other
  misc_feature (251)..(256): n is a, c, g, or t

SEQ ID NO: 260928 - DNA, 248 bp, Homo sapiens
  misc_feature: GYAE6OF02JELY7.1.5.A05.1.454.CMB.1.raw
  modified_base (191)..(194): a, c, t, g, unknown or other
  misc_feature (191)..(194): n is a, c, g, or t
  modified_base (196)..(248): a, c, t, g, unknown or other
  misc_feature (196)..(248): n is a, c, g, or t
tcagacgagtgcgtcacgaccggtgctcgatttagatagatagacaggggacgaccaagggcccatcggtcttccccctggcacccgtcctccaagagcaccgtctgggggcacgacgcggccctgggctgccgtggtcaaggactacttcctcggatccgcgtctgagcgggctggcaaggcgcatagcnnnncnnnnnnnnnnnnnnnnnnnnnnnnnnnnnnnnnnnnnnnnnnnnnnnnnnnnn

SEQ ID NO: 260929 - DNA, 279 bp, Homo sapiens
  misc_feature: GYAE6OF02I8E39.1.5.A05.1.454.CMB.1.raw
  modified_base (260)..(279): a, c, t, g, unknown or other
  misc_feature (260)..(279): n is a, c, g, or t
tcagacgagtgcgtcacgaccggtgctcgatttagatagatagacaggggcagttccgagagtttcaactgctcatcagcagcctgcagtctgaagattttggcagtttattactgtcagcagtataataactggcctccgacgttcggccaagggaccaaggtggaaatcaaacgaactgtggctgcaccatctgtcttcatcttcccgccatctgatgtacccccctgcgctgagcgggcgtggcaaaggcgcatagnnnnnnnnnnnnnnnnnnnn

SEQ ID NO: 260930 - DNA, 180 bp, Homo sapiens; identical to SEQ ID NO: 259970
  misc_feature: GYAE6OF02GQXFK.1.5.A05.1.454.CMB.1.raw
  modified_base (178)..(180): a, c, t, g, unknown or other
  misc_feature (178)..(180): n is a, c, g, or t

SEQ ID NO: 260931 - DNA, 253 bp, Homo sapiens
  misc_feature: GYAE6OF02F25QF.1.5.A05.1.454.CMB.1.raw
  modified_base (250)..(253): a, c, t, g, unknown or other
  misc_feature (250)..(253): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgcatctgaacgcactcgtctgagcgggctggcaaggcgcatagnnnn

SEQ ID NO: 260932 - DNA, 179 bp, Homo sapiens; identical to SEQ ID NO: 260756
  misc_feature: GYAE6OF02G1JN3.1.5.A05.1.454.CMB.1.raw
  modified_base (179)..(179): a, c, t, g, unknown or other
  misc_feature (179)..(179): n is a, c, g, or t

SEQ ID NO: 260933 - DNA, 607 bp, Homo sapiens
  misc_feature: GYAE6OF02JGANG.1.5.A05.1.454.CMB.1.raw
  modified_base (282)..(282): a, c, t, g, unknown or other
  misc_feature (282)..(282): n is a, c, g, or t
  modified_base (294)..(294): a, c, t, g, unknown or other
  misc_feature (294)..(294): n is a, c, g, or t
  modified_base (437)..(437): a, c, t, g, unknown or other
  misc_feature (437)..(437): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcgagtgaaggtttcctgcaagggcttacgaggatacaccttcactaggtatgactatactagttggtgcgccgaccngggccccccganaaacgggtcttaggagtggatgggactgggatcgaacgctggacaagtaggtaacaactaaaaattcaacagaagttccaagggcaagacgtacacctttacgagggtaccacatccgacgaggaatttactaatactggaanctagacgcaacgcaggagacgtaccgaagacgacggtactagtattagtttgacgtacgtaccgttagtaggtacggtagtactattacgtacgtacttaacttaagttagtaccgttcggtacgggaccgtaaccgggtaacccgttggtaccctaccgtccttacccg

SEQ ID NO: 260934 - DNA, 572 bp, Homo sapiens
  misc_feature: GYAE6OF02GP2JR.1.5.A05.1.454.CMB.1.raw
  modified_base (285)..(285): a, c, t, g, unknown or other
  misc_feature (285)..(285): n is a, c, g, or t
  modified_base (403)..(403): a, c, t, g, unknown or other
  misc_feature (403)..(403): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtcccagcttgtgcagtctggggctgaggtgaagagcctgggcctcagtgaaggtttcctgcaaggtcttcgaggatacaccttcactaggtatgctatacattgggtgcgcaggcccccgganaaaggcttgagtggatgggatggatcgaacgctggcaatggtaacacaaaaaattcacagaacgttccaggcagagtcacctttacaggacacatccgcgaggattacttatatggancgtgagcgagcctgaagactaccgaagacacggctagtattattttgtgtaccgtaccttcgttagttggaggtcgtatttattaccgtactacgtaatttcgacgttcccgtggggaccctaggggtaaccccgttcggttacctacccggttcctacccgttacccg

SEQ ID NO: 260935 - DNA, 180 bp, Homo sapiens
  misc_feature: GYAE6OF02HLYTM.1.5.A05.1.454.CMB.1.raw
  modified_base (180)..(180): a, c, t, g, unknown or other
  misc_feature (180)..(180): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttccacgcactcgtctgagcgggctggcaaggcgcatagn

SEQ ID NO: 260936 - DNA, 828 bp, Homo sapiens
  misc_feature: GYAE6OF02JMXQ5.1.5.A05.1.454.CMB.1.raw
tcagacgagtgcgtcacgaccggtgctcgatttagatagatagacaggggacccgaacaaccacatccctcctcagaagcccccacgagcacaacgccccacccactggactggacctggaggatcctcttttggtggcagcagccacaggtgcccactcccaggtccagcttgtgcagtctggggctgaggtgaagagcctggggcctcagtgaaggtttcctggcaaggcttcaggatacaccttcactaggtatgcctatacattgggtgtcgccacgggcccccggacgtaaacggccgttgaacgttggggattaggggagtgggatccgaaacggtcgtagggccgtaaagtggggtaaacaacgtaaaaaaagtttaccaacaaggaaagtttacccgaagggtacaaggacgttacgaacccttttaaccgaacgggtaaccgactaacgtacccggtacggaacgggtaactttaaccgttaactttaacgttacgggtaaggtacccgttaggtaacggaacgtacgggtaccctaacgggtacggaacgtttaaccccgggaaacgggttaaccgaaccggggtaccggttaaacggtttaacgtttaacggttttttttacggttcggggtaaccgtacccgtttaacccgtttagggttaacggggtacggtttaccgttacgttttaacgttacggttaccgttaccgtaaacggttttttaccgtaacggttccccgtttacggggggtacccgtaaccggggtacccggttaccgggttacccgtaaccggtttccccgtacccgttcccgg

SEQ ID NO: 260937 - DNA, 546 bp, Homo sapiens
  misc_feature: GYAE6OF02IC0F9.1.5.A05.1.454.CMB.1.raw
  modified_base (285)..(285): a, c, t, g, unknown or other
  misc_feature (285)..(285): n is a, c, g, or t
  modified_base (449)..(449): a, c, t, g, unknown or other
  misc_feature (449)..(449): n is a, c, g, or t
  modified_base (458)..(458): a, c, t, g, unknown or other
  misc_feature (458)..(458): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccgganaaaggcttgagtgatgggatggatcaacgctggcaatggtaacaacaaaaaattcaacagaagttccagggcagagtcactttaccagggacacatccgcgaggatttactatatggagctagagcagcctagagatccgaagacacggctagtattattttgncgtaccttntagttggagtctattattacgtcttactaatttcgacttccgttaggggacctacgggaacccttgggtccaccgttcctcctacccg

SEQ ID NO: 260938 - DNA, 584 bp, Homo sapiens
  misc_feature: GYAE6OF02HII6X.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatggggatggatcaacgcgtggcaatggtaacaacaaaaaattacaaaagaagttaccagggcagagtcacttacagggacacatccgcgagattactatatggagctgagcagcctaggagacgttaccgaagacctacgggctagtacttagtttttgtagtccgtaccttcgtagtgggtaaggtctaattagttacgcttacgtaatttcgtaccttccgtcggggaccctaaggggtaccccgttgggttacccgtacccggttccttcccgtctacccgg

SEQ ID NO: 260939 - DNA, 562 bp, Homo sapiens
  misc_feature: GYAE6OF02GPY3Y.1.5.A05.1.454.CMB.1.raw
  modified_base (286)..(286): a, c, t, g, unknown or other
  misc_feature (286)..(286): n is a, c, g, or t
  modified_base (405)..(405): a, c, t, g, unknown or other
  misc_feature (405)..(405): n is a, c, g, or t
tcagacgagtgcgtcacgaccggtgctcgatttagatagatagacaggggacccaacaaccacatccctcctcagaacgcccccagagcacaacgccccaccatggactggacctggaggatccttcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccgganaaaggcttgagtggatgggatggatcaacgctggcaatggtaaacgaacaaaaaattcaacagaagttacaggcagagtcacctttacagggacacatcgcgaggattactatatgganctgagcagcctgagactacgaagacacggctcgtaattattttgtagtcgtacctcgtagtggtaggtctattacttacggtctacgtaatttagaccttccggtacgggtccgtacggggaacccttcgggtacctacccggttctacccgtaccg

SEQ ID NO: 260940 - DNA, 182 bp, Homo sapiens; identical to SEQ ID NO: 260877
  misc_feature: GYAE6OF02HJ95R.1.5.A05.1.454.CMB.1.raw
  modified_base (180)..(182): a, c, t, g, unknown or other
  misc_feature (180)..(182): n is a, c, g, or t

SEQ ID NO: 260941 - DNA, 561 bp, Homo sapiens
  misc_feature: GYAE6OF02JIGZ2.1.5.A05.1.454.CMB.1.raw
  modified_base (403)..(403): a, c, t, g, unknown or other
  misc_feature (403)..(403): n is a, c, g, or t
  modified_base (445)..(445): a, c, t, g, unknown or other
  misc_feature (445)..(445): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattggtgcgccaggcccccggacaaaggcttgagtggatgggatggatcaacgctggcaatggtaacacaaaaattcacagaagttccaggggcagagtcacctttaccagggacacatccgcgaggattacttatatgganctgagcagcctgagactcgaagacaggcctgtatatttttgngtcgaccttctagtggaggtcctatttattacgtcgtactaagttttgaactttcccgtaggggtacccgacggggtaaccccgttgggttaccacccgggttctccccgttaccg

SEQ ID NO: 260942 - DNA, 257 bp, Homo sapiens
  misc_feature: GYAE6OF02HKWB6.1.5.A05.1.454.CMB.1.raw
  modified_base (251)..(257): a, c, t, g, unknown or other
  misc_feature (251)..(257): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatctgatcgtactgcgctgagcgggctggcaaggcgcatagnnnnnnn

SEQ ID NO: 260943 - DNA, 517 bp, Homo sapiens
  misc_feature: GYAE6OF02FHQ2W.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttaggaactaaacagagtatggagagagtcagggcagagtcatcatcacgcggacacatccagagtacagcctacatggaactgaggagcctacagatctgacgacacggcctacttatactgcgacgagagtattagtgactacgttggtcctggtcctagtaacccgtacggtccttaggtcggggtctacggtcgggg

SEQ ID NO: 260944 - DNA, 577 bp, Homo sapiens
  misc_feature: GYAE6OF02FLO45.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggccccccggacaaacggcttcgagtggatgggatggatcaacgctggcaatggtaacacaaaaaattcacagaagttccagggacagagtcacctttacaggacacatccgcgagtataccgttatatggagtctgagcagcctgagatcgaagacacgctgtattagttttgtagtcgtacctacgttagtggacgttcgtaattacgtttaccgcttacgtaagtttacgtaccttcccgttagggtacccgtacgggtaacccctcgggttaccctacccggttcctacccgttacccgg

SEQ ID NO: 260945 - DNA, 614 bp, Homo sapiens
  misc_feature: GYAE6OF02JW9HI.1.5.A05.1.454.CMB.1.raw
  modified_base (267)..(267): a, c, t, g, unknown or other
  misc_feature (267)..(267): n is a, c, g, or t
  modified_base (282)..(282): a, c, t, g, unknown or other
  misc_feature (282)..(282): n is a, c, g, or t
  modified_base (314)..(314): a, c, t, g, unknown or other
  misc_feature (314)..(314): n is a, c, g, or t
  modified_base (329)..(329): a, c, t, g, unknown or other
  misc_feature (329)..(329): n is a, c, g, or t
  modified_base (337)..(337): a, c, t, g, unknown or other
  misc_feature (337)..(337): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagctggggcctcagtgaaggtttcctgcaaggcttcaggatacaccttcactaggtatgctatacattgggtncgcaggcccccgganaaaggcttgagtggatgggatggatcgaagcnggcaagtggaacaanaaaatcanagaagtcgaggtcagagtacacttacgagggtacacatccgcggaggactttaacgtatagtggagtctaggacgcgtagacccgttagaacgtaagtcccgaaaggaccgtaacggggtactttacggttaagttagtttttttacgagggtccgttaccgttccgttaaggttggtacggttacaatttaccgttacgtcgtttacgtacttttagaccgttaccggtggggaccctacggggtacccttcggacttaccggtcctacgttacgg

SEQ ID NO: 260946 - DNA, 525 bp, Homo sapiens
  misc_feature: GYAE6OF02HWIQQ.1.5.A05.1.454.CMB.1.raw
  modified_base (448)..(448): a, c, t, g, unknown or other
  misc_feature (448)..(448): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatggggatggatcgaacgctggcaatggtaacacaaaaattcaacagaagttccagggcagagtacactttaccaggacacatccgcgaggattacttatatggagctgagcagcctgagatccgaagacacggctgtattattttgtncgtactctagtggagtctattattacgcttacaatttcgactcgtgggccagggaccctggtaccaccgtctcctcg

SEQ ID NO: 260947 - DNA, 551 bp, Homo sapiens
  misc_feature: GYAE6OF02HWJ4I.1.5.A05.1.454.CMB.1.raw
  modified_base (380)..(380): a, c, t, g, unknown or other
  misc_feature (380)..(380): n is a, c, g, or t
tcagacgagtgcgtcacgaccggtgctcgatttagatagatagacaggggacccaacaaccacatccctcctcagaagcccccagagcacaacgccccaccatggactggacctggaggatcctctctttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttcgagtggatgggatggatcaacgctggcaatggtaacgacaaaaaattcaacagaagttccaagggcagagtcacttacaggacacntacgcgagattactatatggagctgagcagcctgagatcgaagacgacggctagtacttattttggacgtcgtaccttgtacggtggtaggttctattacgttacgtcgtactaagtttgacttccgtggggtaccgacgggtacccttagggtactacccgtcttacccg

SEQ ID NO: 260948 - DNA, 180 bp, Homo sapiens
  misc_feature: GYAE6OF02H6306.1.5.A05.1.454.CMB.1.raw
  modified_base (178)..(180): a, c, t, g, unknown or other
  misc_feature (178)..(180): n is a, c, g, or t
tcagacgagtgcgtcacgaccggtgctcgatttagatagatagacagggcaccaagggcccatcggtcttcccctggcaccctctccaagagcacctctgggggcacagcggccctgggctgcctggtcaaggactacttccagtactctatctgagcgggctggcaaggcgcatagnnn

SEQ ID NO: 260949 - DNA, 259 bp, Homo sapiens
  misc_feature: GYAE6OF02IN5Z0.1.5.A05.1.454.CMB.1.raw
  modified_base (252)..(259): a, c, t, g, unknown or other
  misc_feature (252)..(259): n is a, c, g, or t
tcagacgagtgcgtcacgaccggtgctcgatttagatagatagacagggggcagttccagatttcaactgctcatcagcagcctgcagtctgaagattttgcagtttacttactgtcagcagtataataactggcctccgacgttcggccaagggaccaaggtggaaatcaaacgaactgttgctgcaccatctgtcttcatcttcccgcatctgacgtgtctgatctgagcgggctggcaaggcgcatagnnnnnnnn

SEQ ID NO: 260950 - DNA, 520 bp, Homo sapiens
  misc_feature: GYAE6OF02GAD61.1.5.A05.1.454.CMB.1.raw
  modified_base (444)..(444): a, c, t, g, unknown or other
  misc_feature (444)..(444): n is a, c, g, or t
  modified_base (470)..(470): a, c, t, g, unknown or other
  misc_feature (470)..(470): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcacagaagttccagggcagagtcacctttacagggacacatccgcgaggattacttatatggagctgagcagcctgagatccgaagacacggctgtatattttgngcgactctagtgagtcattattacgntcaatttgactcctggggccagggaccctggtaccaccgttctccctacg

SEQ ID NO: 260951 - DNA, 186 bp, Homo sapiens
  misc_feature: GYAE6OF02IXB0M.1.5.A05.1.454.CMB.1.raw
  modified_base (178)..(186): a, c, t, g, unknown or other
  misc_feature (178)..(186): n is a, c, g, or t
tcagacgagtgcgtcacgaccggtgctcgatttagatagatagacagggcaccaagggcccatcggtcttcccctggcaccctcctccaacgagcacctctggggcacagcggcctgggctgcctggtcaaggactacttccagtactctatctgagcgggctggcaaggcgcatagnnnnnnnnn

SEQ ID NO: 260952 - DNA, 538 bp, Homo sapiens
  misc_feature: GYAE6OF02FGGP5.1.5.A05.1.454.CMB.1.raw
  modified_base (393)..(393): a, c, t, g, unknown or other
  misc_feature (393)..(393): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggcccccggacaaaggcttgatggatgggatggatcaacgctggcaatggtaacacaaaaattcacagagttcagggcagagtcaccgtttacagggacacatccgcgaggacttacttanatggagctgagcagcctggagatccgaagaccacggctgttattattttgtagtcgtacctcttaggtgacggtctattacttacgctacgtaatttgaacctccgtggggccacgggtaccctggtccaccgtctcccgtaccg

SEQ ID NO: 260953 - DNA, 254 bp, Homo sapiens
  misc_feature: GYAE6OF02IFPG0.1.5.A05.1.454.CMB.1.raw
  modified_base (248)..(254): a, c, t, g, unknown or other
  misc_feature (248)..(254): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtgaaatcaaacgactgttgctgcacatctgtcttcatccttcccgcatctgacgtgtctgatctgagcggctggctaaggcgcatagnnnnnnn

SEQ ID NO: 260954 - DNA, 534 bp, Homo sapiens
  misc_feature: GYAE6OF02III16.1.5.A05.1.454.CMB.1.raw
  modified_base (270)..(270): a, c, t, g, unknown or other
  misc_feature (270)..(270): n is a, c, g, or t
  modified_base (286)..(286): a, c, t, g, unknown or other
  misc_feature (286)..(286): n is a, c, g, or t
tcagacgagtgcgtcacgaccggtgctcgatttagatagatagacagggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtncgccaggcccccgganaaaggcttgagtggatgggatggatcaacgctggcaatggtaacacaaaaaattcaacaagaagttcagggacagagtcactttaccagggacacatccgcgaggattacttatatggagctgagcagcctgagatcgaagacacggctgtattattttgtgcgtactcttagtggtagtcattactagtctctaatttgactccgtgggcctacgggacccttggtcctaccggttcctccgtaccg

SEQ ID NO: 260955 - DNA, 554 bp, Homo sapiens
  misc_feature: GYAE6OF02IGP3E.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggcccccggacaaaggcttgagtggatgggatggatcaacgctggcaatggtaaacaacaaaaaattcaacaagaagttccagggcagagtcacctttacagggacacatccgacgaggattacttatatggagctgagcagcctgagataccgaagacacggctgtattattttgagtcgaccttgtagttgggagttctattattacgcttacgtaatttgaccttccggtagggacccgacgggtaacccttgggtaccctaccgttcctccctaccg

SEQ ID NO: 260956 - DNA, 262 bp, Homo sapiens
  misc_feature: GYAE6OF02IYKKE.1.5.A05.1.454.CMB.1.raw
  modified_base (252)..(262): a, c, t, g, unknown or other
  misc_feature (252)..(262): n is a, c, g, or t
tcagacgagtgcgtcacgaccggtgctcgatttagatagatagacaggggcagttccagatttcaactgctcatcagcagcctgcagtctgaagattttgctagtttattactgtcagcagtataataactggcctccgacgttcggccaagggaccaaggtgaaatcaaacgactgtggctgcaccatctgtcttcatccttcccgcatctgactcgtactgcgctgaggcgggctggcaaggcgcatagnnnnnnnnnnn

SEQ ID NO: 260957 - DNA, 255 bp, Homo sapiens
  misc_feature: GYAE6OF02G9QHX.1.5.A05.1.454.CMB.1.raw
  modified_base (252)..(255): a, c, t, g, unknown or other
  misc_feature (252)..(255): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtgaaatcaaacgactgtggctgcaccatctgtcttcatccttcccgctatctgatcgtactgcgctgagcgggctggcaaaggccgcatagnnnn

SEQ ID NO: 260958 - DNA, 532 bp, Homo sapiens
  misc_feature: GYAE6OF02HJLZB.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaaacacaaaaaattcaacagaagttccagggcagagtcactttacagggacacatccgcgaggattacttatatggagctagagcagcctgagatcgaagacacggctgtatattttgtgcgtactcgtagtggagtctattattacgctctaatttgacttccgtggggacctagggtaccctggtaccaccggttcctcctacg

SEQ ID NO: 260959 - DNA, 522 bp, Homo sapiens
  misc_feature: GYAE6OF02GAMRG.1.5.A05.1.454.CMB.1.raw
  modified_base (443)..(443): a, c, t, g, unknown or other
  misc_feature (443)..(443): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatggggatggatcaacgctggcaatggtaacacaaaaaattcaacagaagttccagggcagagtcactttaccagggacacatccgcgagattactatatggagctgagcagcctgagatccgaagacacggctgtatattttgngtcgacctctagtgaggtcattattacgctcgtaatttgactccgtgggtccagggaccctggtccaccgtctcctccg

SEQ ID NO: 260960 - DNA, 257 bp, Homo sapiens
  misc_feature: GYAE6OF02JR5J5.1.5.A05.1.454.CMB.1.raw
  modified_base (243)..(257): a, c, t, g, unknown or other
  misc_feature (243)..(257): n is a, c, g, or t
tcagacgagtgcgtcacgaccggtgctcgatttagatagatagacagggcagttccagatttcaactgctcatcagcagcctgcagtctgaagtatttgcagtttattactgtcagcagtataatactggcctcgacgttcgccaagggaccaggtgaaatcaaacgactgtgctgcacatctgtctcatctcccgctatctgactcgtactgcgactgagcggctggacaaggctacatagnnnnnnnnnnnnnnn

SEQ ID NO: 260961 - DNA, 725 bp, Homo sapiens
  misc_feature: GYAE6OF02JLYUG.1.5.A05.1.454.CMB.1.raw
  modified_base (213)..(213): a, c, t, g, unknown or other
  misc_feature (213)..(213): n is a, c, g, or t
  modified_base (227)..(227): a, c, t, g, unknown or other
  misc_feature (227)..(227): n is a, c, g, or t
  modified_base (295)..(295): a, c, t, g, unknown or other
  misc_feature (295)..(295): n is a, c, g, or t
tcagacgagtgcgtcacgaccggtgctcgatttagatagatagacaggggacccgaacaaccaacatccctcctccagaagccccacgacgcacaacgccccaccactggactggacctggaggatcctcttttggtggtcagcagccacaggtgcccactcccaggtcccagcttgtgcagtctggggctgaggtgaagagcctggggcctnagtgaaggtttccngccaaggcttcaggatacacctttcactaggtatgctataccattgggtagtcgctaggcccccgganaaacggcttggagtggactgggatgggatcaacgctggcaatggtaacacgaaaaaattcaacagaagttcgaggggcaagagtcaacccgttttacaaggggaccaacagtcccgacgaacgggtactttaaccgttataacgtttggggaagtaccgtggtaagtacgaacgccgttaccggagtaacgtccccgggtaaaagaccgtaaccgggggtacttaccgggttaattaagtttttttcggacggttacggtaaccctttacggtaacgggtttcgggaaacggggttccttaaacgtttagtttaccggactttccgggtaaaactttttcgggaaacctttcccggttacgggggtcccgaaccgggggttaacccccttaggggttaccctaaccccgggtttctacccccgttaccgg

SEQ ID NO: 260962 - DNA, 596 bp, Homo sapiens
  misc_feature: GYAE6OF02IWIBK.1.5.A05.1.454.CMB.1.raw
  modified_base (308)..(308): a, c, t, g, unknown or other
  misc_feature (308)..(308): n is a, c, g, or t
  modified_base (406)..(406): a, c, t, g, unknown or other
  misc_feature (406)..(406): n is a, c, g, or t
  modified_base (444)..(444): a, c, t, g, unknown or other
  misc_feature (444)..(444): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagctggggcctcagtgaggtttcctgcaaggcttcaggatacaccttcactaggtatgctatacattggtgcgccacggcccccggacaaaggcttgagtggagtgggatggancaacgcgtggcaagtggtaaacacaaaaattcaacagaagttcaggcagagtcacgtttacagggacacatccgacgaggactttacttatagtggancgtgagacagtcctgtacgacgtaccgaagacgaccgntaggttattaatttttggtcgtacgtaccgttacgttagttagggtacggttataagtttatttaccggtcttacgttaagttttacgacttcccggttaggggaccctaacggggtaacccttgggtaccacccggttccgtacctaccgg

SEQ ID NO: 260963 - DNA, 549 bp, Homo sapiens
  misc_feature: GYAE6OF02GJQ3D.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaattcacagaagttccagggcagagtcactttaccagggacacatccgcgagattactatatggagctgagacagcctgagatccgaagaccacggctagtattagttttgtgcgtactcgtagtggtaggtctagttattacgcttacgtaatttcgaccttccgtacggggaccctaggggaacccttgggtaccaccggttcctccgtacccg

SEQ ID NO: 260964 - DNA, 578 bp, Homo sapiens
  misc_feature: GYAE6OF02HTCG2.1.5.A05.1.454.CMB.1.raw
  modified_base (454)..(454): a, c, t, g, unknown or other
  misc_feature (454)..(454): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggataccaccttcactaggtatgctatacattgggtgcgccaggcccccggacaaaggcttgagtggatggggatgggatcaacggctggcaatgggtaaacacaaaaattcaacagaagttccaagggcagatacacctttacagggacacatccgcgaggattactatagtggagctgagcagcctgagataccgaagacacggctgttattatttttgngacgtaccttgtagtgggtagtacgtaattagttacacgttactaagttttcgaaccgttccgttacgggggtaccctaaggggtaccccgttacggttacccaacccggttctcccgttaccg

SEQ ID NO: 260965 - DNA, 520 bp, Homo sapiens
  misc_feature: GYAE6OF02FG5FT.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccccggacaaaggcttgagtggatgggatggatcaacgctggcaatggtaacacaaaaaattcacagaagttccagggcagagtcacctttaccagggacacatccgcgaggattacttatatggagctgagcagcctgagatccgaagacacggctgtattattttgtgcgacctctagtgaggtcattattacgctcaatttgacttcctgggccagggaccctggtccaccgtctcctcg

SEQ ID NO: 260966 - DNA, 540 bp, Homo sapiens
  misc_feature: GYAE6OF02GI8SJ.1.5.A05.1.454.CMB.1.raw
  modified_base (378)..(378): a, c, t, g, unknown or other
  misc_feature (378)..(378): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcacagaagttccagggcagagtcactttacaggacacanccgcaggattacttatatggagtctgagcagcctgagatccgaagacacggctagttattattttagtgtacgtaccttcgttagtggtaggtcagtttattacgtctacaatttgaccttccgtgggccacgggtaccctggtacctacgtcctcctaccg

SEQ ID NO: 260967 - DNA, 552 bp, Homo sapiens
  misc_feature: GYAE6OF02IGGI7.1.5.A05.1.454.CMB.1.raw
  modified_base (344)..(344): a, c, t, g, unknown or other
  misc_feature (344)..(344): n is a, c, g, or t
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggcccccggacaaaggcttgagtggatgggatggatcaacggctggcaatggtaacaacaaaaaattcaanagaagttaccagggcagagtcacctttacagggaacacatccgacgaggattacttatatggagntgancgagcctgagatccgaaagacacggctaggttatagtttttgtgcgaccttctagtaggagtctatttacttacgctacgtaatttcgacttccgtcgggtaccacgggtaaccctggtaccaccgttcctccgtaccg

SEQ ID NO: 260968 - DNA, 539 bp, Homo sapiens
  misc_feature: GYAE6OF02G064U.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaattcacagaagttccagggcagagtcacctttaccagggacacatccgcgaggattacttatatggagctgagcagcctgagatccgaagacgacggctgtatatttttgtgtcgtacctcttagtggtaggtcattattacgtctctaatttgaaccttctcggggcccaggggtaacccctggtccgaccgttctcctaccg

SEQ ID NO: 260969 - DNA, 527 bp, Homo sapiens
  misc_feature: GYAE6OF02FITN8.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcaacagaagttccagggcagagtcactttaccagggacacatccgcgaggattacttatatggagctgagcagcctgagatccgaagacacggctgtatattttgtgcgactctagtggagtcattattacgctctaatttgactccgtggggtacccagggtaaccctgggtacaccgtctcctaccg

SEQ ID NO: 260970 - DNA, 180 bp, Homo sapiens
  misc_feature: GYAE6OF02HGCH9.1.5.A05.1.454.CMB.1.raw
  modified_base (180)..(180): a, c, t, g, unknown or other
  misc_feature (180)..(180): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttcctctctcgactctgagcgggctggcaaggcgcatagn

SEQ ID NO: 260971 - DNA, 572 bp, Homo sapiens
  misc_feature: GYAE6OF02J2FVV.1.5.A05.1.454.CMB.1.raw
  modified_base (239)..(239): a, c, t, g, unknown or other
  misc_feature (239)..(239): n is a, c, g, or t
  modified_base (458)..(458): a, c, t, g, unknown or other
  misc_feature (458)..(458): n is a, c, g, or t
  modified_base (475)..(475): a, c, t, g, unknown or other
  misc_feature (475)..(475): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacnccttcactaggtatgctatacattgggtgcgccgacggcccccggaacgaaaggcttgagtggatgggatggatcgaacgctgggcaagtggtaaacaactaaaaattcaacaagaacgttccgaagggcaggagtcaccgtttaccgaggaccacactccgacggaggtacttacgttatagtggagcgtgagcagctgagtacgtaccgagtaccgnggactagtattatttgngtacgtactgtagtcggtaggtctattagtacatacgtaattcgtactccggtacgggtaccgacggttacccggtcggtcaccgttcgtcctaccg

SEQ ID NO: 260972 - DNA, 550 bp, Homo sapiens
  misc_feature: GYAE6OF02IZA3S.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaagggcttcaggatacaccttcactaggtatgctatacattgggtgcgccaggcccccggacaaaggcttgagtggatggggatgggatcaacgctggcaatggtaacacaaaaaattcaacagaagttccaggcagagtacacctttaccagggacacatccgcgagattacttatatggagctgagcagcctgagatccgaagaccacggctagtattagttttgtgtcgtacctcgttagtggaggtacattattacgtctgtaattttgacttccgtggggacctagggaacccttcgggtcctacccggtcttcccgtacg

SEQ ID NO: 260973 - DNA, 616 bp, Homo sapiens
  misc_feature: GYAE6OF02IUSC0.1.5.A05.1.454.CMB.1.raw
  modified_base (415)..(415): a, c, t, g, unknown or other
  misc_feature (415)..(415): n is a, c, g, or t
  modified_base (423)..(423): a, c, t, g, unknown or other
  misc_feature (423)..(423): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattggtgcgccaggcccccggacaaaggcttgagtggatgggatggatcaacgctggcaagtcggtaacaacaaaaaattcaacaagaagttaccgaaggggacagacgtcaactttaccgaggacacatccgcgagagttacttatatggacntagacganagccgtagagactaccgaaagaccgacgacttaggtaattagttttttagcggtacgtaaccgtacgttaggtcggtaacgggttctaacgttttaacttacgggtaccttacgtaatttagtaccgttaccgttcggggtacccaacggggttaacccttagggtacccgtacggttccctacccgtaaccg

SEQ ID NO: 260974 - DNA, 182 bp, Homo sapiens
  misc_feature: GYAE6OF02HK4B2.1.5.A05.1.454.CMB.1.raw
  modified_base (180)..(182): a, c, t, g, unknown or other
  misc_feature (180)..(182): n is a, c, g, or t
tcagacgagtgcgtcacgaccggtgctcgatttagatagatagacagggcaccaagggcccatcggtcttccacctggcaccctcctccaagagcacctctgggggcacagcggccctgggctgcctggtcaaggactacttccacgcactcgtctgagcgggctggcaaggcgcatagnnn

SEQ ID NO: 260975 - DNA, 576 bp, Homo sapiens
  misc_feature: GYAE6OF02HVMRM.1.5.A05.1.454.CMB.1.raw
  modified_base (213)..(213): a, c, t, g, unknown or other
  misc_feature (213)..(213): n is a, c, g, or t
  modified_base (328)..(328): a, c, t, g, unknown or other
  misc_feature (328)..(328): n is a, c, g, or t
  modified_base (412)..(412): a, c, t, g, unknown or other
  misc_feature (412)..(412): n is a, c, g, or t
tcagacgagtgcgtcacgaccggtgctcgatttagatagatagacagggggacccaacaaccacatccctcctcagaagcccccagagcactaaccgccccaccatggactggacctggaggatcctctttttggtggcagcagccacacggtgcccactcccaggtcccagcttgtgcagtcgtggggctgaggtgaagagcctggggcctnagtgaaggtttcctgctaaggcttcgaggatacaccttcactaggtatgctatacattggtagcgccaggccccccggacaaaaggcttgagtggatggggatggatcgaacgcncggcaatggtaacacaaaaatcacagaagtccgagggcagagtcaccttacagggacacatccgacgagattactatatggagntgagcagtcctgagatccgaagacacggctagtacttagttttcgagtccgtacctcgtacgtgggacggtctagttatacggctacgaatttacgaacgttccgtaggggtaccctacggggtaaccccttgggtacccttaacccggttctacccgttaccg

SEQ ID NO: 260976 - DNA, 665 bp, Homo sapiens
  misc_feature: GYAE6OF02JQS3C.1.5.A05.1.454.CMB.1.raw
  modified_base (224)..(224): a, c, t, g, unknown or other
  misc_feature (224)..(224): n is a, c, g, or t
  modified_base (278)..(278): a, c, t, g, unknown or other
  misc_feature (278)..(278): n is a, c, g, or t
  modified_base (297)..(297): a, c, t, g, unknown or other
  misc_feature (297)..(297): n is a, c, g, or t
tcagacgagtgcgtcacgaccggtgctcgatttagatagatagacaggggacccaacaaccacatccctcctcagaagcccccagagcacaacgccccaccatggacctggacctggatgatcctcttttggtggcagcagccacaggtgcccactcccaggtccagcttgtgcagtctggggctgaggtgaagagccgtggggccctcgagtgaaggtttccngcaaggcttcgaggtataccaccgtttcacgtaggtatgactatacattgggtntcgccagggtccccccganaacggtcttgagtggatgggtatggatcgaacgcgtaggcgaagtgtaacgaacaaaaagttcgaactagacgttacgaggcagagtctaaccttacgagggactacgacgtccgacgtacggtattacttatacgtaggtagtactgtagacgtaacgcgtagacgacgtaccggaagacgtacggtcctagttacgttatttttcggacgttaccgtaccgtttaggtacgttacgggtaagggttcttaaggttttactaacggttcgttaaccgttaaagtttttccgggaactttacccggtagggtacccggttaacgggaacccgttttaccgggaccgttacccgtttaccgtaccccgg

SEQ ID NO: 260977 - DNA, 818 bp, Homo sapiens
  misc_feature: GYAE6OF02ID1UQ.1.5.A05.1.454.CMB.1.raw
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgagaagcctggggcctcagtgaaggtttcctgcaaggcttcaggatacaccttcactaggtatgctatacattgggtncgcaggcccccgganaaaggcttgagtggagtgggagtggatcgaacgtcgtcggactaagtacggtaaacaaactaaaaaacttcaacgtaaggtaaacgttaccgaaggggaccgaaggtacgtacccgttaacccgtttaaccggaacggggtaacccaacgtaaccgtcccggacgggtaacgggtaacttttaacgtttaattaaggtagggtacgtaccgttaggaacgtacgtacggtacccgtaggaacggtaacgttaacccgggaaagacccggtaaccgggtacctttaagggtttaacgtttttaaggtttttttagggtaccggtacccggttaacccgtttacgggtttaacgggttcgggttaaacgggttcctttaaaggttttaccgttaaccgttccgttttaacgttaaacggtttttaccggtaaccggtttccccgggtttaccgggggaacccggttaacccgggggtaaccccgtttccggggttaaccccgttaaccccgggtttcccgttaccccgttaacccgg

SEQ ID NO: 260978 - DNA, 266 bp, Homo sapiens
  misc_feature: GYAE6OF02H0T6Z.1.5.A05.1.454.CMB.1.raw
  modified_base (252)..(266): a, c, t, g, unknown or other
  misc_feature (252)..(266): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctcgacgttcggcaagggaccaaggtggaaatcaaacgaactgtggctgcaccatcctgtcttcatccttcccgcctatctgatcgtactgcgctgagcggctggcaaggcgcatacgnnnnnnnnnnnnnnn

SEQ ID NO: 260979 - DNA, 552 bp, Homo sapiens
  misc_feature: GYAE6OF02HFTII.1.5.A05.1.454.CMB.1.raw
  modified_base (268)..(268): a, c, t, g, unknown or other
  misc_feature (268)..(268): n is a, c, g, or t
  modified_base (443)..(443): a, c, t, g, unknown or other
  misc_feature (443)..(443): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtncgccaggcccccggacaaaggcttgagtggatgggatggatcaacgctggcaatggtaacacaaaaaattcaacagaagttccagggcagagtcactttacaggacacatccgcgagattactatatggagctgagcagcctagagatcgaagacgacgctagtattatttttgngtacgtaccttgtagtggacggttctagtttattacgcttacgtaatttacgacttcccgtagggtcccgaacgggtacccgtggttaccgtacccgttcctcctaccg

SEQ ID NO: 260980 - DNA, 182 bp, Homo sapiens
  misc_feature: GYAE6OF02F0A08.1.5.A05.1.454.CMB.1.raw
  modified_base (179)..(182): a, c, t, g, unknown or other
  misc_feature (179)..(182): n is a, c, g, or t
tcagacgagtgcgtcacgaccggtgctcgatttagatagatagacagggcaccaagggcccatcggtcttccccctggcaccctcctccaagagcacctctggggcacagcggccctgggctgcctggtcaaggactacttcctcgtactgcgctgagcgggctggcaaggcgcatagnnnn

SEQ ID NO: 260981 - DNA, 616 bp, Homo sapiens
  misc_feature: GYAE6OF02IZCBA.1.5.A05.1.454.CMB.1.raw
  modified_base (356)..(356): a, c, t, g, unknown or other
  misc_feature (356)..(356): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgatggtctcctgcagtgcttctggttacatctttcacctacggtatgaattggttgagacaggcccccggagaggggcttggagtggatgggatggatcagcccttagagaaactaacgagtagtagagagagtacgtacggagngaggtagtactacgtactataccgaccggacggaaccactactacccgaacggtaactacgactacccgtagtacggtaacgaacgttagggaacggtacgacctacgaagtacgtagaccgtaaccgacgacccggacttaactttacgtacgtcggacgacggaacgattagttattcgactacggtccgtcggtcgtacgtaaccgttaccgacgtttcgtggtcggtaccgagggttccgggacggtaaccccggg

SEQ ID NO: 260982 - DNA, 648 bp, Homo sapiens
  misc_feature: GYAE6OF02II336.1.5.A05.1.454.CMB.1.raw
  modified_base (286)..(286): a, c, t, g, unknown or other
  misc_feature (286)..(286): n is a, c, g, or t
  modified_base (501)..(501): a, c, t, g, unknown or other
  misc_feature (501)..(501): n is a, c, g, or t
tcagacgagtgcgtcacgaccggtgctcgatttagatagatagacagggggacccgaacaaccacatccctcctcagaagccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccgganaaaggcttgacgtggatggatggatcaacgctggcaagtggtaacacgaaaaattcacagaacgttcaggcagagtcacctttacgaggactacatccgcgaggtattaacttatagtggtaagcttagacgctaggccttagagtaactccgaaagcgaacgggtctaggttaacttagttttttcggacgtccgtaaccttacgtttaacggnggggttaacggttaccgtaagttttaacgttaccggacgtttaccgtaaagtttttaccggaaccgtttccggtacggggggtacctaaccgggggttaaaccccttggggttaccgtaaccccgtttccgtacccgtttaacccgg

SEQ ID NO: 260983 - DNA, 258 bp, Homo sapiens
  misc_feature: GYAE6OF02I7PXA.1.5.A05.1.454.CMB.1.raw
  modified_base (252)..(258): a, c, t, g, unknown or other
  misc_feature (252)..(258): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaaggtggaaatcaaacgaactgtggctgcaccatctgtcttcatcttcccgcatctgatcgtactgcgctgagcgggctggcaaggcgcaatagnnnnnnn

SEQ ID NO: 260984 - DNA, 582 bp, Homo sapiens
  misc_feature: GYAE6OF02H8JV1.1.5.A05.1.454.CMB.1.raw
  modified_base (461)..(461): a, c, t, g, unknown or other
  misc_feature (461)..(461): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatactattgggtgcgccacggcccccggacaaacggcttgagtggatgggatggatcaacgctggcaagtggtaacaacaaaaaattcaacaagaagttccagggcagagtactacctttaccacgggacacataccgcgaggattacttatatggagctgagcacgcctgagactacgaacgacacggctagtattatttttgngtccgtaccttgttaggtaggaggttacgtagtttattacgacttacgtaatttagtaccgttccggtacgggtccgtaacgggtacccgtcggttaccgtacccgttccttcccgtaccg

SEQ ID NO: 260985 - DNA, 544 bp, Homo sapiens
  misc_feature: GYAE6OF02IHQPP.1.5.A05.1.454.CMB.1.raw
  modified_base (468)..(468): a, c, t, g, unknown or other
  misc_feature (468)..(468): n is a, c, g, or t
  modified_base (498)..(498): a, c, t, g, unknown or other
  misc_feature (498)..(498): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaagggcttcaggatacaccttcactaggtatgctatacattgggtgcgccaggcccccggacaaaggcttgagtggatgggatgggatcaacgactggcaaatggtaacaacaaaaaattcaacaagaagttccagggcagagtctacctttaaccagggtaacacgatccgcgagattaacttatatggagctgagcagcctgagatacgaagaacacggctagtattattttgtgcgacctntacgtggagtcattattacgctctaatttnactccgtacgggaccagggaccctggtaccaccgttcctcctaccg

SEQ ID NO: 260986 - DNA, 527 bp, Homo sapiens
  misc_feature: GYAE6OF02GNHBN.1.5.A05.1.454.CMB.1.raw
  modified_base (245)..(245): a, c, t, g, unknown or other
  misc_feature (245)..(245): n is a, c, g, or t
  modified_base (269)..(269): a, c, t, g, unknown or other
  misc_feature (269)..(269): n is a, c, g, or t
  modified_base (406)..(406): a, c, t, g, unknown or other
  misc_feature (406)..(406): n is a, c, g, or t
  modified_base (415)..(415): a, c, t, g, unknown or other
  misc_feature (415)..(415): n is a, c, g, or t
  modified_base (420)..(420): a, c, t, g, unknown or other
  misc_feature (420)..(420): n is a, c, g, or t
  modified_base (443)..(443): a, c, t, g, unknown or other
  misc_feature (443)..(443): n is a, c, g, or t
  modified_base (481)..(481): a, c, t, g, unknown or other
  misc_feature (481)..(481): n is a, c, g, or t
  modified_base (488)..(488): a, c, t, g, unknown or other
  misc_feature (488)..(488): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaagggcttcaggatacaccttnactaggtatgctatacattgggtncgccaggcccccggacaaaggcttgagtggatgggatggatcaacgctggcaatggtaacacaaaaaattcaacagaagttccagggacagagtcactttacagggaacacatccgcgaggattacttatatggagntgagcagcngagancgaagacagctgtattattttgngcgtactcgtagtggagtcattatacgctctaagtttnacgttcngggtaccagggacccttggtcctaccgtcctaccctacg

SEQ ID NO: 260987 - DNA, 527 bp, Homo sapiens
  misc_feature: GYAE6OF02FS3UL.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcacagaagttccagggcagagtcacctttaccagggacacatccgcgaggattacttatatggagctgagcagcctgagatccgaagaccacggctgtattattttgtgtcgacctctagtggaggtcattattacgctcaatttgactccgtgggtccagggtaccctggtccaccgttctcctaccg

SEQ ID NO: 260988 - DNA, 562 bp, Homo sapiens
  misc_feature: GYAE6OF02GI1KS.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattggtgcgccaggcccccggacaaaggcttgagtggatgggatggatcgaacgctggcaatggtaacacaaaaattcaacagaagttccaggacagagtacacctttaccgaggacacactccgcgagatacttatatggagctgagcagcctgagatacgaagacacgactgtattagttttgtcgtacgtaccttcgtagtaggtacggtctatttagttacgtctacgtaatttcgtaccttccgtcggggtacccacgggtaacccgtcgggttactacccggttcctacctaccgg

SEQ ID NO: 260989 - DNA, 542 bp, Homo sapiens
  misc_feature: GYAE6OF02GTYEY.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaattcaacagaagttccaggcagagtcactttaccagggacacatccgcgagattactatatggagctgagcagcctgagacgtccgaagacacggctgtacttattttgtgtcgacttcgtagtggaggtctattagttacgcttacgtaatttcgacttccgtacgggccgtacgggtaccctggtaccacccggttctcctaccg

SEQ ID NO: 260990 - DNA, 601 bp, Homo sapiens
  misc_feature: GYAE6OF02IUIBG.1.5.A05.1.454.CMB.1.raw
  modified_base (346)..(346): a, c, t, g, unknown or other
  misc_feature (346)..(346): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccccggacaaaggcttgagtggatgggatgggatcaacgctggcaatggtaacaactaaaaattcaanagaagttccgaggcagagtcacctttaccgagggacacactccgcgtaggattacttatagtggagtcgtaggagcagccctagacgatccgaaagaccgacgggtcctaggtaattagtttttggtgtaccgtaaccttcgtaaggttcgggtaggttacgtaatttacgttacgtcttacgtaattttacggaccttccggtggggaccctacggggaacccttcggtaccgtacccggttcctcccgtaccg

SEQ ID NO: 260991 - DNA, 184 bp, Homo sapiens
  misc_feature: GYAE6OF02IBEZB.1.5.A05.1.454.CMB.1.raw
  modified_base (180)..(184): a, c, t, g, unknown or other
  misc_feature (180)..(184): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttccagtactctatctgagcgggctggcaaggcgcatagnnnnn

SEQ ID NO: 260992 - DNA, 555 bp, Homo sapiens
  misc_feature: GYAE6OF02GCKGI.1.5.A05.1.454.CMB.1.raw
  modified_base (407)..(407): a, c, t, g, unknown or other
  misc_feature (407)..(407): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatggggatggatcaacgctggcaatggtaacacaaaaaattcaacagaagttaccaggggacagagtcactttaccagggacacatccgcgaggattacttatatgganctgagcagcctgagatccgaagacacggctgtatatttttgtgcgtacctgtagttggaggtctagttattacgctacgtaatttgaccttccgtaggggtcctaacggggtaacccttgggtccaacccggttcctacccgtacccg

SEQ ID NO: 260993 - DNA, 182 bp, Homo sapiens; identical to SEQ ID NO: 259848
  misc_feature: GYAE6OF02HWRG8.1.5.A05.1.454.CMB.1.raw
  modified_base (178)..(182): a, c, t, g, unknown or other
  misc_feature (178)..(182): n is a, c, g, or t

SEQ ID NO: 260994 - DNA, 230 bp, Homo sapiens
  misc_feature: GYAE6OF02G250P.1.5.A05.1.454.CMB.1.raw
  modified_base (186)..(230): a, c, t, g, unknown or other
  misc_feature (186)..(230): n is a, c, g, or t
tcagacgagtgcgtcacgaccggtgctcgatttagatagatagacagggcgaccgaagggcccatcggtcttccccctggcaccctcctccaagagcacctctggggggcaccagcggccctgggctggcctggtcaaggactacttccagtacctctatctgagcgggctggcaaggcgcatagnnnnnnnnnnnnnnnnnnnnnnnnnnnnnnnnnnnnnnnnnnnnn

SEQ ID NO: 260995 - DNA, 578 bp, Homo sapiens
  misc_feature: GYAE6OF02GZJVG.1.5.A05.1.454.CMB.1.raw
  modified_base (268)..(268): a, c, t, g, unknown or other
  misc_feature (268)..(268): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtncgcaggcccccggacaaaggcttgagtggatgggatggatcaacgctggcaatggtaacaactaaaaaattcaacagaaagttccagggtcagagtcacctttacgagggacacatccgcgagattatatatgagctgagcgagccagagactccggaaagacgacggtcttaggtattagtttttgtggtacgtaccgtcgttagtggtaggtacgatttacgttacgtacttacgtaatttcgaccgtccgttcggggaccctaacggggtaccccgttgggtccgacccggttctacccgtacccgg

SEQ ID NO: 260996 - DNA, 612 bp, Homo sapiens
  misc_feature: GYAE6OF02F2MEL.1.5.A05.1.454.CMB.1.raw
  modified_base (287)..(287): a, c, t, g, unknown or other
  misc_feature (287)..(287): n is a, c, g, or t
  modified_base (460)..(460): a, c, t, g, unknown or other
  misc_feature (460)..(460): n is a, c, g, or t
  modified_base (479)..(479): a, c, t, g, unknown or other
  misc_feature (479)..(479): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagccgtggggcctcagtgaaggtttcctgcaaggcttcaggatacaccttcactaggtatgctatacattgggtgcgccacggcccccgganaaaggctgagtggagtgggatggatcaacggctggcaagtggtaacaacaaaaaattcaactaagaagttccagggacagagtcacgtttacgaggacacactacgcgaagtattacttatatggagtcgtagagcgagccctaggacgtaactaccggaagaccgaaccggnttacgtagtttattttagngtacgtaccttgtagtggtaggttcctaagtttacttacgacttacgtaatttcggtaaccgttccgttacggggaccgtaaccgggtaccccggtttaggtacccgtaccccggttaccttccccgtacccg

SEQ ID NO: 260997 - DNA, 547 bp, Homo sapiens
  misc_feature: GYAE6OF02F6S90.1.5.A05.1.454.CMB.1.raw
  modified_base (286)..(286): a, c, t, g, unknown or other
  misc_feature (286)..(286): n is a, c, g, or t
  modified_base (419)..(419): a, c, t, g, unknown or other
  misc_feature (419)..(419): n is a, c, g, or t
  modified_base (462)..(462): a, c, t, g, unknown or other
  misc_feature (462)..(462): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccccgganaaaggcttgagtggatgggatggatcaacgctggcaatggtaaacacaaaaattcacagaagttccagggcagagtcactttaccagggacacatccgcgaggattacttatagtggagctgagcagctgagntaccgaagacacggctaggtattagttttgtagtcgtaccttntaggtggaggttcaagttattacgtctactaatttcgacttccgtgggacctagggtacccttggtccctaccgtctccgtaccg

SEQ ID NO: 260998 - DNA, 254 bp, Homo sapiens
  misc_feature: GYAE6OF02FOSOT.1.5.A05.1.454.CMB.1.raw
  modified_base (251)..(254): a, c, t, g, unknown or other
  misc_feature (251)..(254): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatctgaacgcactcgtctgagcgggctggcaaggcgcatagnnnn

SEQ ID NO: 260999 - DNA, 685 bp, Homo sapiens
  misc_feature: GYAE6OF02FZGUP.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagccgtggggcctcagtgaaggtttcctgcaaggcttcgaggtatacaccttcactaggtatgctatacattgggtgcgccaggcccccggacaaaggcttgagtggatgggatgggatcgaacgcgtaggcaagtggttaaacaactaaaaaaattcaacgaaggaacgttaccgaaggggacaaggaacgttcctaacccgttttaacccgaaggggtaacctaaccgaacgttacccggaccgtaagggtaacttttaaccgtttaattagtacgggtaagtacgtaacgacgaccgaagtacccgtagtaaggactaccggtaagaaccgacggtacgttacgttaatttagttttaggtacgtacgtacccgttcgttaaggtcgggagttacgtaatttaacgttacgcgtacttaagttccgacgttccgtagggtacccgtacgggtacccgttaggtacccgtacccgttcctcccgtaccgg

SEQ ID NO: 261000 - DNA, 532 bp, Homo sapiens
  misc_feature: GYAE6OF02F7IFZ.1.5.A05.1.454.CMB.1.raw
  modified_base (443)..(443): a, c, t, g, unknown or other
  misc_feature (443)..(443): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcacagaagttccagggcagagtcacctttacagggacacatccgcgagattacttatatggagctgagcagcctgagatccgaagacacgctgtattattttgngcgtactctagtggagtcattattacgctacgtaatttgacttccgtgggaccgtacgggtaccctggtacctaccggtcctcctaccg

SEQ ID NO: 261001 - DNA, 693 bp, Homo sapiens
  misc_feature: GYAE6OF02H5L68.1.5.A05.1.454.CMB.1.raw
  modified_base (207)..(207): a, c, t, g, unknown or other
  misc_feature (207)..(207): n is a, c, g, or t
  modified_base (244)..(244): a, c, t, g, unknown or other
  misc_feature (244)..(244): n is a, c, g, or t
  modified_base (283)..(283): a, c, t, g, unknown or other
  misc_feature (283)..(283): n is a, c, g, or t
  modified_base (420)..(420): a, c, t, g, unknown or other
  misc_feature (420)..(420): n is a, c, g, or t
tcagacgagtgcgtcacgaccggtgctcgattttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctgggcctnagtgaaggtttcctgcaaggcttcaggatacaccttnactagtatgctatacattgggtgcgccaggcccccgganaaaggcttgagtggatgggatggatcgaacgctggcaagtggaaacaacaaaaaattcaacaggaacgttccgaggcagacgtctacctttacgacggacacactccgagaggtattactatagtggatcgtagacngacgtccgttagacgtacttaccggaaagaccgtaacggtacgttagttaacttttaagttttttcggtacggtacccgggtaaccctttacggttaaaggttcggggttaaacggtaccgttaagttttaacgtttaacccggtaccttttaaccggaaagttttttccggaaccgttacccggtttacgggggaaccccggttaacgggggtaaacccccttggggtttaacccccgtaaccggttttccccgtacccgtttaacccccgg

SEQ ID NO: 261002 - DNA, 623 bp, Homo sapiens
  misc_feature: GYAE6OF02JZXK5.1.5.A05.1.454.CMB.1.raw
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
  modified_base (243)..(243): a, c, t, g, unknown or other
  misc_feature (243)..(243): n is a, c, g, or t
  modified_base (386)..(386): a, c, t, g, unknown or other
  misc_feature (386)..(386): n is a, c, g, or t
tcagacgagtgcgtcacgaccggtgctcgatttagatagatagacaggggacccaacaaccacatccctcctcagaagccccagagcacaacgccccaccatggactggacctggaggatcctctttttggtggcagcagccacaggtgcccactcccaggtccagcttgtgcagtctggggctgaggtgaagagcctgggcctnagtgaaggttccnggcaaggcttcgaggatacaccttnacgtaggtatgactatacattgggtgcgccaggccccggacaaggtctgagtggagtggatgatcgaacgctggcataggtaacaacaaaattcacgtagaacgttacgagggctagagtcactttacgaggtacacatccgngtacgattactatagtagtagctgagtcagtccgtagacgtacgtaccggaagtaccgacggtctacgtaatttagtttttacggcgtaccggtaccttacgttacggtaggttacggtacgttacgtttagttaccgtactttacgggtaattttaacggtacttcccgggttaacggggtccccgtaaggggttaacccgtgggttaccctaccgggttccttcccgttaaccgg

SEQ ID NO: 261003 - DNA, 555 bp, Homo sapiens
  misc_feature: GYAE6OF02GKLMZ.1.5.A05.1.454.CMB.1.raw
  modified_base (403)..(403): a, c, t, g, unknown or other
  misc_feature (403)..(403): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacgaaaaaattcacagaagttccagggcagatcacctttacagggacacatccgcgaggattacttatatgganctgagcagcctgagatccgaagacacggctaggtattattttgtgtccgtactcgtagtggtaggtcagttacttacgcttacgtaactttgaaccttccgtaggggtcccgtaagggaccccgttggttccgacccgttcctccttacccg

SEQ ID NO: 261004 - DNA, 256 bp, Homo sapiens
  misc_feature: GYAE6OF02HC93Z.1.5.A05.1.454.CMB.1.raw
  modified_base (250)..(256): a, c, t, g, unknown or other
  misc_feature (250)..(256): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgcatctgatcgtactgcgctgagcgggctggcaaggcgcatagnnnnnnn

SEQ ID NO: 261005 - DNA, 524 bp, Homo sapiens
  misc_feature: GYAE6OF02GX9DZ.1.5.A05.1.454.CMB.1.raw
  modified_base (473)..(473): a, c, t, g, unknown or other
  misc_feature (473)..(473): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatggggatggatcaacgctggcaatggtaacacaaaaaattcacagaagttccagggcagagtcactttacagggacacatcgcgaggattacttatatggagctgagcagcctgagatccgaagacacggctgtatattttgcgtcgtactctagtggagtctattattacgnttacgtaatttgactccgtgggacctagggaccctggtcaccgtctcctcg

SEQ ID NO: 261006 - DNA, 562 bp, Homo sapiens
  misc_feature: GYAE6OF02HNYJC.1.5.A05.1.454.CMB.1.raw
  modified_base (447)..(447): a, c, t, g, unknown or other
  misc_feature (447)..(447): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagccgtggggcctcagtgaaggtttcctgcaaggcttcgaggataccaccttcactaggtatgctatacattgggtgcgccaggcccccggacaaaggcttgagtggatgggatggatcaacgctggcaatggtaacaacgaaaaaattcaacagaagttccaggcagagtcaccttacagggacacatccgcgaggattacttatatgagctgagcagcctgagataccgaagacaggctgtatagttttgngtcgtacttgtagttggagtactagttattacgtcttagtaattttcggaccttaccggtcgggtacccgtagggtaaccccgttggtacccgtaacccggttcctccgtacccg

SEQ ID NO: 261007 - DNA, 579 bp, Homo sapiens
  misc_feature: GYAE6OF02HWHEO.1.5.A05.1.454.CMB.1.raw
  modified_base (287)..(287): a, c, t, g, unknown or other
  misc_feature (287)..(287): n is a, c, g, or t
  modified_base (397)..(397): a, c, t, g, unknown or other
  misc_feature (397)..(397): n is a, c, g, or t
  modified_base (421)..(421): a, c, t, g, unknown or other
  misc_feature (421)..(421): n is a, c, g, or t
  modified_base (457)..(457): a, c, t, g, unknown or other
  misc_feature (457)..(457): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcgagtgaaggtttcctgcaaggcttcaggatacaccttcactaggtatgctatacattgggtgcgccacggcccccgganaaaggcttgagtggatgggatggatcgaacgctggacaagtaggtaaacaacgaaaaaattcaacgaagaagttccaagggcagagtcacctttacgaggacacatccgngagattactatatggagctgacgnagctgagatcgaagacacgctagtattagttttggngtacgtactcgtagtcggtaagtctattaagttaccgtacgttacgtaaatttcgaaccgttccgtacggggacccgtacggggtaaccccttgggtccctaaccggttccttcccgtaccg

SEQ ID NO: 261008 - DNA, 634 bp, Homo sapiens
  misc_feature: GYAE6OF02HN7W6.1.5.A05.1.454.CMB.1.raw
  modified_base (286)..(286): a, c, t, g, unknown or other
  misc_feature (286)..(286): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtcccagcttgtgcagtctggggctgaggtgaagagcctggggcctcagtgaaggtttcctgcaaggcttcgaggatacaccttcacgtaggtatgttatacattggtgcgccaggcccccgganaaaggcttgagtggatgggatggactacgaacgccgtggcaagttggtaaacaactaaaaattcaacaagtaagttaccaagggacagagtacctaaccgtttaccgaagggtacaacagttacccggacgaaggtacttacttaagtaagtaggagtcgtgagcgagcctagagacgtaccgaacgaacgacggtacgttagtatttagttttagttcgacgttacctacgttaggtaggtaggtacgtagtttacgttacgtcttacttagtttacgtaccgtcgtacgggaccgtaccgggtaaccgttccgggtacctacccggttccttaccgtcgtacccgg

SEQ ID NO: 261009 - DNA, 183 bp, Homo sapiens
  misc_feature: GYAE6OF02H8MEX.1.5.A05.1.454.CMB.1.raw
  modified_base (180)..(183): a, c, t, g, unknown or other
  misc_feature (180)..(183): n is a, c, g, or t
tcagacgagtgcgtcacgaccggtgctcgatttagatagatagacagggcaccaagggccaatcggtcttccccctggcaccctcctccaagagcacctctgggggcacagcggccctgggctgcctggtcaaggactacttcctcgtactgcgctgagcgggctggcaaggcgcatagnnnn

SEQ ID NO: 261010 - DNA, 621 bp, Homo sapiens
  misc_feature: GYAE6OF02F4CDC.1.5.A05.1.454.CMB.1.raw
tcagacgagtgcgtcacgaccggtgctcgatttagatagatagacaggggacccaacaaccacatccctccttcaggaagcccccagagcacaacgccccaccatggactggaacctggaggatcctcttttggtggcagcagccacaggtgcccactcccaggtccagcttgtgcagtctggggctgaggtgaagaagcctggggcctcgagtgaaggtttcctgcaaggcttcaggactacaccttcacctaggtatcgcctatacacttgggtgcgccaggcccccggacaaaggcttgagtggatggggatggatcaacgcgtggcaatggtaacacgaaaaattcacagaagttccagggcagagtcacctttaacagggacacgatccgcgaggattactatatggagctgagcagcctgacgtactaccgaagtaccacggtctggtaactttagtttttggtcgtaccgtaacccttcgttaaggttgggtaacggttcgtaagtttagttaccggtacttacgtaaagttttcgtaaccgttcccggttcggggaccctaacggggtaaccccgttgggtacccgtacccggttcccgttacccgtacccgg

SEQ ID NO: 261011 - DNA, 853 bp, Homo sapiens
  misc_feature: GYAE6OF02HX3P6.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctgggctgaggtgaagaagcctggggcctcagtgaaggtttcctgcaaggcttcaggatacaccttcactaggtatgctatacattgggtgcgccgacggcccccggaacaaacggcttggagtggatggggatgggatcgaacgctggacaagtacggtaaacaacaaaaaaattcaacaaggtaaagttaccgaaggggacaggacgtacctaaccgttttaaccgaacggggaacaaccgtacgtacccggacggtaaggtaactttaactttaagtaacgttacggggaagtaccgttaggaacgtaccgaacggtaccgtacggaacgtaaacgttacccggaaaacggtaaccgtaaccggggtccgtttaacgggtttaaacgttttaacgtttttttaacggttcgggttaacccggttaaacccgtttaccgttaaacgggttttaacgggggtaaacggttaccgtttaaacgttttaacgttttaaccggtacctttaaccggttaaaacgttttttaccggttaaaaccgggttttcccccggttaacggggggggtaaccccccggttaaacggggggggtttaaacccccccgttaccgggggggttaaccccctttaaacccccggggttttccccgttacccccggtttaaccccccggg

SEQ ID NO: 261012 - DNA, 596 bp, Homo sapiens
  misc_feature: GYAE6OF02G7XG7.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggagtgggatggatcaacgctggcaatggtaacaacaaaaattcaacagaagttccgaggcagagtacacctttaccgagggacacactccgacgaggtattacttatagtggagctgagcagccgtgagacgtaccgaagaccgacggcttagtatttagtttttacgtgaccgtaccttcgttagttcggtaggttactagtttacgttaccgtacttacgtaactttgtaccgtccggtacggggtacccgtaacgggtacccgtcggtacccgtacccgttccgtcccttaccgg

SEQ ID NO: 261013 - DNA, 542 bp, Homo sapiens
  misc_feature: GYAE6OF02ILCN8.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatggggatgggatcaacgctggcaatggtaacacaaaaattcacagaagttccagggcagagtacacctttaccagggacacatccgacgaggattacttatatggagctgagcagcctgagatccgaagacacgggctagtattatttttgtgcgtaccttcgtagtggagttcattattacgcttctaattttgacttccgtgggtacccgagggaacccttggtcacccggtctcctccg

SEQ ID NO: 261014 - DNA, 618 bp, Homo sapiens
  misc_feature: GYAE6OF02GHD5U.1.5.A05.1.454.CMB.1.raw
  modified_base (285)..(285): a, c, t, g, unknown or other
  misc_feature (285)..(285): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccacggcccccgganaaaggcttggagtggagtgggatggatcgaacgcgtggcaagtggtaaacaacaaaaattcaacaagtaacgttacgagggcagagtcaaccgtttacgagggacacacgtccgacgaggtatttacttagtagtggagtcgtagagcacggacctgacgactaccgaagaccgacggtctagttaatttagttttgtacgtccgtacttacgttaggtggtaggttactattacgttacgtacttaccgttaagtttacgtaccgttccggtcggggtaccgtaaccgggtacccttcgggttaccctacccggttaccgtcccgtacccgg

SEQ ID NO: 261015 - DNA, 185 bp, Homo sapiens
  misc_feature: GYAE6OF02IHNTT.1.5.A05.1.454.CMB.1.raw
  modified_base (179)..(185): a, c, t, g, unknown or other
  misc_feature (179)..(185): n is a, c, g, or t
tcagacgagtgcgtcacgaccggtgctcgatttagatagatagacagggcaccaagggcccatcggtcttcccctggcaccctcctccaagagcacctctgggggcacagcggccctgggctgcctggtcaaggactacttcctcgtactgcgctgagcgggctggcaaggcgcatagnnnnnnn

SEQ ID NO: 261016 - DNA, 521 bp, Homo sapiens
  misc_feature: GYAE6OF02FZ8FE.1.5.A05.1.454.CMB.1.raw
  modified_base (243)..(243): a, c, t, g, unknown or other
  misc_feature (243)..(243): n is a, c, g, or t
  modified_base (445)..(445): a, c, t, g, unknown or other
  misc_feature (445)..(445): n is a, c, g, or t
  modified_base (463)..(463): a, c, t, g, unknown or other
  misc_feature (463)..(463): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttcctgcaaggcttcaggatacaccttnactaggtatgctatacattgggtgcgccaggcccccggcaaaagggcttgagtggatgggatggatcaacgctggcaatggtaacacaaaaaattcaacagaagttccagggcagagtcactttaccagggacacatccgcgaggattacttatatggagctgagcagcctgagatccgaagacacggctgtatatttttgngtcgactctagtgaggtnattatacgctcaattgactccgtgggccacgggaaccctggtacaccggtctccctcg

SEQ ID NO: 261017 - DNA, 602 bp, Homo sapiens
  misc_feature: GYAE6OF02I0C2Z.1.5.A05.1.454.CMB.1.raw
  modified_base (332)..(332): a, c, t, g, unknown or other
  misc_feature (332)..(332): n is a, c, g, or t
  modified_base (411)..(411): a, c, t, g, unknown or other
  misc_feature (411)..(411): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggcccccggacaaagcttgagtggatgggatgggatcaacgctggacaatggtaacanaaaaaattcacagaagttcaggcagacgtcacctttacgacgggacacactaccgcgaggattacttagtaatggacgnttgagcagcctggagatcgaacacgcggctgtattattttgtgtacgtacctcgttacgtggtacggttactagtttattaccgtacgttacgttaacttttaccggtaactttcccggtacggggtaccccgtaacggggttaacccggttaccggtttacccggaccccgttaccgtcccgttaacccg

SEQ ID NO: 261018 - DNA, 253 bp, Homo sapiens; identical to SEQ ID NO: 259990
  misc_feature: GYAE6OF02ICLM0.1.5.A05.1.454.CMB.1.raw
  modified_base (250)..(253): a, c, t, g, unknown or other
  misc_feature (250)..(253): n is a, c, g, or t

SEQ ID NO: 261019 - DNA, 268 bp, Homo sapiens
  misc_feature: GYAE6OF02JXLPE.1.5.A05.1.454.CMB.1.raw
  modified_base (251)..(252): a, c, t, g, unknown or other
  misc_feature (251)..(252): n is a, c, g, or t
  modified_base (254)..(268): a, c, t, g, unknown or other
  misc_feature (254)..(268): n is a, c, g, or t
tcagacgagtgcgtcacgaccggtgctcgatttagatagatagacaggggcgagttccagatttcaactgctcatcagcagcctgcagtctgaagattttgcagtttattactgtcagcagtataataactggccttcgacgttcggaccaagggaccaaggtgaaatcaaacgactgtggctgcaccatctgtctcatctcccgcatctgatcgtactgcgctagagcggctggacaaggccgctatagnntnnnnnnnnnnnnnnn

SEQ ID NO: 261020 - DNA, 525 bp, Homo sapiens
  misc_feature: GYAE6OF02FKDLG.1.5.A05.1.454.CMB.1.raw
  modified_base (401)..(401): a, c, t, g, unknown or other
  misc_feature (401)..(401): n is a, c, g, or t
  modified_base (491)..(491): a, c, t, g, unknown or other
  misc_feature (491)..(491): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttcttggtggcagcagccacaggagcccactcccaggtgcagctggtgcagtctggggctgaggtgaagaagcctggggcctcagtgaaggtctcctgcagtgcttctggttacatcttttccacctacggtatgaattggttgagtacaggcccccggagaggggcttgagtggatgggatggatcgagcccttacggaactaaaacagagtatggagagaagttccgagggcagagtcatcatcaccgcggacacatccacgagtacagcctanatggaactgaggacgcctcagatcgtagaccgacacggccacttattactgcgcgagagtattatgcagtcggtcctggctcggtaaccncgtcttggtcggctacggtcgggcctaaccgggg

SEQ ID NO: 261021 - DNA, 538 bp, Homo sapiens
  misc_feature: GYAE6OF02FVP0I.1.5.A05.1.454.CMB.1.raw
  modified_base (445)..(445): a, c, t, g, unknown or other
  misc_feature (445)..(445): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggctcaggatacaccttcactaggtatgctatacattgggtgcgccaggcccccggacaaaggcttgagtggatgggatggatcaacgctggcaatggtaacacaaaaaattcaacagaagttaccagggcagagtcactttaccagggacacatccgcaggattacttatatggagctgagcagcctgagatccgaagacacggctgtattattttgngtcgacctcttagtggtagtctattattacgctctaatttcgaccttccgtgggccgtacgggtaccctcggtactacccgtcctccgtaccg

SEQ ID NO: 261022 - DNA, 540 bp, Homo sapiens
  misc_feature: GYAE6OF02I8K9L.1.5.A05.1.454.CMB.1.raw
  modified_base (445)..(445): a, c, t, g, unknown or other
  misc_feature (445)..(445): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacaacaaaaattcaacagaagttccagggcagagtcactttacagggacacatccgcgaggattactatatggagctgagcagccgtgagactcgaagacacggctgtattattttgngcgtactcgtagtggaggtctattattacgcttacgtaatttcgacttccgtgggcctacgggtacccgttcggtccgtaccggtcctcctaccg

SEQ ID NO: 261023 - DNA, 565 bp, Homo sapiens
  misc_feature: GYAE6OF02JCTNV.1.5.A05.1.454.CMB.1.raw
  modified_base (285)..(285): a, c, t, g, unknown or other
  misc_feature (285)..(285): n is a, c, g, or t
  modified_base (404)..(404): a, c, t, g, unknown or other
  misc_feature (404)..(404): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggccccccgganaaaaggcttgacgtggatgggatggatcgaacgctggcaatggtaacacaaaaattcacagaagttccaggcagagtcacctttacagggacacatccgacgagattactatatggagntgagcagcctgagataccgaagacgacggctagttacttatttttggtgtaccgtaccttcgttaggtgggaaggttcaagtttattacgcttactaacgtttcaccttccgtgggacccgacgggtacccgttcggtaccacccggttcctccgtacccg

SEQ ID NO: 261024 - DNA, 520 bp, Homo sapiens
  misc_feature: GYAE6OF02GTG54.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcacagaagttccagggcagagtcacctttaccagggtacacatccgcgaggattactatatggagctgagcagcctgagatccgaagacacggctgtattattttgtgcgactctagtggtaggtcattattacgctctaatttgactcctgggccagggtaccctggtcaccgtctcctcg

SEQ ID NO: 261025 - DNA, 756 bp, Homo sapiens
  misc_feature: GYAE6OF02JPKLB.1.5.A05.1.454.CMB.1.raw
  modified_base (209)..(209): a, c, t, g, unknown or other
  misc_feature (209)..(209): n is a, c, g, or t
tcagacgagtgcgtcacgaccggtgctcgatttagatagatagacaggggacccaacaaccacatccctcctcagaagccccacgagcacaacgccccaccactggactggacctggaggatcctctttttggtggtcagcagccacaggtgcccactcccaggtccagcttgtgcagtcgtgggctgaggtgaagaagcctgggcctnaggtgaaggttttccgacaaggcttcaggacttacgaccttcacgttaggtatcggactactactagttggtagtccgtaccgacggtcccccggaacaaacggtcgttacggaacggttcgggtaacgtgggaatcgggtacttcgaaccgtcgttcggaacgtaacgttaggtaaaacctaactaaaaaacgtttccaaacgtaggtaaacggtttaccgaacgggtactacggtaacgttaccgtaacccgtttacgaaacggactaaccgaacgttcccggcggtaacgtacgtttaacgttaatacggttacggaagtccgtagtaacgtacgacgaccgtacgtagtaacgtacggtaaacgccgtaacggtccgttagttaaacgtttcgtttttaggacgtccggtaaacccgtttggttaacgtcgggtataccgttatttaacgttacgtacttacgttaacgttgtaaccttcccgggtaagggtccccgtaagggttacccgtacggttaccggaccgtttacccgttccgacgg

SEQ ID NO: 261026 - DNA, 542 bp, Homo sapiens
  misc_feature: GYAE6OF02HEVP0.1.5.A05.1.454.CMB.1.raw
  modified_base (451)..(451): a, c, t, g, unknown or other
  misc_feature (451)..(451): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgccggcaatggtaacacaaaaaattcacagaagttccagggcagagtcactttacaggacacatccgcgaggattactatatggagctgagcagcctgagataccgaagacacggctgtatattttgtgcgaccttntagtggaggtctattattacgctactaagtttgacttccgtggggcccgtaaggggaacccttgggtacctacccggtcttccgtctaccg

SEQ ID NO: 261027 - DNA, 181 bp, Homo sapiens
  misc_feature: GYAE6OF02IWE02.1.5.A05.1.454.CMB.1.raw
  modified_base (179)..(181): a, c, t, g, unknown or other
  misc_feature (179)..(181): n is a, c, g, or t
tcagacgagtgcgtcacgaccggtgctcgatttagatagatagacagggcaccaagggcccatcggtcttcccctggcaccctcctccaagagcacctctgggggcacagcggccctgggctgcctggtcaaggactacttcctcgtactgcgctgagcgggctggcaaggcgcatagnnn

SEQ ID NO: 261028 - DNA, 185 bp, Homo sapiens
  misc_feature: GYAE6OF02HW6GE.1.5.A05.1.454.CMB.1.raw
  modified_base (180)..(185): a, c, t, g, unknown or other
  misc_feature (180)..(185): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttccagtactctatctgagcgggctggcaaggcgcatagnnnnnn

SEQ ID NO: 261029 - DNA, 646 bp, Homo sapiens
  misc_feature: GYAE6OF02GNJ3X.1.5.A05.1.454.CMB.1.raw
  modified_base (334)..(334): a, c, t, g, unknown or other
  misc_feature (334)..(334): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccacggcccccggacaaaggcttgagtggagtgggatggatcgaacgctggcaatggtaacaanaaaaaattcaacagaagttcgaggcagagtacactttaaccagggaacacgactccggacgtaaggtactttacttataagtcggtaagcgtagagacaggccctgacggactaccggaaacgtacgaaccgggtcgttacgttaatttacgtttttaggtcgtaccgtacccttcgttaaggttgggaacggtttactaagtttactttaccggtccttacgtaagttttacgaaccgttccggttacggggacccgtaacggggtaacccgttaccgggttaccctacccggttccctcccgttaacccg

SEQ ID NO: 261030 - DNA, 550 bp, Homo sapiens
  misc_feature: GYAE6OF02I9WPT.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggcccccggacaaaggcctgagtggatgggatggatcaacgctggcaatggtaacacaaaaattcaacagaagttaccagggcaagagtacacctttacgaggacacatccgcgaggattactatatggagctagagcagcctagagagtaccgaagaccgacggtctgtattagttttgtcgtacgtactctaggtggagttactattacgttacgctacgtaatttgtacgttccgtagggtccacgggtaccctggtccaccgtcctccgtaccg

SEQ ID NO: 261031 - DNA, 623 bp, Homo sapiens
  misc_feature: GYAE6OF02HQ3CO.1.5.A05.1.454.CMB.1.raw
  modified_base (440)..(440): a, c, t, g, unknown or other
  misc_feature (440)..(440): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagccgtggggcctcagtgaaggtttcctgcaaggcttcaggatacaccttcactaggtatgctatacattgggtgcgccaggcccccggacaaaggcttgagtggatggggatggatcgaacgcgtggcaagtaggtaacaacaaaaaattcaacagaaagttccagggtacagagtacacctttaccgagggacacatacccgcgaacggtattacgttatagtaggagcgtagagcagtccgngagactaccgaagaccgacgctagttattaagtttttgtgcgtacctcgttaagtggtagtaccgtaatttacgttacgtaccttacgtaacgttttacggaccttacccggttacgggggacccgtaacgggggtaaccccgttcggggttaccctacccgggttccttaccccgttaaccg

SEQ ID NO: 261032 - DNA, 568 bp, Homo sapiens
  misc_feature: GYAE6OF02G5AG3.1.5.A05.1.454.CMB.1.raw
  modified_base (475)..(475): a, c, t, g, unknown or other
  misc_feature (475)..(475): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggccccccggacaaaaggcttggagtgggatggggatggatcaacgctggcaagtggtaacaacgaaaaaattcaacaagaagttccagggcagagtcactttaccagggacacatccgagaggattacttatagtggagcttgagcagccctgagataccgaagacacggactaggttattagtttttgacgtcgtacctntagttggagtctagttagtaccgtactacgtaattttgaccttccgtaggggccctaacgggacccttggtaccctacggtcctacctacccg

SEQ ID NO: 261033 - DNA, 553 bp, Homo sapiens
  misc_feature: GYAE6OF02JIL2L.1.5.A05.1.454.CMB.1.raw
  modified_base (386)..(386): a, c, t, g, unknown or other
  misc_feature (386)..(386): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgacgtggatgggatggatcaacgctggcaatggtaacacaaaaattcaacagaagttaccgagggcagagtcacctttacaggacacatccgngagattacttatagtggagctgagcagcctgagactacgaacgacgacggctagtattagttttgacggtcgtaaccttcgttaagttgggagttactatttaatacgtctacgtaagtttcgactccgtgggccgacggtacccgtgtaccgaccgtctcctaccg

SEQ ID NO: 261034 - DNA, 530 bp, Homo sapiens
  misc_feature: GYAE6OF02JDTEO.1.5.A05.1.454.CMB.1.raw
  modified_base (406)..(406): a, c, t, g, unknown or other
  misc_feature (406)..(406): n is a, c, g, or t
  modified_base (433)..(433): a, c, t, g, unknown or other
  misc_feature (433)..(433): n is a, c, g, or t
  modified_base (445)..(445): a, c, t, g, unknown or other
  misc_feature (445)..(445): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggccccccggacaaaggcttgagtggatgggatggatcaatgctggcaatggtaacacaaaaattcacagaagttccagggcagagtcacttaccaggacacatccgacgaggattacttatatggagctgancagcctagagataccgaagacgacggntgtatattttgngtcgtacttctaggtggagtcagttattacgctctaatttgacttccgtggggacctacgggtaaccctggtcaccgttctcccg

SEQ ID NO: 261035 - DNA, 532 bp, Homo sapiens
  misc_feature: GYAE6OF02IYOZR.1.5.A05.1.454.CMB.1.raw
  modified_base (381)..(381): a, c, t, g, unknown or other
  misc_feature (381)..(381): n is a, c, g, or t
  modified_base (454)..(454): a, c, t, g, unknown or other
  misc_feature (454)..(454): n is a, c, g, or t
tcagacgagtgcgtcacgaccggtgctcgatttagatagatagacaggggacccaacaaccacatccctcctcagaagcccctcagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccacggcccccggacaaaggcttgagtggatgggatggatcaacgctggcaatggtaacacaaaaattcacagaagttcaggcagagtcaccttacaggacacatccgngaggattactatatggagctgagcagcctgagatccgaagacgacgcttgtattagttttgtgtcgtaccttntaggtggtagtctattatacgtctactatttcgacgttccgtgggaccacgggtaccctggtcctaccggtctacccg

SEQ ID NO: 261036 - DNA, 838 bp, Homo sapiens
  misc_feature: GYAE6OF02GB04D.1.5.A05.1.454.CMB.1.raw
  modified_base (220)..(220): a, c, t, g, unknown or other
  misc_feature (220)..(220): n is a, c, g, or t
  modified_base (245)..(245): a, c, t, g, unknown or other
  misc_feature (245)..(245): n is a, c, g, or t
tcagacgagtgcgtcacgaccggtgctcgatttagatagatagacaggggacccaacgaaccacatccctcctcagaagcccccagagcacaacgccccaccatggactggacctggatgatcctcttttggtgcagcagccacaggtgcccactcccaggtccagcttgtgcagtctgggctgaggtgaagagccgtgggcctcgagtgaaggtttccngcaaggcttcgaggtatacaccttnactaggtatgctatactattggtgacgtcgtacggcccccggacgaaacggccttaggtacggtacgggtagtaggggagtggggtactacgaacggacgttacggaccgtaaagttgggtaaacctaacgtaaaaaagttccaaacgtaacggtaaagttaccgaagggacgtaacggtaacgttaccgtaaccgtttaaccgaaggggtaaacctacgaacgttacccggacggtaagggtaacctttaacgttaacttaaggttacgggtaacgtacgtttacggaacgttaccgaacggtaccctagggtaacgtacggttaccggaaacggaaccgtaccgggtacgttacgttaaacgttacgggttttttcgtaacgggttccgttaaccggttacggttaaacggttcgggttaacggttaacccgttaggttttaacccgtttacccggtttaacgtttaccggttaaacgtttttaccggtaacccgttttacccggtttacgggggaaccccggtttaaccggggtttaaccccgttaccggggtaaccccggtttacccggttaacccgttttcccccggg

SEQ ID NO: 261037 - DNA, 578 bp, Homo sapiens
  misc_feature: GYAE6OF02H9BPT.1.5.A05.1.454.CMB.1.raw
  modified_base (207)..(207): a, c, t, g, unknown or other
  misc_feature (207)..(207): n is a, c, g, or t
  modified_base (245)..(245): a, c, t, g, unknown or other
  misc_feature (245)..(245): n is a, c, g, or t
  modified_base (393)..(393): a, c, t, g, unknown or other
  misc_feature (393)..(393): n is a, c, g, or t
  modified_base (414)..(414): a, c, t, g, unknown or other
  misc_feature (414)..(414): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctnagtgaaggttttcctgcaaggcttcaggatacaccttnactaggtatgctatacattggggtgcgccaggcccccggacaaaggcttggagtggatgggatgggatcaacgcgtggcaatggtaacaacaaaaaattcaacagaagttccagggacagagtctacctttacgagggacacatccgngaggtattacttatagtgganctgagcagctgagataccgaagaccacggctagttattagtttttagtcgtacgaccttcgtagttggaggttctatttagttacgtcttacgtaagtttcgacttccgtacggggcccgtagggtaaccccttcgggttaccacccgtttccgccttacccgg

SEQ ID NO: 261038 - DNA, 272 bp, Homo sapiens
  misc_feature: GYAE6OF02H7SSJ.1.5.A05.1.454.CMB.1.raw
  modified_base (256)..(256): a, c, t, g, unknown or other
  misc_feature (256)..(256): n is a, c, g, or t
  modified_base (258)..(272): a, c, t, g, unknown or other
  misc_feature (258)..(272): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgactgttgctgcacatctgtcttcatctcccgccatctgacgtgtctgatcgtgacgcgggctgggacaagggccgctataggntnnnnnnnnnnnnnnn

SEQ ID NO: 261039 - DNA, 540 bp, Homo sapiens
  misc_feature: GYAE6OF02G2ZR6.1.5.A05.1.454.CMB.1.raw
  modified_base (343)..(343): a, c, t, g, unknown or other
  misc_feature (343)..(343): n is a, c, g, or t
  modified_base (406)..(406): a, c, t, g, unknown or other
  misc_feature (406)..(406): n is a, c, g, or t
  modified_base (419)..(419): a, c, t, g, unknown or other
  misc_feature (419)..(419): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggcccccggacaaaggctgagtggatgggatggatcaacgctggcaagtggtaacaacgaaaaattcaanagaacgttccgagggcagagtcactttacgaggacacactccgacgaggattactatatgganctgagcagcctgngactcgaagacacgactgtattagttttgagtcgtactcgtagtggagtctattacttacgctacgtaattgtacctcgtcgggacctacgggaccttggtaccaccgttactccgtaccg

SEQ ID NO: 261040 - DNA, 312 bp, Homo sapiens
  misc_feature: GYAE6OF02FVF00.1.5.A05.1.454.CMB.1.raw
  modified_base (265)..(265): a, c, t, g, unknown or other
  misc_feature (265)..(265): n is a, c, g, or t
  modified_base (267)..(267): a, c, t, g, unknown or other
  misc_feature (267)..(267): n is a, c, g, or t
  modified_base (271)..(312): a, c, t, g, unknown or other
  misc_feature (271)..(312): n is a, c, g, or t
tcagacgagtgcgtcacgaccggtgctcgatttagatagatagacagggggcagttccagatttcaactgctcatcagcagcctgcagtctgaagtatttttgcagttttattactgtcagcagtataataactggcctccgacgttcggccaagggaccaaggtggaaatcaaacgaactgtggctgcaccatctgtcttcatcttcccgccatctgagagtgcgtctctgaggccgggctgggcaaagggcgaccaagtaagnangcannnnnnnnnnnnnnnnnnnnnnnnnnnnnnnnnnnnnnnnnn

SEQ ID NO: 261041 - DNA, 558 bp, Homo sapiens
  misc_feature: GYAE6OF02H8GYX.1.5.A05.1.454.CMB.1.raw
  modified_base (284)..(284): a, c, t, g, unknown or other
  misc_feature (284)..(284): n is a, c, g, or t
  modified_base (402)..(402): a, c, t, g, unknown or other
  misc_feature (402)..(402): n is a, c, g, or t
  modified_base (447)..(447): a, c, t, g, unknown or other
  misc_feature (447)..(447): n is a, c, g, or t
  modified_base (457)..(457): a, c, t, g, unknown or other
  misc_feature (457)..(457): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggcccccgganaaaggcttgagtggatgggatggatcaacgctggcaatggtaacacaaaaaatcaacagaagttccagggcagagtcactttaccgagggacacatccgacgagattactatatgganctgagcagcctgagatccgaagacgacgctagttatagtttttgngtcgtacctnttagtggaggtctattattacgcttacgtaatttaggaccttccgtggggtacccgtacggggtaaccccgtggttacgtacccggttcctaccctacccg

SEQ ID NO: 261042 - DNA, 602 bp, Homo sapiens
  misc_feature: GYAE6OF02I5QI1.1.5.A05.1.454.CMB.1.raw
  modified_base (307)..(307): a, c, t, g, unknown or other
  misc_feature (307)..(307): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctggaggtgaagaagcctggggcctcagtgaggtttcctgcaaggcttcgaggatacaccttcactaggtatgctatacattgggtgcgccacggcccccggacaaggcttgagtggagtgggntggatcgaacgctggcaagtaggtaacaactaaaaattacaacagaacgttccgagggacagacgtcacctttaccgagggtacacactcggacgaggtacttaacttaatagtaggtagtactggagacagcctagagagtaccgaagaccgacgctgtattagttttgtgtcgtacctcgtaggttggtacggtactagttacttacgcttacgtaatttcgtaccgtcccggttaggggacccgtaacggggtaacccgttcgggtacccgtacccggtcctacccgtaccg

SEQ ID NO: 261043 - DNA, 537 bp, Homo sapiens
  misc_feature: GYAE6OF02FPRQO.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcacagaagttccagggcagagtcacctttacagggacacatccgcgaggattacttatatggagctgagcagcctgagatccgaagacacggctgtattagttttgtgtcgtacctcgtagtggaggttactattattacgcttacgtaatttgacttccgtgggcctacgggtaccctggtcctaccgtctcctccg

SEQ ID NO: 261044 - DNA, 544 bp, Homo sapiens
  misc_feature: GYAE6OF02GNJNC.1.5.A05.1.454.CMB.1.raw
  modified_base (460)..(460): a, c, t, g, unknown or other
  misc_feature (460)..(460): n is a, c, g, or t
tcagacgagtgcgtcacgaccggtgctcgatttagatagatagacagggggacccaacaaccacatccctcctcagaagcccccagagcacaacgccccaccatggactggacctggatgatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatggggatggatcaacgctggcaatggtaacacaaaaaattcaacggaagttccgagggacagagtcacctttaccagggacacatccgcgaggattacttatataggagctgagcagcctgagatcgaagacacggctgtattattttgtgtcgacctntagtggtaggtctattattacgcttacgtaatttgtacttccgtgggtaccctagggaaccctggtacaccggttctctacccg

SEQ ID NO: 261045 - DNA, 254 bp, Homo sapiens; identical to SEQ ID NO: 259973
  misc_feature: GYAE6OF02GHQUX.1.5.A05.1.454.CMB.1.raw
  modified_base (251)..(254): a, c, t, g, unknown or other
  misc_feature (251)..(254): n is a, c, g, or t

SEQ ID NO: 261046 - DNA, 571 bp, Homo sapiens
  misc_feature: GYAE6OF02GUVH9.1.5.A05.1.454.CMB.1.raw
tcagacgagtgcgtcacgaccggtgctcgatttagatagatagacgagggggacccaacaaccacatccctcctcagaagcccccagagcacaacgccccaccgactggactggaccctggaggatcctctttttggtggcagcagccacaggtgcccactcccaggtcccagcttgtgcagtctggggcctgaggtgaagaagcctggggcctcgagtgaaggtttcctgaccaagggcttcaggactacaccttcacgtaggtatgactatacattgggtgtcgccaggcccccggacaaagggcttggacgtggatggggatggatcaacggctggcaatggtaacacaaaaaattcaacagaagttccagggcagagtacactttaccaggggacaacatccgcgaggatacttatatggagctgagcagcctgagtatccgaagaacgtacgctgtattagttttagtgtcgtaccttctagttcggaggtctattatacgctacgaatttgaacctaccgttgggacccgtagggaacccttggtacccaccgtccgttcctccg

SEQ ID NO: 261047 - DNA, 728 bp, Homo sapiens
  misc_feature: GYAE6OF02HVOTT.1.5.A05.1.454.CMB.1.raw
  modified_base (287)..(287): a, c, t, g, unknown or other
  misc_feature (287)..(287): n is a, c, g, or t
  modified_base (323)..(323): a, c, t, g, unknown or other
  misc_feature (323)..(323): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccgacggcccccgganaaaggtcttgagtggatgggatggatacgacgtcgnggacaagtaggtaaacaaaactaaaaattcaacgtaaggtaacgttaccggaacggacaaggtaccgttaacccgttaacccgtttaaacggaacgggtaaccaaccgtaccgtcccggaacggtaacggttacttttaaacgttacttaaggtacgggtacgtcgtaagacgcgtaacggtcgtagacgtacgtaaccggaacgaaccggacgtacgttacgtttaattttcgtttttacggcgtaccgttaccgttacggttaggttcgggtacggttaactttaacgtttacgttaccgtcttaacgtttagtttacccgtacgttacccgggtacggggtacccggtaacccgggttacccggttccggttacccgtaccgttacccgttcccgtaacccg

SEQ ID NO: 261048 - DNA, 554 bp, Homo sapiens
  misc_feature: GYAE6OF02HNGS4.1.5.A05.1.454.CMB.1.raw
  modified_base (286)..(286): a, c, t, g, unknown or other
  misc_feature (286)..(286): n is a, c, g, or t
  modified_base (449)..(449): a, c, t, g, unknown or other
  misc_feature (449)..(449): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccccgganaaaggcttgagtggatgggatggatcaacgctgggcaatggtaacaacaaaaaaattcaacagaagttccaggcagagtcacctttacagggacacatccgcgaggatacttatatggagctgagcagcctgagatccgaagacacggctgtattatttttgngtacgacctcgtagtggtaggtctattagttacgcttctaaatttcgaccttccgtggggacccaaggggtaacccctggttaccacccggttctcccgttaccg

SEQ ID NO: 261049 - DNA, 575 bp, Homo sapiens
  misc_feature: GYAE6OF02FQ9Y2.1.5.A05.1.454.CMB.1.raw
  modified_base (401)..(401): a, c, t, g, unknown or other
  misc_feature (401)..(401): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatggggatggatcaacgctggcaatggtaacaacaaaaaattcaacagaagttccagggcagagtcacctttaccagggacacatccgcgaggattacttanatggagctgagcgagccgtgagactaccgaagacacggctagtattacgtttttgtgtccgtacctcgttagtgggtaggtctagtttacttacgcttacgtaattttcgaaccttccgttacggggacccgtaacggggtacccgttggtaccctaccgttccgtccctaccg

SEQ ID NO: 261050 - DNA, 531 bp, Homo sapiens
  misc_feature: GYAE6OF02HTVOT.1.5.A05.1.454.CMB.1.raw
  modified_base (412)..(412): a, c, t, g, unknown or other
  misc_feature (412)..(412): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaaggcttgagtggatgggatggatcaacgctggcaatggtaaacacaaaaaattcaacagaaagttccagggcagagtcacctttacgaggacacatccgagagattacttatatggagctgagnagccgtgagatcgaagacgacggctgtattattttgtgcgtactcgttagtggagtctattattacgtctcgaatttcgagtcctggggccagggtacctggtccaccgttctctaccg

SEQ ID NO: 261051 - DNA, 773 bp, Homo sapiens
  misc_feature: GYAE6OF02I4947.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtctggggctgaggtgaagagcctggggcctcagtgaaggtttcctgcaaggcttcaggataccaccttcactaggtatgctatacattgggtgcgtccaggccccccggacaaacggcttggagtcggagtagggatggagtcgaacgcgtggacaatacggtaaacgaacaaaaaactttacaacgagtaacgtttacccgagggtacagagtacgtaaccttttaaccgacgggaacaacgtacgtcccgacggtaacggtaactttaaccttaacgttaacgttagggacggtacgttggaaggtaccgacggtaccttaggaacggtaacgttaccggaaacggtaacgaccgggtacgttacggttaacgtttaacgttttttacggttacggtaccggttaaccctttacggttacggtttacggggttaacggttaacgttacgtttttaaagttaccggttactttaccgttaaaggttttttccggaaaccgtttccccgttaacgggggtaccccgttaaccgggggaaaccccggtttaccgggttaccccgtaacccgggttaccccttacggtttaaccccgg

SEQ ID NO: 261052 - DNA, 764 bp, Homo sapiens
  misc_feature: GYAE6OF02JYS0Y.1.5.A05.1.454.CMB.1.raw
  modified_base (205)..(205): a, c, t, g, unknown or other
  misc_feature (205)..(205): n is a, c, g, or t
  modified_base (219)..(219): a, c, t, g, unknown or other
  misc_feature (219)..(219): n is a, c, g, or t
  modified_base (284)..(284): a, c, t, g, unknown or other
  misc_feature (284)..(284): n is a, c, g, or t
tcagacgagtgcgtcacgaccggtgctcgatttagatagatagacagggaccaacaaccacatccctcctcagaagccccacgagcacaacgccccaccatggactggacctggaggatcctcttttggtggcagcagccacaggtgcccactcccaggtccagcttgtgcagtctggggctggaggtgaagagcctggggcctnagtgaaggtttccnggcaaggcttcaggactacgaccttcactaggtatgctatacattggtgcgccacggccccgganaaacggcttcgagtggagtcggatggatcgacgactggacagtaggtaacgaacaaaaacgttcaactaaggaacgttaccgaaggggctaaggacgtactaaccgttttaacgaacgggtaaccaacgtacgtacccggacgtaagggtaactttaacttaacgtaacgttagggaacgtccttaggaacggtactacggacccgttagaacggttaactacccgggaaaggacccgtaaccggggtactacgggtttaaactttacggtttttttaggtaccgtaaccgggttacccgttacgttaacgggttagggtaaaccggttcgttaagttttaacgtaccgttacgtttacgtaaacgtttttacggtaacccgtttaccgggtttacggggggtaaccccgtaaccgggggttaacccgttaccgggtttacccgtaacccgggtttaccccgttacccgttaaccccggg

SEQ ID NO: 261053 - DNA, 668 bp, Homo sapiens
  misc_feature: GYAE6OF02JL6Q5.1.5.A05.1.454.CMB.1.raw
  modified_base (270)..(270): a, c, t, g, unknown or other
  misc_feature (270)..(270): n is a, c, g, or t
  modified_base (286)..(286): a, c, t, g, unknown or other
  misc_feature (286)..(286): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagccttgtgcagtctggggctgaggtgaagaagcctggggcctcagtgaaggtttcctgcaaggcttcaggatacaccttcactaggtatgctatacattgggtncgcacggcccccgganaaaggcttgagtggatgggatggatacgaacgcgtaggctaatgggtaaacaacgtaaaaaacttcaactaggtaaacgttccgaacggggacaggacgtactacccgtttaacgacgggaacacgactaccgacgtacggtactttacgtatagtacggagtcgtagacgacgtagccgtagtacgtacgtaccgaagaccgtacggtacgtagttacttagtttttcgacgttaccgtaccgttacgttagggttcggtacggttaaccttagtttaccgttacgtaccgttaacgttaagtttcggtaccttacccggttcggggaccgtaaccggggtaccgttcggttacccgtacccggtttccacccgttacccg

SEQ ID NO: 261054 - DNA, 547 bp, Homo sapiens
  misc_feature: GYAE6OF02G39W6.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaacgttcacagaagttccagggcagagtcaacctttacagggacacatccgcgagattacttatatgagctgagcagcctgagatccgaagaccacggctagtattattttgtgtcgtaccttcgtagttgggaggttctatttatacgtctactaatttcgaccttccgtcgggcccgacgggtaccctcggtacgtaccgttcctcctaccg

SEQ ID NO: 261055 - DNA, 537 bp, Homo sapiens
  misc_feature: GYAE6OF02H7AQU.1.5.A05.1.454.CMB.1.raw
  modified_base (244)..(244): a, c, t, g, unknown or other
  misc_feature (244)..(244): n is a, c, g, or t
  modified_base (408)..(408): a, c, t, g, unknown or other
  misc_feature (408)..(408): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttnactaggtatgctatacattgggtgcgccaggcccccggacaaaggcttgactggatgggatgggatcaacgctggcaatggtaaacaacaaaaaaattcaacagaagttcccagggcagagtcacctttaccagggacacatccgcgaggattactatatgganctgagcagcctgagatccgaagacacggctgtattatttttgcgtcgaccttctagtgggagtcattattacgcttctaatttgactccgttcgggcctagggtaccctggtccaccgttcctcctccg

SEQ ID NO: 261056 - DNA, 617 bp, Homo sapiens
  misc_feature: GYAE6OF02G845W.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggagtgggatggatcgaacgcgtggcaatggtaaacaacgaaaaaaattcaacaagaaacgttaccgaaggggacaagagtacaacctttaccgaaggggtaccacatccgacgagtagttacttatatggagtctgagcagcctagagataccggaagacgacggtactagttaattatttttgtagtccgtaccgttcgttagtcgggtagttactaatttacttacggtacttacgtaaacgttttcgaacgttccgtacggggtaccgtaacggggtaccccgttgggttacccgacccggttccgtcccgtaccg

SEQ ID NO: 261057 - DNA, 547 bp, Homo sapiens
  misc_feature: GYAE6OF02I3OCL.1.5.A05.1.454.CMB.1.raw
  modified_base (455)..(455): a, c, t, g, unknown or other
  misc_feature (455)..(455): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaagtggtaacaacaaaaaattcaacgagaaagttccgagggacagagtactaccgttaccaggacacatccgcgagattactatatggagctgagcagcctgagtactacgaagacgacgctagtattattttgngtccgactcgtagtggtagtatagttattacgctacgtaatttgaccttcggtggaccgtacggacccgtggtacccgtacgtcctcctacg

SEQ ID NO: 261058 - DNA, 785 bp, Homo sapiens
  misc_feature: GYAE6OF02GXJ69.1.5.A05.1.454.CMB.1.raw
tcagacgagtgcgtcacgaccggtgctcgattttagatagatagactagggggtacccgaacaaccacaaatacccctcctctacgaacgcccccaaagaagcccacgaaacgcccccaacccaatcggacctggaccctcggaaggagtccttcgtttttcggtgggcgtacgcctaggtccgacgaggtgcccaacgtcccaaggtccgaggccttgtcgcgtacgtcgttggggctggaaggtgaaggagccgtaggggcctacgagtcggaagggtttccctggcgaagggtccttcgaggactacgacctttcgacgtaggtactcgtctaatacagtttgggtgtcgacctagggcccccggacgaaacgggccttggacggtacggaacgtcgggtagtcgggagtcgaacggcgtaggctaacgtacggtaacaacgaaaaacttccaaacgaaagtaaacgtaccgaaggactaagtaacgtacgaaccgttaaccgaagggtaaccaacaacgttacccggacgaagtaacttacgtaatacgtagaacgtctagacgtcgagtacccaggacgtaagtcccggaaagccgtaacgggctaggtaacttcgttttacgtacgtcgtaaccgttcgtaaggttcggtagttaactacgtttaacttaccgtccgtttaacgtaacttttaccggttaaaccgttcccggtagggtaacccgttacggggttacccttacgggacccgtttaacccggtccgttacccgttacccgg

SEQ ID NO: 261059 - DNA, 607 bp, Homo sapiens
  misc_feature: GYAE6OF02G7TSP.1.5.A05.1.454.CMB.1.raw
  modified_base (470)..(470): a, c, t, g, unknown or other
  misc_feature (470)..(470): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaacggcttgaggtggatgggatggatcgaacgctggcaatggtaaacaacaaaaaattcaacaagaagttccgagggcagagtcaaccgtttaccaagggacacgactccgacgaggattacttaatagtaggagctaggagcagccctgagtacgtaccgaacgacgacggtctggttattntttttaggtcgtacgtacctcgttaggtggtaggtctagttattacgtacttacgtaactttcgaccgttccgtacggggtacccgtacggggtaccccttgggttacccgacccggttccgttacccgtaccccgg

SEQ ID NO: 261060 - DNA, 546 bp, Homo sapiens
  misc_feature: GYAE6OF02GJSMZ.1.5.A05.1.454.CMB.1.raw
  modified_base (410)..(410): a, c, t, g, unknown or other
  misc_feature (410)..(410): n is a, c, g, or t
tcagacgagtgcgtcacgaccggtgctcgatttagatagatagacaggggacccaacaaccacatccctcctcagaagcccccagagcacaacgcccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcatggtaacacaaaaattacacagaagtccaggcagagtcactttaccagggacacatcgcgaggattactatagtgagctgagcgagccgngacgaatcccgaagacgacggcctagtacttagttttttgtagtcgtaccttcgtagtggtaggttcgattattacgtctcgtaatttgtacttccgtggggtccacgggtaccctggttccaccgtctccctccg

SEQ ID NO: 261061 - DNA, 631 bp, Homo sapiens
  misc_feature: GYAE6OF02FZLRY.1.5.A05.1.454.CMB.1.raw
  modified_base (268)..(268): a, c, t, g, unknown or other
  misc_feature (268)..(268): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtncgccaggcccccggacaaaggcttgagtggatgggatggatcaacgctggacaagtggtaacaacaaaaattcaacagaagttccagggcagagtcaccgtttaccgagggacacatccgcgaggattactatatggagctgagcagccgtaggacgtacgtaccggaaagaccgacggtacgttagttaacttttagttttaggtacggtaccgttacccgttcgttaacgggtgggtaacggttcttaagtttaacgttaccgtcgttacttaaagtttccgtaccgttccggttacggggtacccgtaaccggggtaaccccgttcgggtacccgtacccggttaccgttcccgtacccg

SEQ ID NO: 261062 - DNA, 623 bp, Homo sapiens
  misc_feature: GYAE6OF02G9Q9K.1.5.A05.1.454.CMB.1.raw
  modified_base (478)..(478): a, c, t, g, unknown or other
  misc_feature (478)..(478): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggcccccggacaaaggcttgagtggatgggatggatcaacgctggcaagtggtaaacaacaaaaaattcaacgagaaagttccgaaggggtacaaggaagtcaaccttttaaccgaaggggacaacactccgacgaggtattacttatagtggagtctagagcagcctagagactaccgaagacgacgactgtattagtttttgngtacgtaccttcgttagtcgggtaggttactaagtttaacttacgtacttaccgtaagtttgtaaccttccggtacgggggtacccgtaacggggtaaccccgttgggttacccgtaacccggttcccgttacccgttaccccgg

SEQ ID NO: 261063 - DNA, 183 bp, Homo sapiens; identical to SEQ ID NO: 260736
  misc_feature: GYAE6OF02F3SPW.1.5.A05.1.454.CMB.1.raw
  modified_base (179)..(183): a, c, t, g, unknown or other
  misc_feature (179)..(183): n is a, c, g, or t

SEQ ID NO: 261064 - DNA, 763 bp, Homo sapiens
  misc_feature: GYAE6OF02FSEZA.1.5.A05.1.454.CMB.1.raw
tcagacgagtgcgtcacgaccggtgctcgatttagatagatagacaggggacccaacaaccacatccctcctcagaacgcccccagagcacaacgccccaccatggactggacctggaggatccttctttttggtggcagcagccacaggtgcccactcccaggtccagcttgtgcagtctggggctgaggtgaagagcctggggcctcaggtgaaggtttcctgcaaggcttcaggatacaccttcactaggtatgctatacattgggtgcgccacggcccccggacaaaggcttgagtggagtgggatggatcaacgctggcaagtggtaaacaactaaaaaattcaacaagaacgttaccgaggggtacaaggagtactaaccttttaaccgaacgggaacacgactcccgacggaaggtatttaacctttaataagtttacggggaagtaccgttaggacggtaccgtaagggtaccccgtaggtaaggtaaaccgttaccccggaaaacgggtaacccgaaccgggggtaccttttacgggtttaaagttttaacgttttttttacgggttacgggtaccccgttaacccggtttacgtttaacgggttaggggtaacggttaccgttaatttaacgtttaccgtactttacgttaaacgttttacgtacccgtttccggttaccgggggtacccgtaacgggggttaacccccgttcggggttaccctacccgggtttacccttcccgttaaccccg

SEQ ID NO: 261065 - DNA, 593 bp, Homo sapiens
  misc_feature: GYAE6OF02GXX1V.1.5.A05.1.454.CMB.1.raw
  modified_base (457)..(457): a, c, t, g, unknown or other
  misc_feature (457)..(457): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagcaacaggtgcccactcccaggtccagcttgtgcagtctggggctgaggtgaagagcctggggcctcagtgaaggtttcctgcaaggcttcaggatacaccttcactaggtatgctatacattgggtgcgccaggccccccggacaaaggcttgagtggatgggatggatcaacggctggcaatggtaacaacaaaaattcaacagaagttccagggcagagtcacctttaccgagggacacatccgcgaggatttacttatatggagcgtgagcagcctgacgatccggaagaccacggctaggtattagttttgngtcgtacctcttaaggtggtacggtctaagtttacttacgtcttacgtaaattttccggacttcccggttacggggtaccctaacggggtaaccccgttcgggttacccgtacccggttccgtacccgttacccgg

SEQ ID NO: 261066 - DNA, 570 bp, Homo sapiens
  misc_feature: GYAE6OF02JEKSR.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcgaacgctggcaagtggtaaacaacaaaaaattcaacgagaagttccgaagggcagagtcaccttacgaggacacatccgcgagattacttatatggagctagagtcagcctagagataccgaagacacggctgtattatttgtcgtcgtacctcgtagtggtagtctagttattacgctacgtaagttttcgaacgttccgttacggggaccgtaaccgggtacccgttgggtaccctaccggttccgtacccttaccgg

SEQ ID NO: 261067 - DNA, 653 bp, Homo sapiens
  misc_feature: GYAE6OF02I9J3U.1.5.A05.1.454.CMB.1.raw
  modified_base (288)..(288): a, c, t, g, unknown or other
  misc_feature (288)..(288): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagccgtggggcctcgagtgaaggtttcctgcaaggtcttcgaggatacaccttcactaggtatgctatacattgggtgcgccaggcccccgganaaaggcttgagtggatgggatggatcgaacgctggcaagtggtaaacaacgtaaaaaattcaacaagaaagttacccgagggacagagtactaacctttaaccgagggaccaacactccgacggaagtaactttacttaagtagttacggagtctaggaagtcaagtcccgtagaacgtactaaccggaagaccgacgggcctaggttacttagtttttagtcgtacgttacccgtacgttaggttcgggtagttactaagtttagttcgtactttacgtaacgtttcgaccgttccggtcggggtacccgtaaccgggtaaccccgttggttacccgacccggtttacccgcccgttaacccgg

SEQ ID NO: 261068 - DNA, 544 bp, Homo sapiens
  misc_feature: GYAE6OF02F32KE.1.5.A05.1.454.CMB.1.raw
  modified_base (401)..(401): a, c, t, g, unknown or other
  misc_feature (401)..(401): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
  modified_base (446)..(446): a, c, t, g, unknown or other
  misc_feature (446)..(446): n is a, c, g, or t
  modified_base (456)..(456): a, c, t, g, unknown or other
  misc_feature (456)..(456): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcaacagaagttcagggcagagtcacctttacagggacacatccgcgagattactatatgagntgagcagcctgaganccgaanacgacgctgtacttagtttttagngtcgtacctntagtggaggtctattagttacgcttacgtaatttcgacgttcccgtgggaccgtacgggacccttggtcctaccggttcctcctaccg

SEQ ID NO: 261069 - DNA, 553 bp, Homo sapiens
  misc_feature: GYAE6OF02GNKQ6.1.5.A05.1.454.CMB.1.raw
  modified_base (332)..(332): a, c, t, g, unknown or other
  misc_feature (332)..(332): n is a, c, g, or t
  modified_base (405)..(405): a, c, t, g, unknown or other
  misc_feature (405)..(405): n is a, c, g, or t
  modified_base (453)..(453): a, c, t, g, unknown or other
  misc_feature (453)..(453): n is a, c, g, or t
  modified_base (463)..(463): a, c, t, g, unknown or other
  misc_feature (463)..(463): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacaanaaaaaattcaacagaagttccagggcagagtcacctttacagggacacagtcgcgaggattacttatatgganctgagcagcctgagatccgaaagacgacggctagttattagtttttgngtcgaccttnttagtgggacggttcattattacgcttagtaatttgactccgtacggggcccgtaaggtacccgtggtacctaccggttcctcctacccg

SEQ ID NO: 261070 - DNA, 596 bp, Homo sapiens
  misc_feature: GYAE6OF02IQU61.1.5.A05.1.454.CMB.1.raw
  modified_base (234)..(234): a, c, t, g, unknown or other
  misc_feature (234)..(234): n is a, c, g, or t
  modified_base (299)..(299): a, c, t, g, unknown or other
  misc_feature (299)..(299): n is a, c, g, or t
  modified_base (451)..(451): a, c, t, g, unknown or other
  misc_feature (451)..(451): n is a, c, g, or t
  modified_base (485)..(485): a, c, t, g, unknown or other
  misc_feature (485)..(485): n is a, c, g, or t
  modified_base (501)..(501): a, c, t, g, unknown or other
  misc_feature (501)..(501): n is a, c, g, or t
  modified_base (532)..(532): a, c, t, g, unknown or other
  misc_feature (532)..(532): n is a, c, g, or t
tcagacgagtgcgtcacgaccggtgctcgatttagatagatagacagggggtacccgaacaaccacatccctcctcagaagcccccagagcacaacgtccccacctatggactggacctggaggatcctcttttggtggcagcagccacaggtgcccactccctaggtccagcttgtagcagtcgtggggctggtaggtgaagaagcctggggcctcgagtggaacggtttccngcgaaggtcttcgaggatacaccttcactaggtatgctatacattggtgcgcacggcccccgganaaacggtcttgacgtggatgggagtgggatcgaacgcgtggcaagtggtaaacaaccgtaaaaattcaacgagtaacgttaccgaggggacagagtactacctttaccgaacgggaccacgacgtcccgcgtacggatttactatactgganctgagacagcctagacgactaccgaagacacgtntagttaattattttgngacgtactcgtagtggagtctattactacgnttacaagtttcgaccgtcgtacgggtaccgacgggtaacctggtccaccggttcctccctaccg

SEQ ID NO: 261071 - DNA, 276 bp, Homo sapiens
  misc_feature: GYAE6OF02IBTMH.1.5.A05.1.454.CMB.1.raw
  modified_base (174)..(174): a, c, t, g, unknown or other
  misc_feature (174)..(174): n is a, c, g, or t
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
  modified_base (258)..(276): a, c, t, g, unknown or other
  misc_feature (258)..(276): n is a, c, g, or t
tcagacgagtgcgtcacgaccggtgctcgatttagatagatagacagggcagttccagatttcaactgctcatcagcagcctgcagtctgaagattttgctagtttattactgtcagcagtataataactggcctccgacgttcggccaagggaccaaggtgaatcaaagaacngtggctagcaacatctagtcttacatcttccgctatctcgatccgtatgctctggacgcggctggaccaagggccgntanaggnnnnnnnnnnnnnnnnnnn

SEQ ID NO: 261072 - DNA, 773 bp, Homo sapiens
  misc_feature: GYAE6OF02H9CP1.1.5.A05.1.454.CMB.1.raw
  modified_base (219)..(219): a, c, t, g, unknown or other
  misc_feature (219)..(219): n is a, c, g, or t
  modified_base (282)..(282): a, c, t, g, unknown or other
  misc_feature (282)..(282): n is a, c, g, or t
  modified_base (290)..(290): a, c, t, g, unknown or other
  misc_feature (290)..(290): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgagtgaagagcctgggcctcagtgaaggtttccngcaaggcttcaggatacaccttcaactaggtatgctatacattggtgcgccacggcccccganaaggctgngtggatgggatgggatcgaacgctggactaagtaggaacaactaaaaaattcaacaacggaacgtttcccgaagggtcaaggtacgtccgtaaaccgttttaccgaacgggtaaccaaccgtactacccggtacgggtaacggttaacgttttaactttaactaaacggttcgggtaacggtaccgttacggaaacggtaccgtaaacgggtccccgttaagggaaccgttaacggttaacccggaaaacgggtaacccgtaaccggggtacctttaaggggtttacttttaaacggtttttttcgggacgtacccggttaacccgttacgttaaccggttagggtaacggttcttaacgtttacttacccggttacttaaccgttaagttttacggtaacccgttaccggttaccggggtacccgtaaccggggttaacccccgtcggtttacccgtaacccggttccttacccggtacccg

SEQ ID NO: 261073 - DNA, 580 bp, Homo sapiens
  misc_feature: GYAE6OF02HNZE3.1.5.A05.1.454.CMB.1.raw
  modified_base (333)..(333): a, c, t, g, unknown or other
  misc_feature (333)..(333): n is a, c, g, or t
  modified_base (491)..(491): a, c, t, g, unknown or other
  misc_feature (491)..(491): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacatttgggtgcgccacggcccccggacaaaggcttgagtggagtgggatgggatcaacgctggcaatggtaanaacaaaaaattcaacagaagtcagggcagagtcacctttaccgagggacacatccgacgagatttactagtactaggagctagagacagcctagacgactccgaaacgacgacggctagttattagtttttgcgtccgtaccttcgtagtggacgttnatttagtcgtacttacgtaagtttcgaccgttccgtacgggacccgtacggggtaccccttgggtaccctaccggtccttcccgtaccg

SEQ ID NO: 261074 - DNA, 651 bp, Homo sapiens
  misc_feature: GYAE6OF02F6D8L.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgccccactcccaggtccagcttgtgcagtctggggctgaggtgaagagcctggggcctcagtgaaggtttcctgcaaggcttcaggatacaccttcacgtaggtatgctatacattggtgcgccacggcccccggacgaaaggcttgacggtggagtgggatgggatcgaacgctggcaagtggtaacaacaaaaagttcacaagaagtacgaggcagagtcacctttacgagggacacactccgacgaaggtattaacgtttataacgtgggaacgtcgttaggaggacctacggaccttaggacgtaacgtacccgaaagaccgaacggtcgttacgttaagtttatttttacggtcgtacgtaaccgttcgttaagggtcggtaggttcctaagttttacgttaccggtacttacggttaaatttcggtaaccttccggtacgggtacccggtacgggtaacccgttcggtacccgtaccgttaccgttcccgttaccg

SEQ ID NO: 261075 - DNA, 795 bp, Homo sapiens
  misc_feature: GYAE6OF02J0TA6.1.5.A05.1.454.CMB.1.raw
  modified_base (786)..(786): a, c, t, g, unknown or other
  misc_feature (786)..(786): n is a, c, g, or t
tcagacgagtgcgtcacgaccggtgctcgatttagatagatagacaggggacccaacaaccacatccctcctcagaagcccccagagcacaacgccccaccatggactggacctggatgatcctcttttggtggcagcagccacaggtgcccactcccaggtccagcttgtgcagtctggggctgaggtgaagaagcctggggcctcagtgaaggttcctgcaaggcttcaggatacacctttcactaggtatgctatactattgggtgcgcctaggcccccggacaaacggcttacgagtgggatgggacttgggactcgaacgtcgttagggccgaagttacgggtaaactaacggtaaaaaactttccgaaacgtaacggtaaacggtttacccgaacgggggtacctaagggaacggtttaccctaaaccggttttaacccgtaacgggggttaacccaaccgtaacgttacccgggaaccggtagggtaaccgttttaacgtttaacgttaaacgttcgggggtaaacgtccgttaacggtaacggtacggtaacgtacccgtaggtaaccggtaacgttacccgggaaacgggtacgtaaccgggtaccgtttagggttaaacgttttaggttttttaacgggtcgtaacccggttaacccgttaaccggttaggttacgggtaacgttcgtaacgtttacgtaccggtcttaaccgttaagtttctacgttaccggtacgggtacccgacggtacccgttagggtcccgttacccggtnttacccccg

SEQ ID NO: 261076 - DNA, 683 bp, Homo sapiens
  misc_feature: GYAE6OF02JUAV0.1.5.A05.1.454.CMB.1.raw
tcagacgagtgcgtcacgaccggtgctcgatttagatagatagacaggggacccaacaaccacatccctcctcagaagccccagagcacaacgccccaccatggactggacctggaggatcctcttttggtggcagcagccacaggtgcccactccccaggtccagcttgtgcagtctgggctgaggtgaagagctggggcctgagtgaggtttcctgcaaggcttcaggtatacaccttcacgtaggtatgctatactagttgggtgcgtccacggcccccggaacaaacggtcttggaagtgggaagtggggacttgggataccgaacggtccgtggacaagtggtaaactaacgtaaaaaagttcaacgaagaacgttaccgaagggacagacggtactaaccgtttaccgaaggtacaacacgtcccgacgtaacgggtaattaccgttaagttgtagaggtcttaggagtacgagacccgttagtaacggtaactaccggaaagtacccgacgggtaccttaggttaacgtttagtttttacggcgttaaccggaccgtttacgtaggtcgggtaacgttcgtaacgtttacgtacgtcgttacgttaacgtttacgtccttaaccggtcgggtaccgacggttaaccgttcggtacccgtacgtcccctgttaaccg

SEQ ID NO: 261077 - DNA, 547 bp, Homo sapiens
  misc_feature: GYAE6OF02GCIPD.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccccggacaaaggcttgagtggatgggatggatcaacgctggcaatggtaacaacaaaaaattcaacagaagttccgaggcagagtcactttacagggacacactccgcgagattacttatatggagtctagagcagcctgagatccgaagacgacggctgtattgttttgtgtcgtacctcgttagtggtaggtctagttactacgtctacgtaatttgaccttccgtcgggccgacgggtacccgtggtcctaccgttctcctaccg

SEQ ID NO: 261078 - DNA, 594 bp, Homo sapiens
  misc_feature: GYAE6OF02F8C8V.1.5.A05.1.454.CMB.1.raw
  modified_base (463)..(463): a, c, t, g, unknown or other
  misc_feature (463)..(463): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcgaggatacaccttcactaggtatgctatacattgggtgcgccaggcccccggacaaaggcttgagtggatgggatggatcaacgctggcaagtggtaacaacgtaaaaaattcaacgaagaacgttaccgaggggacaggtagtactaacctttaccgaagggaccaactactccggcgaaggatttacttaatatggagtctagagcagcctgagactccgaagacacggntgtaattcgttttgcgcgtacctgtagtggtaagtctattacgttacgtactactaatttcgaccgttccggttacgggcccgtacgggtacccggttacggtaccgtacccggttacctcccgttacccg

SEQ ID NO: 261079 - DNA, 647 bp, Homo sapiens
  misc_feature: GYAE6OF02G2BQQ.1.5.A05.1.454.CMB.1.raw
  modified_base (403)..(403): a, c, t, g, unknown or other
  misc_feature (403)..(403): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcgaggataccaccttcacgttaggtatgctatacagttggtgcgccgaggcccccggacaaaggcttggagtggatgggatggatcaacgcgtggcaagtacggtaacaacgaaaaaattccaacagtaacgttccgaaggcaggatcgtaccttacgaggacacgatccgngaggacttacgttatagtaggatacgtgtagcgagtcctagaacgtagtaccgaagaaccgacgtctacggttaattacgtttttagtacgtacgtaaccgttcgttaggttacgggtacggttaacttaagtttaccttacgggtacttacgtaacttttacggtacgttcccggtacgggggtacccgtaacggggttaacccgttaccgggtacccgtacccgttccgtacccgttacccg

SEQ ID NO: 261080 - DNA, 654 bp, Homo sapiens
  misc_feature: GYAE6OF02I1KQ5.1.5.A05.1.454.CMB.1.raw
  modified_base (553)..(553): a, c, t, g, unknown or other
  misc_feature (553)..(553): n is a, c, g, or t
tcagacgagtgcgtcacgaccggtgctcgatttagatagatagacgaggggacccaacaaccacatccctcctcagaagccccagagcacaacgccccaccatggactggacctggaggatcctcttttggtggcagcagccacaggtgcccactcccaggtccagcttgtgcagtctggggctgaggtgaagagcctggggcctcgagtgaaggtttcctgcaaggtcttcaggatacaccttcactaggtactgctatacattggtgcgccacggcccccgagaaacggcttagagtggatggggatggatcgaacgtcgtaggcaagtcggtaaacaacgtaaaaaattaccaacgaagtaaacgttacccgaaggggtacctaaggaacgtacgtaacccgtttaacggaaacggggtaaccaaccgtaacgttcccggacggtaagggtaacttttaaccgtttaataagttacgggagtacgttaggaacgtcgaacgccgtaggaacgtactaccggaagaccgacgggctagtattagttttagngcgtacctgttagtggtagtctagttgtacgtacttacgtatttcgacgttccgtacgggtaccgtacgggtacctcggtaccgtaccgttctcccgtacc

SEQ ID NO: 261081 - DNA, 184 bp, Homo sapiens
  misc_feature: GYAE6OF02IWTSI.1.5.A05.1.454.CMB.1.raw
  modified_base (180)..(184): a, c, t, g, unknown or other
  misc_feature (180)..(184): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttcctcgtactgcgctgagcgggctggcaaggcgcatagnnnnn

SEQ ID NO: 261082 - DNA, 184 bp, Homo sapiens; identical to SEQ ID NO: 260991
  misc_feature: GYAE6OF02INZTF.1.5.A05.1.454.CMB.1.raw
  modified_base (180)..(184): a, c, t, g, unknown or other
  misc_feature (180)..(184): n is a, c, g, or t

SEQ ID NO: 261083 - DNA, 603 bp, Homo sapiens
  misc_feature: GYAE6OF02G81J0.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccacggcccccggacaaaggcttgagtggatgggatggatcaacggctggcaagtggtaacaacgaaaaaattcaacagaacgttcgaaggcagagtcacctttacgaggacacatcgcgaggattactatatggagctgagcagctagagactccggaagaccgacggctgttattagtttttagtcggtacgtaccttagttaggttcggtaaggttacagttttaacttacgtccttacgtaaattttcggtaaccttcccggttacggggacccgtaacggggtaccccgttagggtacccctacccggttccgttacccgttacccg

SEQ ID NO: 261084 - DNA, 801 bp, Homo sapiens
  misc_feature: GYAE6OF02H69V0.1.5.A05.1.454.CMB.1.raw
  modified_base (207)..(207): a, c, t, g, unknown or other
  misc_feature (207)..(207): n is a, c, g, or t
  modified_base (281)..(281): a, c, t, g, unknown or other
  misc_feature (281)..(281): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctgggcctnagtgaaggtttcctgcaaggcttcaggatacaccttcactagtatgactatacattggtgcgcgaggcccgganaaaggcttgagtggagtgggataggatcaacggtcgtaggacgtaagtaggtaaacaaaacgtaaaaaacttcgaaacgtaagaacgttaccgaagggcgaagtacgtactaaccgtttaaccgacgggaacctacgtacgtaccgacgtaacgggtaactttaacgtttaagtaagttacgggtaacgtctaacgggtacgtaccgtaacggtaccgtaggtaacggtaaccgttaacccggaaaaggtaaccggtaacgggtactttaacggtttaaacgtttttaacggtttttttaacgggcgttaacccggttaacccgttaaccgggtttacggttaacggggttaaacgttaccgttaaattttacccgtttaaccggtaaccttttaaccgtttaaacggttttcggtaacccgtttaccccgggtttaacgggggaaccccgtttaacccgggggtaacccgttccggggtttaacccctacccggtttccccttacccggttaaccccgg

SEQ ID NO: 261085 - DNA, 585 bp, Homo sapiens
  misc_feature: GYAE6OF02HSR9I.1.5.A05.1.454.CMB.1.raw
  modified_base (207)..(207): a, c, t, g, unknown or other
  misc_feature (207)..(207): n is a, c, g, or t
  modified_base (405)..(405): a, c, t, g, unknown or other
  misc_feature (405)..(405): n is a, c, g, or t
  modified_base (457)..(457): a, c, t, g, unknown or other
  misc_feature (457)..(457): n is a, c, g, or t
  modified_base (474)..(474): a, c, t, g, unknown or other
  misc_feature (474)..(474): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctnagtgaaggtttcctgcaaggcttcaggatacaccttcactaggtatgctatacattgggtgcgccacggcccccggacaaaagggcctttaggacgtgggactggggagttggatcgaacgctggcaagtggtaaacgaacaaaaaattcaacaagaagttaccgagggacagagtcacctttacagggacacatcgngaggattactatatggagcgtgagcagcctgagagtaccggaagacgacgtntagttattatttttagngtcgaccttgtaacgtggtaggtatagtttattacgtacttacgtaatttacgacgttccgtacggggtaccaacggggtaccctggttaccgtacccgtcgtcctacccg

SEQ ID NO: 261086 - DNA, 672 bp, Homo sapiens
  misc_feature: GYAE6OF02GFDFV.1.5.A05.1.454.CMB.1.raw
  modified_base (390)..(390): a, c, t, g, unknown or other
  misc_feature (390)..(390): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgagagcctggggcctcagtgaaggtttcctgcaaggcttcaggatacaccttcactaggtatgctatacattgggtgtcgccacggcccccggacaaaggcttgagtggagtgggatggatcgaacgctggcaagtggtaaacaactaaaaattcgaacagaacgttccaagggcagtagtcaaccgtttacgacggganacgatccgacgaggaactttacttaacgtagtagggagtcgtagagacacggcctgaggtaacgtaccggaaaggaccgacggtcctaggttaactttagttttttaggttacggccggttaacccttacgttagggttacggtaggttaccgtaattttacgtttaccgacgtttaccgttaaagttttccgtaacccgttcccggttacgggggtaccccgaacgggggttaaccccgttaggggttacccctccggttttacccggtccctttacccgg

SEQ ID NO: 261087 - DNA, 609 bp, Homo sapiens
  misc_feature: GYAE6OF02I3YO6.1.5.A05.1.454.CMB.1.raw
  modified_base (207)..(207): a, c, t, g, unknown or other
  misc_feature (207)..(207): n is a, c, g, or t
  modified_base (221)..(221): a, c, t, g, unknown or other
  misc_feature (221)..(221): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctgggcctnagtgaaggtttccngcaaggcttcaggatacaccttcactaggtatgctatacattgggtgcgccgaggcccccggacaaaggcttgacgttggagtgggatgggatcgaacggctaggcaagtggtaacactaaaaaattcaacaagaagttaccgagggacagagtacactttaccagggacacatccgcgaggtacttacttatatggagctagagcagcctggagtacgtccgaaagcacggctagttattagttttgtgtacgtacttcgtagttcggaggttctagtttacgttacgtacttacgtaacgttttcgaccttaccggttcggggtaaccctaacggggtaaccccttagggttccccgaacccggttccgttaccccgttaacccgg

SEQ ID NO: 261088 - DNA, 674 bp, Homo sapiens
  misc_feature: GYAE6OF02IGMP4.1.5.A05.1.454.CMB.1.raw
  modified_base (273)..(273): a, c, t, g, unknown or other
  misc_feature (273)..(273): n is a, c, g, or t
  modified_base (291)..(291): a, c, t, g, unknown or other
  misc_feature (291)..(291): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtcgcccactcccaggtccagcttgtgcagtctggggctgaggtgaagagccgtggggcctcagtgaaggtttcctgcaagtcttcaggactacaccttcactaggtatgctatactagttgggtncgccacggcccccggaanaaggcttgagtggatgggatggatcacgtcgtggcaagtcggtaaacaaactaaaaattcaacgaagtaacgttccgaaggggtacaaggacgtcctaaccgtttaaccgagggaaccacacgtcccgacgtaaggtatttaaccttagtaacgtaggagtctagacgtcacggtcctaggaagcgtaaccggaacggtaccaacgggtctaggtttaactttaagtttttggtacgtaccgtaccgttcgtaagggttggaacggttctaagtttacttaccgtccttaacgtaatttccggtaccgttccggttacggggacccgtaaccggggttacccggttccgggtaccgttaccccgttcccggttccctaaccgg

SEQ ID NO: 261089 - DNA, 270 bp, Homo sapiens
  misc_feature: GYAE6OF02F1UFB.1.5.A05.1.454.CMB.1.raw
  modified_base (259)..(270): a, c, t, g, unknown or other
  misc_feature (259)..(270): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgccatctgagagtgcgtctcgtggaggcgggctggacaagggccgcagtaggnnnnnnnnnnnn

SEQ ID NO: 261090 - DNA, 182 bp, Homo sapiens; identical to SEQ ID NO: 260846
  misc_feature: GYAE6OF02GW3ZI.1.5.A05.1.454.CMB.1.raw
  modified_base (180)..(182): a, c, t, g, unknown or other
  misc_feature (180)..(182): n is a, c, g, or t

SEQ ID NO: 261091 - DNA, 769 bp, Homo sapiens
  misc_feature: GYAE6OF02F14SU.1.5.A05.1.454.CMB.1.raw
  modified_base (287)..(287): a, c, t, g, unknown or other
  misc_feature (287)..(287): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttcctgcaaggtcttcgaggatactaccttcactaggtatgctatacattggtgcgccacggcccccggaanaaaggtcgttggagtggagtggggtatggtatcgaacggcgtaggcgtaagtaggtaaaccaaacgtaaaaaacttccaacgaacggtaacgttaccgaaggggtacaagacggttaccctaccgttttaaccgaagggaacctacgacgtccggacggtaaggtaactttaacgttaagttagtacggtaggtcgttagacgactacggaccgttaggaacgtaacgtaccggtaaacgaacccgtaccgggtactttacgggttaagttttacggtttttacgggttacggtacggttaaccctttacggttacggttacggggtaaccgggtttacttaacgtttaaggtttccgtaaccgttaccgttaaacggttttaccggtacccggttcccggtaccgggggtacccgttaaccgggggttaaccccttaaccggggtccccgttaacccgggttacccttccccgtaacccgg

SEQ ID NO: 261092 - DNA, 533 bp, Homo sapiens
  misc_feature: GYAE6OF02FG7W4.1.5.A05.1.454.CMB.1.raw
  modified_base (406)..(406): a, c, t, g, unknown or other
  misc_feature (406)..(406): n is a, c, g, or t
  modified_base (416)..(416): a, c, t, g, unknown or other
  misc_feature (416)..(416): n is a, c, g, or t
  modified_base (472)..(472): a, c, t, g, unknown or other
  misc_feature (472)..(472): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccccggacaaaggcttggagtgggatgggatggatcaacgctggcaatggtaacacaaaaaattcacagaagttccagggcagagtcacctttacagggacacatccgcgagattacttatatggagntgagcagccngagactccgaagaccaggctagtattagttttgtgtcgtacctcttagtgacggtntattattcgctacgtaattgactcgtgggccacgggtaccctggtccaccgtctcctaccg

SEQ ID NO: 261093 - DNA, 562 bp, Homo sapiens
  misc_feature: GYAE6OF02HPMKV.1.5.A05.1.454.CMB.1.raw
  modified_base (284)..(284): a, c, t, g, unknown or other
  misc_feature (284)..(284): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggcccccgganaaaggcttgagtggatgggatgggatcgaacgctggcaagtggtaaacaactaaaaaattcaacagaagttcgaagggcagagtcactttacgaggacacactccgacgaggactttacgtatagtggagtctagagacagctgagatccgaagacgacgtctagtattagttttgtgccgtactgtagtggtagtctaagttattacgctacgtaagtttgacgttccgtcgggaccgtacgggtacccgtggtaccgtaccgttctacccgtaccg

SEQ ID NO: 261094 - DNA, 536 bp, Homo sapiens
  misc_feature: GYAE6OF02FN6JV.1.5.A05.1.454.CMB.1.raw
  modified_base (447)..(447): a, c, t, g, unknown or other
  misc_feature (447)..(447): n is a, c, g, or t
  modified_base (467)..(467): a, c, t, g, unknown or other
  misc_feature (467)..(467): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacaacaaaaattcaacagaagttccagggacagagtcactttaccagggacacatccgcgaggattacttatatggagctgagcagcctgacgatccgaagacacggctgtattattttgngtcgtactctagtcggagtntagttattacgctactaattcgactccgtgggccgtagggtaccctggtacctaccgtcctccgtaccg

SEQ ID NO: 261095 - DNA, 637 bp, Homo sapiens
  misc_feature: GYAE6OF02I0KF8.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattggtgtcgccaggcccccggacaaaggctgacgtggagtgggatggatacaacgctgggcaatggtaaacacaaaaaagtttcaacagaagttaccgaagggtcaaggactaccgtaccttttacccaaggggtaacaacacttacccgacggtaggaatttacctttaataagtagggagtacgtgtaagccaagcctaggagacgttccgaagtaccacgctacgtattattttgtgacgtacctcgtacgtgggtagttacgtactttaacgttacgtacttaacgtgttttaacgtaccttaccggttacggggtacccgaacgggtaccccggttaggttacccgtacccggttccctacccgttacccg

SEQ ID NO: 261096 - DNA, 179 bp, Homo sapiens
  misc_feature: GYAE6OF02IL4ZE.1.5.A05.1.454.CMB.1.raw
  modified_base (179)..(179): a, c, t, g, unknown or other
  misc_feature (179)..(179): n is a, c, g, or t
tcagacgagtgcgtcacgaccggtgctcgatttagatagatagacatggcaccaagggcccatcggtcttccccctggcaccctcctccaagagcacctctggggcacagcggccctgggctgcctggtcaaggactacttccagtactctatctgagcgggctggcaaggcgcatagn

SEQ ID NO: 261097 - DNA, 757 bp, Homo sapiens
  misc_feature: GYAE6OF02IDTJ0.1.5.A05.1.454.CMB.1.raw
  modified_base (291)..(291): a, c, t, g, unknown or other
  misc_feature (291)..(291): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgccactcccaggtccagctgtgcagtctggggctgaggtgaagagcctggggcctcagtgaaggtttcctgcaaggcttcaggactacaccttacactaggtatgtctatactagttgggtgcgccgacggcccccggaanaaacggcttggagtggtagtgggatggactcgaacgcgtggactaagtacggtaaacaaactaaaaaacttcgaactaagtaacgttaccgagggtacaaggtacgtaccgtaaccgtttaaccgaagggtaacaacgtcgtaccgacggtaagggtaactttaacttaagttaagtagggtaggaccgttaggaacgacgtacggccgttacggaacggtaacgttaacccgggaaacggtaaccgtaaccgggtacctttacgggtttaaacttttacggtttttttacggtacggtacccgttaccgttacgttaacggttaggggtaccggtttaacgttaatttaacgtttaccggactttaacgttaacgtttttaaccggaccgtttacccggtgggggtaacccgtacgggttaaccccgttaccgggttccggtacccgttcccttacccgtacccg

SEQ ID NO: 261098 - DNA, 869 bp, Homo sapiens
  misc_feature: GYAE6OF02HYPRI.1.5.A05.1.454.CMB.1.raw
  modified_base (134)..(134): a, c, t, g, unknown or other
  misc_feature (134)..(134): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggnggcagcagccacaggtcgcccactcccaggtccagtcttgtgctagtcgtggggctgaggtagaagagccgtggggcctgagtggaacggtttcctgcgaaggtcttagaggactaccaccttacactaggtatgactatactagtaggtgcgccgacggccccggacgaaaggcttgagtggagtgggagtggatacgaacgcgtaggacaacgtacggtaaacaaactaaaaaattacgaacgtaacggtaaacggttaccgtaacggggacgaaggtaacgtaccgtaacccgttttaacccggaacggggtaaccaaccgtaacgtacccggtacggtaacgggttaactttaaccgtttaacgttagttacgggtacggtaccgtagggaacgaccgtaacggcccgttaagggaacgtaacgttaacccggaaacggtaaccggaaccgggtacgtttacggtttaacgttttaagtttttttacggtacggtacccgttaaccgtttaccggttaagggtttacgggtaacggggtttaccttaagttttaaaccgttttacccggttaccgtttaacgtttaaaacggttttttaccgggtaaccgtttaccccgggttaacccgggggggttaacccgttaaccccggggggtaaacccccggtttaccgggtttaacccccgggttaaccccggtttaccccgtttacccccggttaaccccggg

SEQ ID NO: 261099 - DNA, 567 bp, Homo sapiens
  misc_feature: GYAE6OF02I07VJ.1.5.A05.1.454.CMB.1.raw
  modified_base (287)..(287): a, c, t, g, unknown or other
  misc_feature (287)..(287): n is a, c, g, or t
  modified_base (335)..(335): a, c, t, g, unknown or other
  misc_feature (335)..(335): n is a, c, g, or t
  modified_base (406)..(406): a, c, t, g, unknown or other
  misc_feature (406)..(406): n is a, c, g, or t
  modified_base (418)..(418): a, c, t, g, unknown or other
  misc_feature (418)..(418): n is a, c, g, or t
  modified_base (453)..(453): a, c, t, g, unknown or other
  misc_feature (453)..(453): n is a, c, g, or t
  modified_base (463)..(463): a, c, t, g, unknown or other
  misc_feature (463)..(463): n is a, c, g, or t
tcagacgagtgcgtcacgaccggtgctcgatttagatagatagacagggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccacggcccccggaanaaaggcttggagtggatgggatggatcaacgctggcaagtggtaacanaaaaattcacaagaagtccagggcagagtacaccttacaggacacactcgcgagattacttatagtggagntgagacagaccngagactaccgaagacacggctagttattattttgngtcgtacctntagtggtaggtactagtttacttacgcttacgtaaatttcggaccttccggtaggggtacccgtacggggtaacccttgggtaccctacggtccctccctaccg

SEQ ID NO: 261100 - DNA, 257 bp, Homo sapiens
  misc_feature: GYAE6OF02GDMA5.1.5.A05.1.454.CMB.1.raw
  modified_base (243)..(243): a, c, t, g, unknown or other
  misc_feature (243)..(243): n is a, c, g, or t
  modified_base (249)..(257): a, c, t, g, unknown or other
  misc_feature (249)..(257): n is a, c, g, or t
tcagacgagtgcgtcacgaccggtgctcgatttagatagatagacaggggcagttccagatttcaactgctcatcagcagcctgcagtctgaagattttgcagttttattactgtcagcagtataataactggcctccgacgttcggccaagggaccaaggtggaaatcaaacgactgtggctgcacatctgtcttcatcttcccgcatctgatcgtactgcgctgagcgggctggcaaggcncatagnnnnnnnnn

SEQ ID NO: 261101 - DNA, 608 bp, Homo sapiens
  misc_feature: GYAE6OF02JICU6.1.5.A05.1.454.CMB.1.raw
  modified_base (285)..(285): a, c, t, g, unknown or other
  misc_feature (285)..(285): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccacggcccccgganaaaggcttgagtggatgggatggatcgaacgctggcaaatggtaaacaactaaaaaagttcaacaagaaacgttccgaaggggcaaggagtcctaacctttaaccgaagggacacagtccgacgaggtactttaacttatagtggagcgtagagcagcctgacgataccgaagaccacggctagttattagtttttgtacgtacgtaccgtgtagtgggtagttcgaatttagttacgactacgtaattttcgaaccgttcccggttaggggacccgtacgggtaaccccggtcggttaccgtacccggttcctcccgtaccg

SEQ ID NO: 261102 - DNA, 184 bp, Homo sapiens; identical to SEQ ID NO: 260991
  misc_feature: GYAE6OF02FR3VK.1.5.A05.1.454.CMB.1.raw
  modified_base (180)..(184): a, c, t, g, unknown or other
  misc_feature (180)..(184): n is a, c, g, or t

SEQ ID NO: 261103 - DNA, 662 bp, Homo sapiens
  misc_feature: GYAE6OF02JGWT4.1.5.A05.1.454.CMB.1.raw
  modified_base (542)..(542): a, c, t, g, unknown or other
  misc_feature (542)..(542): n is a, c, g, or t
  modified_base (566)..(566): a, c, t, g, unknown or other
  misc_feature (566)..(566): n is a, c, g, or t
  modified_base (576)..(576): a, c, t, g, unknown or other
  misc_feature (576)..(576): n is a, c, g, or t
  modified_base (590)..(590): a, c, t, g, unknown or other
  misc_feature (590)..(590): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtcgtggggctgaggtgaagaagccgtggggcctcgagtgaggtttcctgcaaggcttcagatacacttcactaggtatgctatacagttgggtcgcgccgacggacccccggagaaacggcgttaggaggtaggagtagggagtggactcgaacggcgtacggactaagttacggtaaacaaactaaaaacgttacaacgtaaggtaacgttaccgaagggacgacggtaacgttaccctaaccgtttaaccgaacgggtaaccaacgacgtaccggaccggtaaggtactttaacgttaagtagtaggagtacgttagacgtcgagtcgtagacgttacgaccgaagacgcgtattcgtagtttntttcgacgtacgtaccgttgtagnggtacggttntagtttactacgtntaacgttacgttgacgttccggtacgggacgtacgggtaccgttcggcccgtaccggttcctaccgttaccg

SEQ ID NO: 261104 - DNA, 746 bp, Homo sapiens
  misc_feature: GYAE6OF02HOK02.1.5.A05.1.454.CMB.1.raw
  modified_base (282)..(282): a, c, t, g, unknown or other
  misc_feature (282)..(282): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgagtttcctgcaaggcttcaggatacacttcactaggtatgctatacattgggtgcgccaggcccccgganaaaggcttgagtggatgggtatggatcaacgctggcaatggtaaacaacaaaaaattcaactaagaaacgttccgaagggacaagagtacctaacctttaacgaacgggaacaacacgtaccggacgaacgggtaactttacgttaaatacgtagggagtcgtaggaacgtaccgagacccgttaggaacgtaaacgtacccgggtaaaagacccgtaacgggtaccgtaaggtttaacgttttaacgttttttttacggaccggttaccgttaaacccgtttacgtttaacgggttaacggggtaacggtttaaccttaaagttttaacgtttacccgggtacttttaaccggttaaagttttccggtaacccgttacccggtagggggttacccccgttaagggggtaaacccccgttcgggtttaacccgtaaccccggttccttacccccgttaacccgg

SEQ ID NO: 261105 - DNA, 697 bp, Homo sapiens
  misc_feature: GYAE6OF02HZQ6J.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcgagtgaaggtttcctgcaaggtcttcgaggataccgtaccttcacgttaggtactgacttaatacagttggtgcgccacggcccccggacaaaggcttggagtggagtgggatggatcgaacgcgtgggacaagtacggtaaacaacgtaaaaaactttcaacgtaagtaaacgttccgaagggcaaggacgtactacctttaaccgaggaacacgactccgacggacggtaactttacgttatagtagggagtcgttggacgcgacgtcctaggagtaacgtaccgaacgaccgacgggtactaggtttaagttagttttttagtcgtaccgtaccgttacgttagggttacgggtacggttaccgtaagtttacgttaccgtacgttacgttaaacttttccggtaccgttaccggtacgggtaacccggtacgggttaacccccggttcggttaccccggttacccgttcccgtttccgtaacccgg

SEQ ID NO: 261106 - DNA, 615 bp, Homo sapiens
  misc_feature: GYAE6OF02F2MZU.1.5.A05.1.454.CMB.1.raw
  modified_base (413)..(413): a, c, t, g, unknown or other
  misc_feature (413)..(413): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgtccaggccccccggacaaaggcttgagtggatggggatggatcaacgctaggcaatggtaacacgaaaaaattcaacagaagttaccagggcagagtcacctttaccgagggtacacactccgcgaggataccttatatggantgagcagctgagataccgaacgacgacggctaggttattagttttagtgtacggaccttcgttaaggttggtacgggttctacgttatttaccggacttaccgttaattttaggtaccgttacccggttagggggtaccccgtacgggggtaacccccgttcgggttacccgaccccggtttccgttaccccgttaccccgg

SEQ ID NO: 261107 - DNA, 183 bp, Homo sapiens
  misc_feature: GYAE6OF02FJETV.1.5.A05.1.454.CMB.1.raw
  modified_base (177)..(183): a, c, t, g, unknown or other
  misc_feature (177)..(183): n is a, c, g, or t
tcagacgagtgcgtcacgaccggtgctcgatttagatagatagacaggcaccaagggcccatcggtcttcccctggcaccctcctccaagagcacctctggggcacagcggccctgggctgcctggtcaaggactacttcctcgtactgcgctgagcgggctggcaaggcgcatagnnnnnnn

SEQ ID NO: 261108 - DNA, 198 bp, Homo sapiens
  misc_feature: GYAE6OF02HSOKD.1.5.A05.1.454.CMB.1.raw
  modified_base (181)..(198): a, c, t, g, unknown or other
  misc_feature (181)..(198): n is a, c, g, or t
tcagacgagtgcgtcacgaccggtgctcgatttagatagatagacagggcaccaagggcccatcgatcttccccctggcaccctcctccaagagcacctccgagagcacagcggcccctgggctgcctggtcaaggactacttcctgtcgagcgtctgagcgggctggcaaggcgcatagnnnnnnnnnnnnnnnnnn

SEQ ID NO: 261109 - DNA, 255 bp, Homo sapiens; identical to SEQ ID NO: 260056
  misc_feature: GYAE6OF02JD2HP.1.5.A05.1.454.CMB.1.raw
  modified_base (250)..(255): a, c, t, g, unknown or other
  misc_feature (250)..(255): n is a, c, g, or t

SEQ ID NO: 261110 - DNA, 678 bp, Homo sapiens
  misc_feature: GYAE6OF02JJQME.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcgagtgaaggtttcctgcaaggcttcgaggataccaccttcactaggtatgctatacattggtgcgccaggccccgacgaagcttgagtaggagtgggatggatcgaacgcgtcggctaagtggtaaacaacgtaaaaatcgaacgaagaacgttaccgaagggacagagtactaacctttacgaaggtaacacgactccgacgacggtattaacttagtatagggtaacgtcgttacggacgagtaacgccgtaggaacgtacgttaccgaaacggacgacggtaccttaggttaacttttagtttttgtacggtaccttaccgttaaccgtttaggttacgggtacgttacgtaagtttacctttacggtaccttacgttaagtttacgtacccgtttcggttacggggtacccgtaccggggttaacccgttacgggtacccgtaaccggtttccctacgttaaccccgg

SEQ ID NO: 261111 - DNA, 758 bp, Homo sapiens
  misc_feature: GYAE6OF02JZLCB.1.5.A05.1.454.CMB.1.raw
  modified_base (174)..(174): a, c, t, g, unknown or other
  misc_feature (174)..(174): n is a, c, g, or t
  modified_base (286)..(286): a, c, t, g, unknown or other
  misc_feature (286)..(286): n is a, c, g, or t
  modified_base (328)..(328): a, c, t, g, unknown or other
  misc_feature (328)..(328): n is a, c, g, or t
tcagacgagtgcgtcacgaccggtgctcgatttagatagatagacaggggacccgaacaaccacatccctcctcagaagccccagagcacaacgccccaccatggactggacctggaggatcctcttttggtggcagcagccacaggtgcccactcccaggtccagcttgtgcngtctgggctgaggtgaagagcctggggcctcgagtgaaggtttcctggcagggtcttcgaggatacaccgttcacgtaggtatgactatacattggtgcgctaggccccganaacggcgttgacgtggacgtgggatggatacgaacgcgtggnaagtaggtaacgaactaaaaattcaacgtaagaagtttccgaagggcgaaggacgtacgtacgtttaaccgacgggtaccactaacgttacccggaggaacgggtaactttaacgtaacgtaacgttacgggtaacggcgttaagacggtaacaacgggtcccttaggaacggtaacttaccgggaaacggttaacccgaacgggaccggttacggttaaacgtttactttttagggtccggtaaccggtttaacccgtttccggttaaagggttcggggtaaacggttcgtaaacgtttacgtttaacccggatttttaccgaaacgtttttacggtacccgttacgttaccggggggtaccctaaccgggggtttaaccccgtacgggttaccgggtaaccccgtttaccggtacccgttaacccggg

SEQ ID NO: 261112 - DNA, 189 bp, Homo sapiens
  misc_feature: GYAE6OF02IHTHF.1.5.A05.1.454.CMB.1.raw
  modified_base (180)..(189): a, c, t, g, unknown or other
  misc_feature (180)..(189): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttcctcgtactgcgctgagcgggctggcaaggcgcatagnnnnnnnnnn

SEQ ID NO: 261113 - DNA, 485 bp, Homo sapiens
  misc_feature: GYAE6OF02J0OUL.1.5.A05.1.454.CMB.1.raw
  modified_base (177)..(177): a, c, t, g, unknown or other
  misc_feature (177)..(177): n is a, c, g, or t
  modified_base (184)..(184): a, c, t, g, unknown or other
  misc_feature (184)..(184): n is a, c, g, or t
  modified_base (187)..(187): a, c, t, g, unknown or other
  misc_feature (187)..(187): n is a, c, g, or t
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (202)..(202): a, c, t, g, unknown or other
  misc_feature (202)..(202): n is a, c, g, or t
  modified_base (206)..(206): a, c, t, g, unknown or other
  misc_feature (206)..(206): n is a, c, g, or t
  modified_base (208)..(208): a, c, t, g, unknown or other
  misc_feature (208)..(208): n is a, c, g, or t
  modified_base (211)..(212): a, c, t, g, unknown or other
  misc_feature (211)..(212): n is a, c, g, or t
  modified_base (215)..(215): a, c, t, g, unknown or other
  misc_feature (215)..(215): n is a, c, g, or t
  modified_base (218)..(218): a, c, t, g, unknown or other
  misc_feature (218)..(218): n is a, c, g, or t
  modified_base (224)..(224): a, c, t, g, unknown or other
  misc_feature (224)..(224): n is a, c, g, or t
  modified_base (257)..(257): a, c, t, g, unknown or other
  misc_feature (257)..(257): n is a, c, g, or t
  modified_base (268)..(268): a, c, t, g, unknown or other
  misc_feature (268)..(268): n is a, c, g, or t
  modified_base (270)..(270): a, c, t, g, unknown or other
  misc_feature (270)..(270): n is a, c, g, or t
  modified_base (272)..(272): a, c, t, g, unknown or other
  misc_feature (272)..(272): n is a, c, g, or t
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
  modified_base (284)..(284): a, c, t, g, unknown or other
  misc_feature (284)..(284): n is a, c, g, or t
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
  modified_base (317)..(317): a, c, t, g, unknown or other
  misc_feature (317)..(317): n is a, c, g, or t
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
  modified_base (343)..(343): a, c, t, g, unknown or other
  misc_feature (343)..(343): n is a, c, g, or t
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
  modified_base (360)..(360): a, c, t, g, unknown or other
  misc_feature (360)..(360): n is a, c, g, or t
  modified_base (364)..(364): a, c, t, g, unknown or other
  misc_feature (364)..(364): n is a, c, g, or t
  modified_base (366)..(366): a, c, t, g, unknown or other
  misc_feature (366)..(366): n is a, c, g, or t
  modified_base (368)..(368): a, c, t, g, unknown or other
  misc_feature (368)..(368): n is a, c, g, or t
  modified_base (384)..(384): a, c, t, g, unknown or other
  misc_feature (384)..(384): n is a, c, g, or t
  modified_base (386)..(386): a, c, t, g, unknown or other
  misc_feature (386)..(386): n is a, c, g, or t
  modified_base (448)..(448): a, c, t, g, unknown or other
  misc_feature (448)..(448): n is a, c, g, or t
tcagacgagtgcgtcacgaccggtgctcgatttagatagatagacagggcaccaagggccatcggtcttcccctggcaccctcctccaagacgcacctctgggggcacagccggccctgggctgcctggtcaacgactacttcctcgtactgcgtctgagcgggactggcaaggccncatacgncgnctcgcagancancgntcgnancgnnctngangcgacngtcgtatcacagtcacgacgtacacgcagcctnacgcgttcaancncncncgcncacganacgtacgacgacacacactacacncnctcacgngtcgtgtgagagngacgatgtcnctncgacgagcncacngtcncacnancnctagtatcgtatactntntctactatatactatacgtacgtacgtacgtacgtactcgtacgtacgtacgtagtactacncgtacgtactacgacgacgtacgtacgagtactatac

SEQ ID NO: 261114 - DNA, 755 bp, Homo sapiens
  misc_feature: GYAE6OF02I4S1P.1.5.A05.1.454.CMB.1.raw
  modified_base (225)..(225): a, c, t, g, unknown or other
  misc_feature (225)..(225): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtcgcccactcccaggtccagcttgtgcagtctgggctgaggtgaagagccgtggggcctcgagtagtaacggtttccngacgaaggcttcgaggactacaccttcgacgtaggtatgcgtatactagttgggtcgccgaccgaccggacccccggaagaaacggtcttaggacggtggagtcgggagtggactaccgaacggtcgtcggactaagtacggttaaacaaactaaaaagttcaacgtaacgtaacgtaccggaaggacaaggtaacgttacccgtaaccgtttaacgacgggtaaccaacaccgtacggacgtaacggtaatttaaccgttaagtacgtaggtaacgtacgttacggaacgtacgtacggtccgtaaggacgttaaccgtaaccggaacggtacccgtacggtacgtttaacgttacgtttttaaggtttcgtaccggtaccgttaccgtacgtttacgggtacgggtacgtacgttaacgtttaacgtaccgttacgttacggttaacgtttaccgaccggttacccgggtacggacccggttaaccggtaccggttccggtacccgtccggttacccgtcgtaccccg

SEQ ID NO: 261115 - DNA, 557 bp, Homo sapiens
  misc_feature: GYAE6OF02GFKNV.1.5.A05.1.454.CMB.1.raw
  modified_base (413)..(413): a, c, t, g, unknown or other
  misc_feature (413)..(413): n is a, c, g, or t
  modified_base (461)..(461): a, c, t, g, unknown or other
  misc_feature (461)..(461): n is a, c, g, or t
  modified_base (482)..(482): a, c, t, g, unknown or other
  misc_feature (482)..(482): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattagggtgcgccaggccccccggacaaaggccttgagtggatggggatggatcaacgctgggcaatgggtaacaactaaaaaattcaacaagaagttccagggacagagtcacctttacaggacacatccgcgaggacttactatatggancgtgagcagcctagagataccgaagacacggctacgtattattttagngtccgtactcgtagtggagtntattattacgcttacgtaatttcgacgttccgtagggccgtacgggacccgtaggtccgaccgtctccctaccgg

SEQ ID NO: 261116 - DNA, 599 bp, Homo sapiens
  misc_feature: GYAE6OF02GSOOH.1.5.A05.1.454.CMB.1.raw
  modified_base (269)..(269): a, c, t, g, unknown or other
  misc_feature (269)..(269): n is a, c, g, or t
  modified_base (406)..(406): a, c, t, g, unknown or other
  misc_feature (406)..(406): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagccgtggggcctcagtgaaggtttcctgcaaggcttcaggatacaccttcactaggtatgctatacattgggtncgccaggcccccggacaaaggcttgagtggatgggatggatcaacgctggcaagtaggtaaacaacaaaaaattcaacagaagttcgaggcagagtcaccttacgaggacacatccgcgagattacttatatggagntgagcagcctgagactaccgaacgacgacgtctgttaatttagttttgcgtcctaccgttcgttacggtaggtacggttactagtttacgttacgcttaccgttaaattttcgtaaccgtttcgtacggggtacccgtaacggggttaaccccgttcgggttacccgtacccggtttccgtacccttacccgg

SEQ ID NO: 261117 - DNA, 406 bp, Homo sapiens
  misc_feature: GYAE6OF02JPRFO.1.5.A05.1.454.CMB.1.raw
  modified_base (119)..(119): a, c, t, g, unknown or other
  misc_feature (119)..(119): n is a, c, g, or t
  modified_base (311)..(311): a, c, t, g, unknown or other
  misc_feature (311)..(311): n is a, c, g, or t
  modified_base (322)..(322): a, c, t, g, unknown or other
  misc_feature (322)..(322): n is a, c, g, or t
  modified_base (327)..(327): a, c, t, g, unknown or other
  misc_feature (327)..(327): n is a, c, g, or t
  modified_base (331)..(331): a, c, t, g, unknown or other
  misc_feature (331)..(331): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
  modified_base (372)..(372): a, c, t, g, unknown or other
  misc_feature (372)..(372): n is a, c, g, or t
  modified_base (375)..(376): a, c, t, g, unknown or other
  misc_feature (375)..(376): n is a, c, g, or t
  modified_base (381)..(382): a, c, t, g, unknown or other
  misc_feature (381)..(382): n is a, c, g, or t
  modified_base (384)..(385): a, c, t, g, unknown or other
  misc_feature (384)..(385): n is a, c, g, or t
  modified_base (387)..(406): a, c, t, g, unknown or other
  misc_feature (387)..(406): n is a, c, g, or t
tcagacgagtgcgtcacgaccggtgctcgatttagatagatagacagggcgagttccagatttcaactgctcatcagcagcctgcagtctgaagattttgcagttttattactgtcagnagtataataactggcctccgacgttcggctaacgggacctaaggtggaaatccgaaaacgtaactggtggacctgccaaccgtatccgttaggttccttccgaatcccgtttccccggaccaattccttgggaacttaccggtacttacgccggccttaggacgtccgggggcttcggggaacaacgggtcncctaggtaacngatgntagntaggcacggtccgnaccgtncgatcaaancgcaaatttggnaanncaagnntnntnnnnnnnnnnnnnnnnnnnn

SEQ ID NO: 261118 - DNA, 672 bp, Homo sapiens
  misc_feature: GYAE6OF02I14PM.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaggtttcctgcaaggcttcaggatacaccttcactaggtatgctatacattgggtgcgccaggccccccggacaaaggcttgagtggagtggggatgggatcgaacgtcgtggaccaaagtcggtaaacaaactaaaaaattccaacgaagtaaacgtttaccaaggggacctaaggacgttcctaaccgttttaaccgaacggggaccacgtacgtacccggacggtaacgggtaatttaacgtttaataagtgggagtctaggacgtacgacggtccctagacggaatccggaaagaccggaagtacccgttaggtactttagtttttggtagtccgtaacgtcgttagttcgggagttactagtttactacgtctacttaactttaggtaccttccggtaggggacccgtaacggggtaacccttacgggtaccctaacccggttcctacccgttacg

SEQ ID NO: 261119 - DNA, 647 bp, Homo sapiens
  misc_feature: GYAE6OF02H2YAL.1.5.A05.1.454.CMB.1.raw
  modified_base (222)..(222): a, c, t, g, unknown or other
  misc_feature (222)..(222): n is a, c, g, or t
  modified_base (289)..(289): a, c, t, g, unknown or other
  misc_feature (289)..(289): n is a, c, g, or t
  modified_base (488)..(488): a, c, t, g, unknown or other
  misc_feature (488)..(488): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcgagtgaaggtttccngcaaggcttcgaggactacaccttcactaggtatgctatacagttgggtgcgccacggcccccgganaacggcttgacgtggagtgggatggatcgaacgcgtggcaagtaggtaacaacaaaaattcaacgtaagaacgttccgaagggcaacggagtacctaacctttaccgaagggacacactccggacgacggtacttacttataacgtgggagtctaggacgcacgtccgtaggaagacgttaccgaacgaccgaccggtnttacggttaatttagtttttacggtgtacccgtaccttcgtaacgttgggtaacggttacgtaatttacgttacgtacgtaccgttaagtttcgaccttccggtacgggtacccgtacgggtaacccgttcggtaccctacccggttcctaccctaccg

SEQ ID NO: 261120 - DNA, 702 bp, Homo sapiens
  misc_feature: GYAE6OF02H8HWD.1.5.A05.1.454.CMB.1.raw
  modified_base (132)..(132): a, c, t, g, unknown or other
  misc_feature (132)..(132): n is a, c, g, or t
  modified_base (192)..(192): a, c, t, g, unknown or other
  misc_feature (192)..(192): n is a, c, g, or t
  modified_base (206)..(206): a, c, t, g, unknown or other
  misc_feature (206)..(206): n is a, c, g, or t
  modified_base (220)..(220): a, c, t, g, unknown or other
  misc_feature (220)..(220): n is a, c, g, or t
  modified_base (245)..(245): a, c, t, g, unknown or other
  misc_feature (245)..(245): n is a, c, g, or t
  modified_base (353)..(353): a, c, t, g, unknown or other
  misc_feature (353)..(353): n is a, c, g, or t
tcagacgagtgcgtcacgaccggtgctcgatttagatagatagacagggacccaacaaccacatccctcctcagaacgcccccagagcacaacgccccaccatggactggacctggagatcctctttttggnggcagcagcctacaggtgcccactccaggtccagcctgtgacagtctggggctgaaggtnagagccgtgggctnaggtgaggtttccngcaaggcttcgaggataccaccttnacgttggtatgacctatacattgggtgtcgccgacggccccggaacgaaacggtcgttagaggttcggagtagggtgtagggatcgaacgctggactagtacggtaanaactaaaattcgaacaacgaagttaccgaacggagacgtacgtacacgtttaacgacggtaacactacgtacgacgagtaactttactaagtagtagtagtacgagacgtacgacgttccagaacgtagtacccggaaataccggaacgtataccggttaattttaacggttttcttaaccgggaccttaaccccggttagtaagggtttaccgggaacggttaacacgggttttaataccgtttacgtacgtttaaagggtttaccgttacgtacccggtttaagggaccccggttaaggtaccccgggttacggttaccggaacccgtttcgtacccgttaacccgg

SEQ ID NO: 261121 - DNA, 600 bp, Homo sapiens
  misc_feature: GYAE6OF02GEHXG.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacacttcactaggtatgctatacattggtgcgccacggccccccggacaaaggcttggagtggagtggggatggatcgaacgctggacaatggtaacaacaaaaattcaacagaagttccgagggcagagtctacttaccgaggacacacgtccgcgagtattacgttatatggagtcgtagagcagcctagagtacgtaccgaagtaccgacggtctaggttacttagtttttgtcgtacgtaccttcgttaagggtggtacggtactaagtttacttacggtctacgttaatttcggtaacctccggttacggggaccgtaacgggtacccttggtacccgacccgtcccgtccgtacccg

SEQ ID NO: 261122 - DNA, 676 bp, Homo sapiens
  misc_feature: GYAE6OF02JYYHD.1.5.A05.1.454.CMB.1.raw
  modified_base (217)..(217): a, c, t, g, unknown or other
  misc_feature (217)..(217): n is a, c, g, or t
  modified_base (285)..(285): a, c, t, g, unknown or other
  misc_feature (285)..(285): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctgggctcagtgaggttccngcaggcttcaggactacgacctttcacgtaggtatgctatacattgggtgtcgccaggccccccgganaaacggcttcggagtggagtgggactggatcaacgcgtggcaagtgggtaacaacaaaaattcaacgagaacgttcgaggcacggagtaccaccgtttaaccgagggtacacacgttcccggacgtagggtacttacgtttaagtagtttacgggaggtaccttagggaacgacgtaacggtacgtcggaaggattacccgggaaacgccgttaacgggtctaaggttatttagtttttcggattcccggactttccggtaaggttcggtacggttacgtatttacgttacgtacgttacgttaacgtttagaccgtttcccggtacgggggtaacctaccggggtaacccgttgggttacccggtaccgtttaccgttccccttaacggg

SEQ ID NO: 261123 - DNA, 573 bp, Homo sapiens
  misc_feature: GYAE6OF02II1S2.1.5.A05.1.454.CMB.1.raw
  modified_base (285)..(285): a, c, t, g, unknown or other
  misc_feature (285)..(285): n is a, c, g, or t
  modified_base (365)..(365): a, c, t, g, unknown or other
  misc_feature (365)..(365): n is a, c, g, or t
  modified_base (463)..(463): a, c, t, g, unknown or other
  misc_feature (463)..(463): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccgganaaaggcttgagtggatgggatggatcaacgctggcaatggtaaacaactaaaaaattcaacaagaagttccagggcaagngtacacctttaccagggacacatccgagaggatttacttatatggagtctagagcagcctagagactaccgaagacacggtctagtaattatttttgngtcgtacctctagtggagtctattattacgcttactaagttttcgacgttccgtacggggacccgtaacggggtacccttcgggtacccgacccggttcctccgtacccg

SEQ ID NO: 261124 - DNA, 712 bp, Homo sapiens
  misc_feature: GYAE6OF02JAU23.1.5.A05.1.454.CMB.1.raw
  modified_base (134)..(134): a, c, t, g, unknown or other
  misc_feature (134)..(134): n is a, c, g, or t
  modified_base (226)..(226): a, c, t, g, unknown or other
  misc_feature (226)..(226): n is a, c, g, or t
  modified_base (300)..(300): a, c, t, g, unknown or other
  misc_feature (300)..(300): n is a, c, g, or t
  modified_base (605)..(605): a, c, t, g, unknown or other
  misc_feature (605)..(605): n is a, c, g, or t
  modified_base (700)..(700): a, c, t, g, unknown or other
  misc_feature (700)..(700): n is a, c, g, or t
tcagacgagtgcgtcacgaccggtgctcgatttagatagatagacaggggacccaacaaccacatccctcctcagaacgcccccagagcacaacgccccaccatggactggacctggaggatcctcgttttggnggcagcagccacaggtcgcccactcccaggtccagcttgtgcagtctggggctggaggtgaagagccgtggggcctcagtgtaaggtttccngacaaggcttcaggataccaccttcacgttaggtatcgtctatactagttgggtgcgccgtacggcccccgganaaaggtcttgagtggacgtgggatggatcgaacgtcgtggacctaagtacggttaaacaacgtaaaaaacttccgaaacgtaacggtaaacgtttaccgaacgggtacacgtaacgttacccgtaacccgttttaaccggaacgggtaacctaacgtaccgtacccggtacggtaacgggtaactttaaccgttagtaacggtgggaacgtcgttacggagtaccgacgtaccgtaggacgtaacgtacccggaaagaccgtaacggtcctaagttacgtttaagttttcgcggacctaccgttntaacgggtgtaacgttactatttacgtcgtacttaacgtactttacggccttaccgtgggacccgtacggtaacccgtggtacctacccggttcncccgttaacccg

SEQ ID NO: 261125 - DNA, 265 bp, Homo sapiens
  misc_feature: GYAE6OF02H52NL.1.5.A05.1.454.CMB.1.raw
  modified_base (259)..(265): a, c, t, g, unknown or other
  misc_feature (259)..(265): n is a, c, g, or t
tcagacgagtgcgtcacgaccggtgctcgatttagatagatagacaggggcagttccagatttcaactgctcatcagcagcctgcagtctgaagattttgctagtttattactgtcagcagtataataactggcctccgacgttcggaccaagggaccaaggtggaaatcaaacgactgtggctgcaccatctgtcttcatccttcccgcatctgactcgtactgcgctggaggcgggctggcaagggccgcaataggnnnnnnn

SEQ ID NO: 261126 - DNA, 591 bp, Homo sapiens
  misc_feature: GYAE6OF02IJR69.1.5.A05.1.454.CMB.1.raw
  modified_base (222)..(222): a, c, t, g, unknown or other
  misc_feature (222)..(222): n is a, c, g, or t
  modified_base (443)..(443): a, c, t, g, unknown or other
  misc_feature (443)..(443): n is a, c, g, or t
  modified_base (480)..(480): a, c, t, g, unknown or other
  misc_feature (480)..(480): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttccngcaaggcttcaggatacaccttcactaggtatgactatacattgggtgcgccacggcccccggacaaaggcttgagtggagtgggatggatcgaacggctggcaagtaggtaaacaactaaaaaattacaacaagaagttaccagggacagatacacctttaccgaggacacactccgcggaacggatttacttataagtggagcgtgagcacgcctgganagtaccgaagacgacggctacgttattagtttttagngtacgtccttgtagtggaggttactagtttattacgcttactaatttcgacctttccggtagggtacccgtagggtaaccccgttgggtaccgaccgttccgtcctacccg

SEQ ID NO: 261127 - DNA, 534 bp, Homo sapiens
  misc_feature: GYAE6OF02GYV04.1.5.A05.1.454.CMB.1.raw
  modified_base (407)..(407): a, c, t, g, unknown or other
  misc_feature (407)..(407): n is a, c, g, or t
  modified_base (417)..(417): a, c, t, g, unknown or other
  misc_feature (417)..(417): n is a, c, g, or t
  modified_base (455)..(455): a, c, t, g, unknown or other
  misc_feature (455)..(455): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaaacacaaaaaattcaacagaagttccagggcagagtcaccttacaggacacatccgcgaggattactatatggagctgancagcctgganatcgaagacacggctgtatcttttagtgtacgaccttntagtggaggtctattattacgctactaatttcgtactccgttaggggccacgggtaccctggtaccaccgttctcctcg

SEQ ID NO: 261128 - DNA, 645 bp, Homo sapiens
  misc_feature: GYAE6OF02GAALP.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccccggacaaacggcttggagtggagtgggatggatcaacgctggcaagtggtaacaactaaaaaacttcaactagtaacgttccgaagggacaggagtacacctttaacgacgggacacactccgacgacggtattacttatagtggagtcgtgagacagccgtagaacgtacgtaccgaaggaccgacggtcgttagttaatttacgtttttgtacgtccgtaccgttacgttaaggtgggtacggttactaagtttacgtttacgtctttaacgttaagttttacggtaccgttccggttacggggtacccgtaacggggtaaccccgtttgggtacccgtaacccggttccgttcccgtaccg

SEQ ID NO: 261129 - DNA, 194 bp, Homo sapiens
  misc_feature: GYAE6OF02F12YH.1.5.A05.1.454.CMB.1.raw
  modified_base (180)..(194): a, c, t, g, unknown or other
  misc_feature (180)..(194): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttccacgcactcgtctgagcgggctggcaaggcgcatagnnnnnnnnnnnnnnn

SEQ ID NO: 261130 - DNA, 763 bp, Homo sapiens
  misc_feature: GYAE6OF02HO5VJ.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagccgtggggcctcagtgaaggtttcctgcaaggcttcaggatacctaccttcactaggtatgctatacagttgggtcgcgccacggcccccggacaaaggtcgttagagtggagtgggataggatacgaacgcgtaggactaagtacggtaaacaaactaaaaaacgttccaacgaacgtaacgttaccgaagggactaagacgttaccctaacccgtttaaccgaacgggtaaccaacgtactacccggacggtaacggttaactttaacgtttaacgtagtacgggaacgtcgtaggacgaccgacggtacccgtaggaaccgtacgttaacccggaacggtaaccgtaccggtacgtttaggtttaacgttttacgttttttggtacggttacccgttaccgttacggtttaagggttcgggtaacggttacttaagttttaccgttaccgtacgtttaacgttaacggttttacggtacccgtttccgggttaccggggacccgttaaccggggtaaccccggttggttaccccggtaccccgttcccgttacccgtacccgg

SEQ ID NO: 261131 - DNA, 589 bp, Homo sapiens
  misc_feature: GYAE6OF02JQBAR.1.5.A05.1.454.CMB.1.raw
  modified_base (207)..(207): a, c, t, g, unknown or other
  misc_feature (207)..(207): n is a, c, g, or t
  modified_base (220)..(220): a, c, t, g, unknown or other
  misc_feature (220)..(220): n is a, c, g, or t
  modified_base (242)..(242): a, c, t, g, unknown or other
  misc_feature (242)..(242): n is a, c, g, or t
  modified_base (279)..(279): a, c, t, g, unknown or other
  misc_feature (279)..(279): n is a, c, g, or t
  modified_base (300)..(300): a, c, t, g, unknown or other
  misc_feature (300)..(300): n is a, c, g, or t
  modified_base (306)..(306): a, c, t, g, unknown or other
  misc_feature (306)..(306): n is a, c, g, or t
  modified_base (313)..(313): a, c, t, g, unknown or other
  misc_feature (313)..(313): n is a, c, g, or t
  modified_base (320)..(320): a, c, t, g, unknown or other
  misc_feature (320)..(320): n is a, c, g, or t
  modified_base (400)..(400): a, c, t, g, unknown or other
  misc_feature (400)..(400): n is a, c, g, or t
  modified_base (529)..(529): a, c, t, g, unknown or other
  misc_feature (529)..(529): n is a, c, g, or t
tcagacgagtgcgtcacgaccggtgctcgatttagatagatagacaggggacccaacaaccacatccctcctcagaagcccccagagcacaacgccccaccatggacctggacctggagatcctcttttggtggcagcagccacaggtgcccactcccaggtccagcttgtgcagtctggggctgaggtgaacgagcctggggcctnagtgaaggttccngcaggcttcaggatacaccttnactggtatgctatacattgggtgcgcacggccccganaagcttgagtggatggatggntcacgntggcagngtaacanaaaatcacagaattccgaggcagacgtacacgtttacgaggtacactaacgtcgacgtaggactttactaatacgaggtntcgtagaagcgtaacgccgtagaggactacgaacgacgtacgctaggtacttacgttttagcgtacggtaacccttggttaagtcgggacggttacctagtttaacgtacgtacttacgttacgtttanaccgttcgttacggaccgtacggggttaacctcggttaccgacccgtttcaccgttcccg

SEQ ID NO: 261132 - DNA, 780 bp, Homo sapiens
  misc_feature: GYAE6OF02HL4PN.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcacgtaggtatgctatactagttgggtgcgccgacggccccccggaagaaaggcttgaggtggagtgggagtggactacgaacggcgtggacctaagtacggtaaacctaaaacgtaaaaaactttacgaaccaaaggtaaaccgttcccgaaaggggacgtaaggtacgttacccgtaaccgtttaacccgaacgggtaaccaactaacgttaccggacggtaacggttaatttaaccgttaattaacggtacgggtaacgtcgtacggaacgccgtaacggtacccgtaggtaaacgtacgtaccccggaaagaccgacgggtaccttaggttaactttacgtttttacgggtccgtacccggtaacccttacggttaacgggtacgggttaaggttaccgttaacgtttaccggttaccgacgtttaaccgttaaacggtttccgtaaccggttcccggtaccggggtaacccggtaaccggggtaaccccgttcgggttaccccgtacccggttaccctccccggtaacccgg

SEQ ID NO: 261133 - DNA, 623 bp, Homo sapiens
  misc_feature: GYAE6OF02HZ9CO.1.5.A05.1.454.CMB.1.raw
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
  modified_base (263)..(263): a, c, t, g, unknown or other
  misc_feature (263)..(263): n is a, c, g, or t
  modified_base (281)..(281): a, c, t, g, unknown or other
  misc_feature (281)..(281): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctgggcctnagtgagttccngcaggcttcaggatacaccttcactaggtatgctatacattgggtncgtccaggccccccgganaaacggtcttagagtggatgggatggatcaacgctggacagtggaacacaaaaattcaacaagtagttccagggcaggactacactttacgaggacactatcccgagacggtattacgtatagtggtagcttgagtacagtccgtgagtactaccggaacgacgaaccgggtcttacgttaagtttacgtttttcggtacgtaccgtacccgtttacgttaggtgggttacggtacttagtttacttacggtacctttacgtaagtttcgtaccgttaccgtacggggtacccgtaacggggtacccttcgggtaccctaaccggttcccgtccgtacccgg

SEQ ID NO: 261134 - DNA, 682 bp, Homo sapiens
  misc_feature: GYAE6OF02JOWDL.1.5.A05.1.454.CMB.1.raw
  modified_base (131)..(131): a, c, t, g, unknown or other
  misc_feature (131)..(131): n is a, c, g, or t
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
tcagacgagtgcgtcacgaccggtgctcgatttagatagatagacaggggacccaacaaccacatccctcctcagaacgccccagagcacaacgcccaccatggactggacctggaggatcctcttttggnggcagcagccacaggtcgccactcccaggtccagcttgtgcagtcgtgggctgagtgaagagcgtgggcctnagtgagttcngacaggtctactagactactactactacgtagtatacgtctactactagtggtcgcgccgaccggacccggaaccgtaacgtacgtacggtaggtaggtaggtaggtacgtacgtacgtacgtacgtacgtacgtacgtaacgtaacgtaaacgtaaactaaactaacgtaacgtaacgtaacgtaccgtacggacgacgtacgtacgtaacgtaacgtaacgtaacgacgacgtaccgacgtacggtaacgttaacgttaacgtagtaggtacgtacgtacgacgtacgtacgtacgtagtacgtacgtaacgaacgaacgtacgtacgttacgttagttacgttagtacgtacgtacgtacgtacgtacggtacgtacgtacgttacttacgtacgtaacttacgtacgtacgttaccggtacggtaccggtaccggtaccgtaccgtaccgtaccgtaccgtaccg

SEQ ID NO: 261135 - DNA, 639 bp, Homo sapiens
  misc_feature: GYAE6OF02JELMD.1.5.A05.1.454.CMB.1.raw
  modified_base (285)..(285): a, c, t, g, unknown or other
  misc_feature (285)..(285): n is a, c, g, or t
  modified_base (564)..(564): a, c, t, g, unknown or other
  misc_feature (564)..(564): n is a, c, g, or t
  modified_base (578)..(578): a, c, t, g, unknown or other
  misc_feature (578)..(578): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccgaggcccccgganaaaggcttgagtggagtggggatgggatcgaacggctggactaagtaggtaaaccaataaaaaacttcaacaagtaacgttaccgagggtacagtagtcctaacctttaccgaagggtaccacacgtccgcgtaaggtatttacctaattagtggacgtcgtagacgagaggcccgagtaacggacgttaccggaaagtaccgacgtccttaggttaatttagttttcggtagtccgtaccttaccgttagtacgggtagttctaagtttacttacgtntaccgttattacgngttccgggtcggtacccggacggttaaccgtccggtaccgttacccggtctcccgtacccg

SEQ ID NO: 261136 - DNA, 606 bp, Homo sapiens
  misc_feature: GYAE6OF02HWZ5B.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccacggcccccggacaaaggcttgagtggagtgggatggatcgaacgcgtggacaagtacggtaaacaaacaaaaaaacttcaactaaggaacgttaccgaggggacagagtaccaaccttttaaccgacgggacacactccgacgaggtatttacttatagtaggacgactgagcgacgccgtgacgacgtaccgaagacgacggctagttattagttttgcgtcgtacctacgttagtggtaggtctagtttatacgtcttacgtaagtttacgacgtccggttacgggccgtacgggtaacccgtcggtaccgtaccggttcctccgtacccg

SEQ ID NO: 261137 - DNA, 731 bp, Homo sapiens
  misc_feature: GYAE6OF02HXN9J.1.5.A05.1.454.CMB.1.raw
  modified_base (288)..(288): a, c, t, g, unknown or other
  misc_feature (288)..(288): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacagttgggtgcgccacggcccccggaanaaaggccttgagtggatgggatggatcgaacgctggacaataggtaacaacgaaaaaaattccaacgaagtaaagtacccgaagggtaccaagtacgtactaacccttttaaccgagggtaaccaactacgtaccggaccggtaaggtaactttacgtttaactagttagggtaagtcgttaggacgtaccgcggtacccgtagggagaacgtacccggaaaggaaccgtaccgggtacttaggttaacttacgttttttaggtcgacccgttaacccgtgttacgggttagggacgggttacttaacgtttaacgtttaccggtctttaacgtaactttttaacggacccgttcccgggttaaccgggtaccccggtaaccggggggttaaccccttccggggttaacccgtacccggtttacccgttcccgttaaccccgg

SEQ ID NO: 261138 - DNA, 327 bp, Homo sapiens
  misc_feature: GYAE6OF02J0IBI.1.5.A05.1.454.CMB.1.raw
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
  modified_base (267)..(267): a, c, t, g, unknown or other
  misc_feature (267)..(267): n is a, c, g, or t
  modified_base (270)..(270): a, c, t, g, unknown or other
  misc_feature (270)..(270): n is a, c, g, or t
  modified_base (273)..(327): a, c, t, g, unknown or other
  misc_feature (273)..(327): n is a, c, g, or t
tcagacgagtgcgtcacgaccggtgctcgatttagatagatagacagggggcagttccagatttcaactgctcatcagcagcctgcagtctgaagtattttgctagttttattactgtcagcagtataataactggcctccgagttcggccaagggaccaaggtggaaatcaaacgactgtggctgcacattcgtgtcttccntccttcccgctatctgacttcgtactgcgctgagcgggctaggcaaaggcgactatagncgatncancgnnnnnnnnnnnnnnnnnnnnnnnnnnnnnnnnnnnnnnnnnnnnnnnnnnnnnnn

SEQ ID NO: 261139 - DNA, 551 bp, Homo sapiens
  misc_feature: GYAE6OF02FMIC3.1.5.A05.1.454.CMB.1.raw
  modified_base (417)..(417): a, c, t, g, unknown or other
  misc_feature (417)..(417): n is a, c, g, or t
  modified_base (461)..(461): a, c, t, g, unknown or other
  misc_feature (461)..(461): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaaattcacagaagttcagggcagagtcaacctttacgagggacacatccgcgagattacttatatggagctgagcagcctganataccgaagacacgctagtattattttgtagcgtactcgttagnggtacggttcatttacttacgctactaagtttcgaactccgtaggggtacctacgggtacccgtaggttaccgaccgttccgtcctaccg

SEQ ID NO: 261140 - DNA, 260 bp, Homo sapiens
  misc_feature: GYAE6OF02ITBUR.1.5.A05.1.454.CMB.1.raw
  modified_base (253)..(260): a, c, t, g, unknown or other
  misc_feature (253)..(260): n is a, c, g, or t
tcagacgagtgcgtcacgaccggtgctcgatttagatagatagacaggggcagttccagatttcaactgctcatcagcagcctgcagtctgaagatttttgcagttttattactgtcagcagtataataactggcctccgacgttcggccaagggaccaggtggaaatcaaacgactgtggctgcaccatctgtcttcatccttcccgccatctgatcgtactgcgctgaggcgggctggcaaggcgcatagnnnnnnnn

SEQ ID NO: 261141 - DNA, 463 bp, Homo sapiens
  misc_feature: GYAE6OF02JM3DB.1.5.A05.1.454.CMB.1.raw
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
  modified_base (389)..(389): a, c, t, g, unknown or other
  misc_feature (389)..(389): n is a, c, g, or t
  modified_base (393)..(393): a, c, t, g, unknown or other
  misc_feature (393)..(393): n is a, c, g, or t
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
  modified_base (407)..(409): a, c, t, g, unknown or other
  misc_feature (407)..(409): n is a, c, g, or t
  modified_base (411)..(463): a, c, t, g, unknown or other
  misc_feature (411)..(463): n is a, c, g, or t
tcagacgagtgcgtcacgaccggtgctcgatttagatagatagacagggcagttccagatttcaactgctcatcagcagcctgcagtctgagattttgctagtttattactgtcagctagtataatactggcctccggacgtttcggaccaagggaccaagggtgaaattccaaaacgtactggtcggactggtacaacccaagttcctggtttaccctttacaaactttccccgtttaccccgggaccccttagtaccctttagggaaacggtggtttacccgccggttcccctttactcggggaacggttcccggggggtaccttggggaacccgtaaacgggccggttacgacgttaacgtgaagtcctagngctgnacgtgntancgtncancgtccagnacnnngnnnnnnnnnnnnnnnnnnnnnnnnnnnnnnnnnnnnnnnnnnnnnnnnnnnnn

SEQ ID NO: 261142 - DNA, 602 bp, Homo sapiens
  misc_feature: GYAE6OF02F2OY1.1.5.A05.1.454.CMB.1.raw
  modified_base (336)..(336): a, c, t, g, unknown or other
  misc_feature (336)..(336): n is a, c, g, or t
tcagacgagtgcgtcacgaccggtgctcgatttagatagatagacaggggacccaacaaccacatccctcctcagaagcccccagagcacaacgccccaccatggactggacctggagaatcctcttttggtggccagcagccacaggtgcccactcccaggtccagcttgtgcagtctggggctgaggtgaagaagcctggggcctcagtgaaggtttcctggcaaggcttcaggatacaccttcactaggtatgctatacattggggtgcgccaggccccccggacaaaaggcttgagtcggatgggatggatcaacgctggcaatggtaaacncgaaaaaattcaaccagaacgttccagggcaggagtcgacctttaccaggggtacacatccgacgaggatacttatataggagctgagcgtagccctagagatccggaaacgtacgaaccgcgtagtattaagttttgtagtcgtaaccttctagtggtacggttcactttaagtttaccgccttcgaaactttaggaaccttcccgttgggggccctaacgggggaaccccttcgggtaccgtacccggttacctcccgtacccg

SEQ ID NO: 261143 - DNA, 651 bp, Homo sapiens
  misc_feature: GYAE6OF02HNYE0.1.5.A05.1.454.CMB.1.raw
  modified_base (208)..(208): a, c, t, g, unknown or other
  misc_feature (208)..(208): n is a, c, g, or t
  modified_base (287)..(287): a, c, t, g, unknown or other
  misc_feature (287)..(287): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcngtgaagtttcctgcgaaggcttcgaggactacaccttcactaggtatgctatcattgggtgcgccgacggcccccgganaaaggcttggagtggagtgggagtggatacgaacgcgtggacaagtaggtaaacaaacgtaaaaaattccaacgtaagtaacgttaccgacgggacagtaacgtaccaacccgttttaacgagggaacctaaccacgtcccggacgaggtaactttaacgttattagtggagtcgtaggacgacgacgtcgtagagacgtaccgaagaccgacggtctgttaagtttacgttttgtacggtccgttaacctcggttaagtcggtaacggtcttaagtttacgttaccgtgttacgttaagtttcgaccgttcggaccgggtaccgtacgggacccgttggtacccgtccgttcctccgttaccg

SEQ ID NO: 261144 - DNA, 600 bp, Homo sapiens
  misc_feature: GYAE6OF02G35HL.1.5.A05.1.454.CMB.1.raw
  modified_base (467)..(467): a, c, t, g, unknown or other
  misc_feature (467)..(467): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccacggccccccggacaaacggcttggagtggagtggggatggatcgaacgcgtggcaagtacggtaaacaacgaaaaacttcaacacgtaaagttccgaagggacaaggtacgtactaccgtttaaccgaagggtaccaacgactccggacgaggtactttacgttatagtaggagtctgagcgagcctgagtacncgaagcacggtctacgtattagtttgcgtcgtacctgtagtcggtagtctagttacgttacgcttactaagtttcgacttccggtcgggtaccgacgggtacccgtggtacccgtaccggttcctccgtaccg

SEQ ID NO: 261145 - DNA, 735 bp, Homo sapiens
  misc_feature: GYAE6OF02JU104.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtcgtggggctggaggtgaagagccgtggggcctcgagtgtaaggtttcctgcaaggtcttcgaggtactacctaccttcacgtaggtatgtctatactattgggtgcgtccacggccccggacaaggtctgagtggagtgggagtggtacgtcaacggtcgtgggactaagtaggtaaacaaacgtaaaaagttaccgaacaaggtaacggttaccgaagggacgaacggtaagttacccgtaacccgttttaccggaacgggtaacctacgtacgtacccggtacggtaacggttaatttaaccgttagttaacgtgggtaaggtacgtaggacggtacgacggtaccgtaggacgtacgtaccgaaacggtaccgaacgggtcttaacgtttacgtttaagttttcgtaggtcccgtaccgttacggtacgttagggtacgtagttagttaacgttacgtcttacgttaactttacggttacctacccggttacggggtacccgtaaccgggtaacccgttccgggtacccgttacccggttccttacccgtacccgg

SEQ ID NO: 261146 - DNA, 657 bp, Homo sapiens
  misc_feature: GYAE6OF02JF5EW.1.5.A05.1.454.CMB.1.raw
  modified_base (316)..(316): a, c, t, g, unknown or other
  misc_feature (316)..(316): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtcgtgggctgaggtgaagagccgtggggcctcgagtgaaggtttcctgacaaggcttcgaggatacctacttcactaggtatgctatactagtggtgcgcaccggccccgactaacggcgtgagtggagtggactgganacacgcgtggataagtagtaaacaaacaaaatcaacgaagtaacgttcgaggactagtacgtacaaccgtttaacgagggaactacgacgtaccgcgaaggtactttacgtaatacgtagtacgtacgtgacgtacgtacgaccgtagaagtaacgttaccggaaacgtaccgacggtcgttaacgttatttacgttttagacggtccgttaaccgttagttaagtcggtaaggttaccttaagtttcgttaccgtagttacgttagttaccgtacgtaccgggtccgggtaaccggtaccggttaaccgtcggttaccgtaccgttccttcccgtaccgg

SEQ ID NO: 261147 - DNA, 551 bp, Homo sapiens
  misc_feature: GYAE6OF02FSA2L.1.5.A05.1.454.CMB.1.raw
  modified_base (432)..(432): a, c, t, g, unknown or other
  misc_feature (432)..(432): n is a, c, g, or t
  modified_base (436)..(436): a, c, t, g, unknown or other
  misc_feature (436)..(436): n is a, c, g, or t
tcagacgagtgcgtcacgaccggtgctcgatttagatagatagacaggggacccaacaaccacatccctcctcagaagcccccagagcacaacgccccaccatggactggacctggatgatcctctttttggtggcagcagccacaggtgcccactcccaggtccagcttgtgcagtctggggctgaggtgaagaagcctggggcctcagtgaaggtttcctgcaaggcttcaggatacacctttcactaggtatgctatacattgggtgcgccaggcccccggacaaaggcttgagtggatgggatggatcgaacgctggcaatggtaacaacaaaaaatcaacagaagttccaggcagagtcacttacaggacacgatccgcgaggacttactatatggagcgtgaagcgagctgagactaccgaagacncggntgttatatttttgagtcgtacctcgtagtcggagtctattagttacgcgtactaagtttgacttccgtaggggtacccgtacgggtaacccgttggtaccgtacccgtcgtcccg

SEQ ID NO: 261148 - DNA, 789 bp, Homo sapiens
  misc_feature: GYAE6OF02F75VG.1.5.A05.1.454.CMB.1.raw
  modified_base (297)..(297): a, c, t, g, unknown or other
  misc_feature (297)..(297): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtcgtggggctggaggtgaagaagccgtggggcctcgagtggtaaggtttcctgacaaggcttcaggactacaccttcacgtaggtatgctatacagttgggtgcgccgacggcccccggaanaaacggtcttagagtggagtgggagtggatacaacgctggacgtaagtacggtaaacaaacgtaaaaaattccaacgtaacggtaaacgttaccgaaggggtacaacgggtaacgttacccgtaaccgtttaaccgaacgggtaaccaaccgtaccgtaccggacggtaacggtaactttaacgtttaagtaacggttacgggacgtacgttaggaacggtacgaggtacccgtaggacggtaacggtaaccggaaacgtaacgtacccgggactttacggttaacttttaggtttttacggtacgtaaccgttacccgttacgttaacgggttacggtacggtttaaccgttaagtttaaccgtttaccgtaccgttaacggtttaacgttttaccggtacccgtttacccgggtacggggttaaccccgtaaccggggttaacccgttaccgggttacccgtaccccggtttaccctaccccgtacccgg

SEQ ID NO: 261149 - DNA, 757 bp, Homo sapiens
  misc_feature: GYAE6OF02IE70U.1.5.A05.1.454.CMB.1.raw
  modified_base (297)..(297): a, c, t, g, unknown or other
  misc_feature (297)..(297): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacagttgggtgcgccaggcccccggacaaaggcttggngtggagtgggatggatcgaacgctggcaataggtaacaacaaaaattacaactacgaagttaccgaagggcgagagtacgtaccgtttaaccagggaaccacgacgtcccgacggtaacgggacttttaaccgtaagttaacgtaggacggtactaggaacgtccgaagcccgttaggaaggtaaccgtccggtaaaaggaacccgtaaacggggtaccttacgggtttaattttaacggttttttttcggtacggttacccgggtaaacccgttttacggttaacgggttacggggtacgggttaacttaacggttttaacgtttaccgggtaccgttttacgtaaaattttttcccggggtaacctttaccccgggtttgggggtaaccccgtaagggggttaaaccccgttcggggttaaccccggttacccggttcccgtttacccctaacccggg

SEQ ID NO: 261150 - DNA, 634 bp, Homo sapiens
  misc_feature: GYAE6OF02FJXG7.1.5.A05.1.454.CMB.1.raw
  modified_base (264)..(264): a, c, t, g, unknown or other
  misc_feature (264)..(264): n is a, c, g, or t
  modified_base (287)..(287): a, c, t, g, unknown or other
  misc_feature (287)..(287): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactccccaggtccagcttgtgcagtctggggctgaggtgaagaagcctggggcctcagtgaaggtttcctgcaaggcttcaggatacaccttcactaggtatgctatacnttgggtgcgccacggcccccganaaggcttgagtggatgggatggatcaacgcgtggacaagtcggtaaacaacaaaaattcgaacaacgtaacggttccgagggcaaggacgtacctaccgtttaaccgagggtaacacgactacccgacggaggtacttacttaatagtcggagtcgtagacgtcacgtccgtagacgtacgtaccgaagaccgacggtctaggttactttagttttacgtgtaccgtacgttcgtacgggtgtaggttacgtatttacgttactcgttacttaagtttcgaccttccgggtccgggaccgtaacgggtacccgttggtacccgttaccgttccgttacccgtacccg

SEQ ID NO: 261151 - DNA, 628 bp, Homo sapiens
  misc_feature: GYAE6OF02FY00C.1.5.A05.1.454.CMB.1.raw
  modified_base (288)..(288): a, c, t, g, unknown or other
  misc_feature (288)..(288): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccgacggcccccggaanaaacggcttggagtggagtgggatggatcaacgcgtggcaagtaggtaaacaacgtaaaaaattcaacaagtaacgtaccgaggacagagtactaccgttacgaggacacactccgcgagtattacgttatagtaggtacgctaggacgacgacgtcgtgagtactaccggaacgaccgacggtcttagttaagtttgttttaggcgtacgtaccttagttaggtcggtagttcgtaatttacgttaccgacgttacgtaagttttcgaccgttccggtacgggtaccggtacggggtaacccttcgggtaacccgtacccggttcctcccgttaacccg

SEQ ID NO: 261152 - DNA, 187 bp, Homo sapiens
  misc_feature: GYAE6OF02HJ45A.1.5.A05.1.454.CMB.1.raw
  modified_base (180)..(187): a, c, t, g, unknown or other
  misc_feature (180)..(187): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttcctactgctagtctgagcgggctggcaaggcgcatagnnnnnnnn

SEQ ID NO: 261153 - DNA, 190 bp, Homo sapiens
  misc_feature: GYAE6OF02FS8G5.1.5.A05.1.454.CMB.1.raw
  modified_base (179)..(190): a, c, t, g, unknown or other
  misc_feature (179)..(190): n is a, c, g, or t
tcagacgagtgcgtcacgaccggtgctcgatttagatagatagacagggcaccaagggcccatcggtcttccccctggcaccctcctccaagagcacctctggggcacagcggccctgggctgcctggtcaaggactacttccagtactctatctgagcgggctggcaaggcgcatagnnnnnnnnnnnn

SEQ ID NO: 261154 - DNA, 542 bp, Homo sapiens
  misc_feature: GYAE6OF02F5H8H.1.5.A05.1.454.CMB.1.raw
  modified_base (371)..(371): a, c, t, g, unknown or other
  misc_feature (371)..(371): n is a, c, g, or t
  modified_base (407)..(407): a, c, t, g, unknown or other
  misc_feature (407)..(407): n is a, c, g, or t
  modified_base (444)..(444): a, c, t, g, unknown or other
  misc_feature (444)..(444): n is a, c, g, or t
tcagacgagtgcgtcacgaccggtgctcgatttagatagatagacagggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaattcacagaagttcaggcagatcacttacaggacanatccgcgaggattacttatatggagctgagcagccngagataccgaagacgacggcttcggtattagttttgngtcgtacttctagtggaggtctatttactacgctactaatttgaccttccgtacggggaccctacgggtacccttgggtccacccgttctccctaccg

SEQ ID NO: 261155 - DNA, 550 bp, Homo sapiens
  misc_feature: GYAE6OF02GCEV3.1.5.A05.1.454.CMB.1.raw
  modified_base (388)..(388): a, c, t, g, unknown or other
  misc_feature (388)..(388): n is a, c, g, or t
  modified_base (392)..(392): a, c, t, g, unknown or other
  misc_feature (392)..(392): n is a, c, g, or t
  modified_base (410)..(410): a, c, t, g, unknown or other
  misc_feature (410)..(410): n is a, c, g, or t
  modified_base (437)..(437): a, c, t, g, unknown or other
  misc_feature (437)..(437): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccacggcccccggacaaacggcttgagtggagtgggatggatcaacgctggcaagtggtaaacaactaaaaaagtcaacagtaagttccagggcagacgtcaccttacaggacacanccgngaggattactatatgagntgagcagctgagactcgaagacgacgntagtattgtttgcgtctaccttcttaggtgagtctattactacgtctacgtattataccgtccgtcgggtacgtacggtaacccgttcggtccgtacccgttctaccctaccg

SEQ ID NO: 261156 - DNA, 559 bp, Homo sapiens
  misc_feature: GYAE6OF02FX3BK.1.5.A05.1.454.CMB.1.raw
  modified_base (438)..(438): a, c, t, g, unknown or other
  misc_feature (438)..(438): n is a, c, g, or t
  modified_base (442)..(442): a, c, t, g, unknown or other
  misc_feature (442)..(442): n is a, c, g, or t
  modified_base (549)..(549): a, c, t, g, unknown or other
  misc_feature (549)..(549): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattggtgcgccaggcccccggacaaaggcttgagtggatggggatgggatcgaacgctggcaagtggtaacacaaaaatcacagaagttaccagggacagagtacacctttaccgaagggacacatccgacgagtattacgttatactggagctgagcagcctgagataccgaagacncggntagtattagtttagtgacgacttactagtggtaggtctatttagtacgtctactagttcgaccgttcgtacggggtccacgggtacccgttggtacctacccggttntaccctaccg

SEQ ID NO: 261157 - DNA, 924 bp, Homo sapiens
  misc_feature: GYAE6OF02GGEXM.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccgacggccccccggtaacgaaacggtcgttaggacggtgggaagttgggggaattggggaactttaccgaaaccggtcgttcgggacgtaaagtacgggtaaaaccaaaccgtaaaaaaaagtttccaaacgtaacggtaaacggtttacccgaagggggtacctaacgggtaacggttacccgtaacccgttttaacccgaacggggtaaccaaccgtacgttacccggaccgggtaaggtaactttaaccgtttaaagttaacggtacggggtaacgtaccgttagggaacggtaccgtaagggtaccccgttaggaaacgttaaccggtaacccggaaaacggtaacccgtaaccggggtaccgtttaacgggtttaacgttttaacgtttttcgggtacggttacccggttaacccggtttaccgttaacggggtttaccgggtaaacgggttttacccgtaaagtttttaaccggttttacccggttacgtttaaccggtttaaacggtttttacgggtaaccccgtttaaccccgggtttaccgggggggtaaccccgttaaacccgggggggttaaaccccccgtttaccgggggttacccccggtaacccccgggtttttccccgtaacccccgtttaaccccggg

SEQ ID NO: 261158 - DNA, 858 bp, Homo sapiens
  misc_feature: GYAE6OF02F0U5L.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagccgtggggcctcgagtgtaaggttttcctgcaaggcttcaggatacacttcactaggtatgctatacagttgggtgtcgccgacggccccccggacgaaacggcctttaggacggttaggacgttaggggaagttacgggaacccgaaacggtccgtaggaccgtaaagtacgggtaaaaccaaacgtaaaaaaacttccgtaaactaacggtaaacggttaccgaaggggaccgtaacggtaacggtaccgtaacccgtttaaccgaacgggtaaccgaaccgtacgttacccggaccggaacgggtaacttaacttttaacgttaagtacgggtaacgtaccgtacggaaggtaccgaacgtcccgtacggtaaggtaaccgtacccggtaacggaaccgtaaccgggtacgttacgtttaaacgtttaagttttttacgggtacggtaacccgttacccgttttaacgtaacggggtttcgggtaaaccggtttacttaaacgtttacgttttaaccgttacccgtttaacgttaaacggtttttccggtaacccgttttacccgggttacccggggtacccggttaaccgggttaacccccggttcgggttaaccccggttaccccgtttacccgttaccccgttaccggtaaccccgg

SEQ ID NO: 261159 - DNA, 607 bp, Homo sapiens
  misc_feature: GYAE6OF02HSV3I.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcaggtgaaggtttcctgcaaggcttcaggatacaccttcactaggtatgctatacattagggtgcgccaggcccccggacaaacggcttgaggtcggatggggatgggatcgaacgctggctaatggtaaacaacgaaaaattcaacaggaacgtttccgaagggcaagtacgtacgtaccttacgacgggacacgactccgagaggattacttaatagtgggatcgtaggacgacagccgtagagtactaccggaagaccgacggacctagttacgttagttttagtggtccgtacgttcgtagttgggtaaggtcgtaagtttacgttacgtctaccgttaattacgtacctcgtacggggactacgggaccctggtaccctacgttcctaccgtaccg

SEQ ID NO: 261160 - DNA, 321 bp, Homo sapiens
  misc_feature: GYAE6OF02JL71G.1.5.A05.1.454.CMB.1.raw
  modified_base (247)..(247): a, c, t, g, unknown or other
  misc_feature (247)..(247): n is a, c, g, or t
  modified_base (260)..(260): a, c, t, g, unknown or other
  misc_feature (260)..(260): n is a, c, g, or t
  modified_base (262)..(264): a, c, t, g, unknown or other
  misc_feature (262)..(264): n is a, c, g, or t
  modified_base (267)..(267): a, c, t, g, unknown or other
  misc_feature (267)..(267): n is a, c, g, or t
  modified_base (271)..(272): a, c, t, g, unknown or other
  misc_feature (271)..(272): n is a, c, g, or t
  modified_base (274)..(274): a, c, t, g, unknown or other
  misc_feature (274)..(274): n is a, c, g, or t
  modified_base (277)..(278): a, c, t, g, unknown or other
  misc_feature (277)..(278): n is a, c, g, or t
  modified_base (280)..(280): a, c, t, g, unknown or other
  misc_feature (280)..(280): n is a, c, g, or t
  modified_base (282)..(321): a, c, t, g, unknown or other
  misc_feature (282)..(321): n is a, c, g, or t
tcagacgagtgcgtcacgaccggtgctcgatttagatagatagacaggggcagttccagatttcaactgctcatcagcagcctgcagtctgaagattttgcagttttattactgtcagcagtataataactggcctccgagttcggccaaagggccaaggtgaaatcaaacgactgtggctgcacatctgtcttcatcttcccgcatctgcttcgtatgcgctggacggtcgggctggacaaaggcnccgaattaggctngnnngtnactnncnatnntnannnnnnnnnnnnnnnnnnnnnnnnnnnnnnnnnnnnnnnn

SEQ ID NO: 261161 - DNA, 886 bp, Homo sapiens
  misc_feature: GYAE6OF02FHCKD.1.5.A05.1.454.CMB.1.raw
  modified_base (150)..(150): a, c, t, g, unknown or other
  misc_feature (150)..(150): n is a, c, g, or t
  modified_base (223)..(223): a, c, t, g, unknown or other
  misc_feature (223)..(223): n is a, c, g, or t
tcagacgagtgcgtcacgaccggtgctcgatttagatagatagacaggggacccaacaaccacatccctcctcagaagcccccagagcacaaccgccccaccatggactggacctggaggatcctcttttggtggcagcagccacaggtncccactcccaggtccagcttgtgcagtctggggctgaggtgaagagcctggggcctcgagtgaacggtttccngcacggcttacgaggtactacctaccttcacgttacgggtattcggactaactacgagttcggggtcgccggcccgaaccgggacccccccgggtaacgtaaaacgggtccgttacgggtacgttaggggtaaccgttaggggtaacgttcggtaacgttaaccgaaaccgggtaccggtttaacggggaccctaaaacggttaacgggtttaaaaacccaaaccttaaaaaaaccgtttacccgaaacgtaaaccggggtaaccggtttaccccgggaacggggggtaccctaaagggtaaccgttaaccccgttaaacccggttttaacccggaaacgggggtaaccctaaccctaaccggttccccggaacggtaaccgggtaactttaaccgttacgtaacgttcgggaaacgtccgtacgtaacggtccgaacggtaccctaggaaccgtaacgtacccggtaaacgaccggacggtacctagttaacgtttatttacggttacgaaccggttaccttacggttacggtacgtacggttcctaaggtttacttaccgtaccgttaacgttaacgttcgtaacccgttaccgggtacgggtaccccggtaacgggttaaccctccggggtaccctaacccgggttcttacccgtacccg

SEQ ID NO: 261162 - DNA, 685 bp, Homo sapiens
  misc_feature: GYAE6OF02JS4LY.1.5.A05.1.454.CMB.1.raw
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
  modified_base (292)..(292): a, c, t, g, unknown or other
  misc_feature (292)..(292): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagccgtggggcctnagtgaaggtttccngcaaggcttcgaggactacgaccttcacgtaggtatgactatactattgggtgcgccacggcccccgganaaacggtcttggacggtggagtgggatggatcgaacggctgggcaagtaggtaaacactaaaaaagttcaacgagaacgttccgaagggcaagacgtcaacctttacgagggacacacgtaccggcgaaggtacttacgttaagtagtacgggtagtactaggtacgacgacgtccgtagaacggtacgtacgaacgaccgtaacggtcgttagttaacgtttagttttcgagtacccgtaaccttggttaagggttcgggtaaacgttagttacctttaagttacccgttcgttaacgtaacgttttacggtaccgttacccgttacgggggtacccgtaaccggggtacccgtagggtttacccgaaccggtttcccgtaccttacccggg

SEQ ID NO: 261163 - DNA, 711 bp, Homo sapiens
  misc_feature: GYAE6OF02JZTYE.1.5.A05.1.454.CMB.1.raw
  modified_base (220)..(220): a, c, t, g, unknown or other
  misc_feature (220)..(220): n is a, c, g, or t
  modified_base (504)..(504): a, c, t, g, unknown or other
  misc_feature (504)..(504): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagccgtgggcctcagtgaaggtttccngacaaggtcttcaggactacaccttcactaggtatgctataactagttgggtgccgccgtacgggccccccggaagtaacggtccgttagagtaggacgtgggactggactacgaacgcgtaggactaagtacgtaacgaactaaaatcacgtaagaacgttccgaggacagacgtactaccttacggaaggtacacgacgtccgagtaaggtacttaactagtagtacgggtatacgagtacgacgtacgtccgtagaacgtacgaacgaacgtacgacggtntagtttaattacggttttagacggtaccgtaccgttccgttaaggtagggtaaaccggttactttaacgtttaacggttacccgtacgtttaacgttaaggtttaccgtaaccgttcccggggtttaacgggacccggttaaaccgggggttaaccctttaccgggttacccgtaaccccggtttcccgtaaccccgtttaaccggg

SEQ ID NO: 261164 - DNA, 332 bp, Homo sapiens
  misc_feature: GYAE6OF02IBRN2.1.5.A05.1.454.CMB.1.raw
  modified_base (199)..(199): a, c, t, g, unknown or other
  misc_feature (199)..(199): n is a, c, g, or t
  modified_base (269)..(269): a, c, t, g, unknown or other
  misc_feature (269)..(269): n is a, c, g, or t
  modified_base (274)..(274): a, c, t, g, unknown or other
  misc_feature (274)..(274): n is a, c, g, or t
  modified_base (278)..(332): a, c, t, g, unknown or other
  misc_feature (278)..(332): n is a, c, g, or t
tcagacgagtgcgtcacgaccggtgctcgatttagatagatagacaggggcagttccagatttcaactgctcatcagcagcctgcagtctgaagatttttgctagttttattactgtcagcagtataataactggcctccgacgttcgaccaagggaccaaggtgaaatcaaacgactgtggctgcaccatctgtcttnactccttcccgctatctagactcgtactgcgctggacggcgggctggacaaaggggtccgcaattaagcntgctnagcnnnnnnnnnnnnnnnnnnnnnnnnnnnnnnnnnnnnnnnnnnnnnnnnnnnnnnn

SEQ ID NO: 261165 - DNA, 708 bp, Homo sapiens
  misc_feature: GYAE6OF02HZMW1.1.5.A05.1.454.CMB.1.raw
  modified_base (271)..(271): a, c, t, g, unknown or other
  misc_feature (271)..(271): n is a, c, g, or t
  modified_base (288)..(288): a, c, t, g, unknown or other
  misc_feature (288)..(288): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcaggtgaaggtttcctgcaagggcttcaggatacaccttcactaggtatgctatacattgggtncgccacggcccccgganaaaggcttgagtggagtgggatggatcaacgctggactagtaggtaaacaactaaaaaattcaacaacggtaacgttaccgaaggggacaggtacgtactacctttaaccgacgggtacctaacgagtcccggacggaacggtaatttaccgttaatacgtcgggtaagtcgtaggaagacgtaacgtccgttaaggacgtaacgttaccggaaacgacgaaccgggtactaggtttaatttacggttttttgacggtaccgtacctttcggttaaggttcgggtaacggttctaagttttacgttacgtcctttaacggtaaacttttaggtacccgttccggtaacgggggtcccgttaaccgggtaaccccggttaccgggttaccggtaaccccggtttcgtccccgttaacccgg

SEQ ID NO: 261166 - DNA, 186 bp, Homo sapiens
  misc_feature: GYAE6OF02HF2ZG.1.5.A05.1.454.CMB.1.raw
  modified_base (180)..(186): a, c, t, g, unknown or other
  misc_feature (180)..(186): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttcctcgtactgcgctgagcgggctggcaaggcgcatagnnnnnnn

SEQ ID NO: 261167 - DNA, 260 bp, Homo sapiens
  misc_feature: GYAE6OF02IW704.1.5.A05.1.454.CMB.1.raw
  modified_base (191)..(197): a, c, t, g, unknown or other
  misc_feature (191)..(197): n is a, c, g, or t
  modified_base (199)..(199): a, c, t, g, unknown or other
  misc_feature (199)..(199): n is a, c, g, or t
  modified_base (201)..(201): a, c, t, g, unknown or other
  misc_feature (201)..(201): n is a, c, g, or t
  modified_base (203)..(260): a, c, t, g, unknown or other
  misc_feature (203)..(260): n is a, c, g, or t
tcagacgagtgcgtcacgaccggtgctcgatttagatagatagacagggcaccaagggcccatcggtcttccccctggcaccctcctccaagagcacctctgggggcacagcggccctgggctggccctggtcaaggactacttcctatgtatactcttgaggtcgggcttgggtcaagggcgcagttagnnnnnnngncngnnnnnnnnnnnnnnnnnnnnnnnnnnnnnnnnnnnnnnnnnnnnnnnnnnnnnnnnnn

SEQ ID NO: 261168 - DNA, 564 bp, Homo sapiens
  misc_feature: GYAE6OF02H3O64.1.5.A05.1.454.CMB.1.raw
  modified_base (244)..(244): a, c, t, g, unknown or other
  misc_feature (244)..(244): n is a, c, g, or t
  modified_base (284)..(284): a, c, t, g, unknown or other
  misc_feature (284)..(284): n is a, c, g, or t
  modified_base (464)..(464): a, c, t, g, unknown or other
  misc_feature (464)..(464): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttnactaggtatgctatacattgggtgcgccaggcccccgganaaaggcttgagtggatgggatgggatcgaacgctggcaatggtaacaacaaaaattcaacagaagttaccagggtcagagtacacctttacagggacacataccgcgaggattacttatagtggagctgagcagccgtaggaacagtaccgaagacgaacggtctagttattatttttgngtcgtactcgtagtggacgttctatttattcgacttctaatttcgtactaccgttcgggaccgtacgggaacccctggtacctaccgtcctaccctaccg

SEQ ID NO: 261169 - DNA, 581 bp, Homo sapiens
  misc_feature: GYAE6OF02HBBQY.1.5.A05.1.454.CMB.1.raw
  modified_base (399)..(399): a, c, t, g, unknown or other
  misc_feature (399)..(399): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgccactcccaggtccagcttgtgcagtctggggctgaggtgaagagcctggggcctcagtgaaggtttcctgcaaggcttcaggatacaccttcactaggtatgctatacattgggtgcgccaggcccccggacaaaggcttgagtggatgggatggatcaacgctggcaatggtaacaacaaaaaattcaacagaagttccagggcagagtcactttacaggacacatccgcgaggatactatatgagntgagcagctgagatcccgaagacgacgactgtaattagttttgtagtcgtaccgttcgtagttagggtagttaccgtatttacgtttacgacctttacgtaattttcgaaccgttccgtacggggtacccgtaacggggtaaccccgttgggtaccctaacccggttccttcccttacccgg

SEQ ID NO: 261170 - DNA, 310 bp, Homo sapiens
  misc_feature: GYAE6OF02JJAQS.1.5.A05.1.454.CMB.1.raw
  modified_base (220)..(220): a, c, t, g, unknown or other
  misc_feature (220)..(220): n is a, c, g, or t
  modified_base (246)..(246): a, c, t, g, unknown or other
  misc_feature (246)..(246): n is a, c, g, or t
  modified_base (258)..(258): a, c, t, g, unknown or other
  misc_feature (258)..(258): n is a, c, g, or t
  modified_base (265)..(265): a, c, t, g, unknown or other
  misc_feature (265)..(265): n is a, c, g, or t
  modified_base (269)..(271): a, c, t, g, unknown or other
  misc_feature (269)..(271): n is a, c, g, or t
  modified_base (273)..(310): a, c, t, g, unknown or other
  misc_feature (273)..(310): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgagttcggccaagggccaaggtgaaatcaaacgactgtaggctgcaccatctgtcttcatcctccgcatctgatcgtactgcnctgagcgggtctcggcgaaacggtcncaataggatcgncgatctnagcnnncnnnnnnnnnnnnnnnnnnnnnnnnnnnnnnnnnnnnnn

SEQ ID NO: 261171 - DNA, 767 bp, Homo sapiens
  misc_feature: GYAE6OF02FQAWS.1.5.A05.1.454.CMB.1.raw
  modified_base (253)..(253): a, c, t, g, unknown or other
  misc_feature (253)..(253): n is a, c, g, or t
  modified_base (284)..(284): a, c, t, g, unknown or other
  misc_feature (284)..(284): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtangctatacattgggtgcgccaggcccccgganaaaggcttgagtggagtgggatggatacaacgctggcaatggtaacaacgaaaaaattcaacgaagaacgttaccgaggggtacaaggtacgtaccgtaaccgttttaaccgaaggggtaacctaacaacgttacccggacgaacgggtaactttaaccgtttaagtaagttaagggacggtacgttaggaacggtaccgtaacggacccgttaggaacggtaacggttacccggaaacgggaacccgaacggggtctttaaccggttaacgttttaaggttttttacggtaggtacccgttaaccgttaccggtttaagggttacgggtacggttacttaacgttttaacgtttaccgtacgttacgttaaacgttttcgaaacccgtttcccgggttaacgggggtaccccgtaacgggggttaaaccccggttcggggtttaaccccgtaccccggtttaccgtaccccgttaaccccgg

SEQ ID NO: 261172 - DNA, 183 bp, Homo sapiens
  misc_feature: GYAE6OF02GGBSG.1.5.A05.1.454.CMB.1.raw
  modified_base (180)..(183): a, c, t, g, unknown or other
  misc_feature (180)..(183): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttccatagcgtactctgagcgggctggcaaggcgcatagnnnn

SEQ ID NO: 261173 - DNA, 721 bp, Homo sapiens
  misc_feature: GYAE6OF02FJ88J.1.5.A05.1.454.CMB.1.raw
  modified_base (265)..(265): a, c, t, g, unknown or other
  misc_feature (265)..(265): n is a, c, g, or t
  modified_base (282)..(282): a, c, t, g, unknown or other
  misc_feature (282)..(282): n is a, c, g, or t
tcagacgagtgcgtcacgaccggtgctcgatttagatagatagacaggggacccaacaaccacatccctcctcagaagcccccagagcacaacgccccaccatggactggacctggaggatccctcttttggtggcagcagccacaggtgcccactcccaggtccagcttgtgcagtctggggctgaggtgaagagcctggggcctcagtgaaggttcctgcaaggcttcaggatcaccttcaactggtatgctatacattggtncgccacggcccccgganaaacggcttgatggatggatggatcaacgctggcaataggtaacacaaaaacttcacacgagttcccaggggcagtacgtacctacccgtttaccaacggggacctacgacgtcccggacggaacggactttaacctttaataagtcggtaacggtccgttaggacggtaccgtaacggcccgtaggaacgtaaccgttacccggaaaacgtaccggaacccgggtaccgttacggtttaaacgtttacggttttttacggtcgttaaccggtaacccctttacggtttaacggtacgggttacggttaactagtttaacgttaccgaccttacgttaaaccgtttcgtaacccgttacccggtaccgggggtacccgttaacggggtaaccccgttaccgggttaccgtacccccggttacttaccccgttaacccgg

SEQ ID NO: 261174 - DNA, 731 bp, Homo sapiens
  misc_feature: GYAE6OF02FP8T3.1.5.A05.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatagatagacaggggacccaacaaccacatccctcctcagaagcccccagagcacaacgccccaccatggactggacctggagatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattggtgcgccaggcccccganaaaggcttagagtggatgggatggatcgaacgtctggcaagtggtaacaacgtaaaaaattccaacaagtaacgttccgaagggcagacgtctaacctttaaccgagggaaccacacgtcccggacgaagggtaactttacgttaatacgtagggtagtctacggtagccgtaagcccgtaggaacgtaactacccggtaaacgacccgtaacgggtacttacggttaagttttacgttttttagggcgtttacccggtacccgtttacggttaaccgggttagggtaaccgggttacgttaacgtttaacggttttaccgtaccgtttacgttaaaaggtttttccgtaaaccggtttcccgttacggggggtaccccgttaaaccgggggttaaccccgttacgggttaacccgtaaccccggtttcccgttaccccggttaccccgg

SEQ ID NO: 261175 - DNA, 691 bp, Homo sapiens
  misc_feature: GYAE6OF02JF2AW.1.5.A05.1.454.CMB.1.raw
  modified_base (150)..(150): a, c, t, g, unknown or other
  misc_feature (150)..(150): n is a, c, g, or t
  modified_base (254)..(254): a, c, t, g, unknown or other
  misc_feature (254)..(254): n is a, c, g, or t
  modified_base (287)..(287): a, c, t, g, unknown or other
  misc_feature (287)..(287): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtncccactcccaggtccagcttgtacagtctgggctgaggtgaagagccgtggggcctcagtgaaggtttcctgcaaggcttcgaggatacaccttcactaggtangactatacattgggtgcgccgacggccccgganaacggcttgagtggagtggatggatcaacgtctaggacaataggtaacaacaaaattcgaactagtaacgttcgagggacagtacgtactaaccgtttaaccgagggtaacacgtaactaccggtacgaacgggtaacttaacttagtaacgtacgggagtacgtaggaacctcgaacgtaccgtagaacgtaacgttaaccggaaacacgtaaccggtctttaaggtaactttaacgttttacgacggtacccgtaaccttcggttaacggtacgggtaacggtacttaacgttacttaacccggtaccttacgtaacgttccgtaaccggtccggtacggggtacccgaaggggttaccccgtacgggtacccgttacccggtcctaccggtaccacccggg

SEQ ID NO: 261176 - DNA, 642 bp, Homo sapiens
  misc_feature: GYAE6OF02HRAVA.1.5.A05.1.454.CMB.1.raw
  modified_base (284)..(284): a, c, t, g, unknown or other
  misc_feature (284)..(284): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactagtatgctatacattgggtgcgccaggcccccgganaaaggcttgagtggatgggatggatcaacgctggacaataggtaacaacaaaaaattcgaacaagaacgttccaaggggactaaggagtactaccgtttaaccgagggaacacgactcccggcgaacgggtatttaaccgttaataacgttagggacgtctaggaacgtcgagtcccgtaggaacgactacccggaaagtaaccgacgggtctaggttaattagtttttagtaggtcctaccgttcgtaggttcggtagttacgtaagttagtttacgtacttacgtaaatttcgaaccgttccgtacgggtaccgacgggtaacccttacgggtccgtacccgttctacccgtaccg

SEQ ID NO: 261177 - DNA, 703 bp, Homo sapiens
  misc_feature: GYAE6OF02FWBT9.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacagttggggtgcgccacggccccccggacaaacggcttaggaggtggagtggggatggatcgaacggcgtcggacaagtaggtaaactaactaaaaaagttaccaactaagaagttacccgacggggacaacggagttaccgtaaccttttaaccgacgggaaccacacgtacccgacgtaacggtactttaaccgtttaatagtagggacgtacgttggaacgcgtaacggtcccgtaggtaacggtactaccggaaagtaccgacggtaccgttagtacgtttacgtttttgggtacgtaccgtaccgttacgttacggtaggtaaggttaccttaagtttacgtacgtacttacgttaagttttcgaccgttacccggttacggggacccgttacgggaacccccgttgggttaccctacccggttccttacccggtccg

SEQ ID NO: 261178 - DNA, 717 bp, Homo sapiens
  misc_feature: GYAE6OF02J2P12.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggcccccggacgaaaggcttcggagtggacgtgggtatgggactcgaaacgctggtaccaatacgggtaaacaaccgaaaaaatttacaacgtaaggaacgtttacccgaaggggtaccgaagacggtactaacccgttttaaccgacggggtaactaccgacgtacccggcgtaacggtacgtttaacttaagtagtttcgggaagtccgtgtaacggcgtaacgtcccgtaggtaaggtaccgttaccggaaacggaaccgtacgggtacgttaggttaacgtttacgtttttacgtgtaccggttacccttacgttacgggttagggtacggtcgtagtttaacgttaccgtacttaccggttaatttacgtactcccggttacggggtaccaccggggtaccgttccggttaccgtacccggttactacccgttacccgg

SEQ ID NO: 261179 - DNA, 762 bp, Homo sapiens
  misc_feature: GYAE6OF02G0440.1.5.A05.1.454.CMB.1.raw
  modified_base (281)..(281): a, c, t, g, unknown or other
  misc_feature (281)..(281): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctgggctgaggtgaagagcctggggcctcgagtgaaggttcctgcaggcttcaggatacaccttcactagtatgctatacattgggtgcgccacggcccccgganaaaggcttggagtggagtgggatgggatccaacgtcgtggactaagtcggtaaacaactaaaaaaacgtttcgaactaagaaacgttaccgaagggtacaggacgtacaccctttacgacggtaccgtactacgtacccgcgtaacggtactttaacgtaatacgttagggagtcgtaggacgacgtacgacccggttacggaggtaaccgtaaccgggaaaacggacccggtaaacccgggtctttacggttaagttttaacgttttttggtacccggttaccggtaacccgtttattaaccggggttacggggtacggtttaacctaacgttttaaggtttacccgtacgtttaacccgttaaaggttttaaccggttaccttaccccgggttagggggttaaccccgtaaaccgggggtttaccccgtaccggggttttaacccccgacccgggtttccctacccccggttaccccgg

SEQ ID NO: 261180 - DNA, 590 bp, Homo sapiens
  misc_feature: GYAE6OF02FJCHO.1.5.A05.1.454.CMB.1.raw
  modified_base (206)..(206): a, c, t, g, unknown or other
  misc_feature (206)..(206): n is a, c, g, or t
  modified_base (283)..(283): a, c, t, g, unknown or other
  misc_feature (283)..(283): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctnagtgaaggtttcctgcaaggcttcaggatacaccttcactaggtatgctatacattgggtgcgccaggcccccgganaaaggcttggagtggatgggatggatcgaacgctggcaataggtaacaacaaaaaattcacagaagttccgagggcagagtccactttaccgagggtacacgatccgacgaggtattacgttatataggtagctgagcgagtcctgagtataccgaagtaccacggtctagtagttatttgtcgtccgtacttcgttagtggtacggtctaagttagttacgcttacgtaattttcgaccgttcccggtcggggtacccgtacggggtaacccctgggttaccctacccggttccgtccctacccgg

SEQ ID NO: 261181 - DNA, 576 bp, Homo sapiens
  misc_feature: GYAE6OF02HH4IY.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgactatacattgggtgcgccaggcccccggacaaaggcttgagtggagtgggatggatcaacgctggcatggtaacaacgaaaaaattcaacagaacgttcagggacagagtcacctttacagggacacagtccgcgagattacttatatggagctagagcagcctgacgtagtacgaagaccgacggactgttattagtttttagtgtcgaccttcgtagtaggacggtcatttagttacgctacgttaatttcgtacgtccgttcggggtacctacggggtaacccgttcgggtacctaccggttccttcccttacccgg

SEQ ID NO: 261182 - DNA, 236 bp, Homo sapiens
  misc_feature: GYAE6OF02HFUNX.1.5.A05.1.454.CMB.1.raw
  modified_base (188)..(194): a, c, t, g, unknown or other
  misc_feature (188)..(194): n is a, c, g, or t
  modified_base (196)..(236): a, c, t, g, unknown or other
  misc_feature (196)..(236): n is a, c, g, or t
tcagacgagtgcgtcacgaccggtgctcgatttagatagatagacggagggcaccaacgggcccatcggtcttccccctggcacccttcctccaagagcacctctggggcacagcggccctgggctgccctggtcaaggcgtacttccagtactcgttatctgagcgggtctggcaaggcgcataggnnnnnnngnnnnnnnnnnnnnnnnnnnnnnnnnnnnnnnnnnnnnnnnn

SEQ ID NO: 261183 - DNA, 540 bp, Homo sapiens
  misc_feature: GYAE6OF02GOLLO.1.5.A05.1.454.CMB.1.raw
  modified_base (405)..(405): a, c, t, g, unknown or other
  misc_feature (405)..(405): n is a, c, g, or t
  modified_base (421)..(421): a, c, t, g, unknown or other
  misc_feature (421)..(421): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaaggatacaccttcactaggtatgctatacattggtgcgtccacggcccccggacaaaggcttgagtggatgggatggatcaacgcgtggcaagtgtaaacaacaaaaaagttcaacagaacgttccaggcagagtcacttacaggacacatcgcgagattactatagtaggancgtagagcagcctganacgtccgaagacgacgtcagttattagtttgtgcgtactctagtggtagtctattatacgcttagaatttgaccttcgtagggcctacgggtaccctggtaccaccgtcctcgtacccg

SEQ ID NO: 261184 - DNA, 260 bp, Homo sapiens
  misc_feature: GYAE6OF02F86Y9.1.5.A05.1.454.CMB.1.raw
  modified_base (243)..(243): a, c, t, g, unknown or other
  misc_feature (243)..(243): n is a, c, g, or t
  modified_base (248)..(260): a, c, t, g, unknown or other
  misc_feature (248)..(260): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtgaaatcaaacgactgtggctgcaccatctgtcttcatcttcccgcatctgatcgtactgcgctgagcggctggcaaggtcgnatagnnnnnnnnnnnnn

SEQ ID NO: 261185 - DNA, 270 bp, Homo sapiens
  misc_feature: GYAE6OF02F9D7H.1.5.A05.1.454.CMB.1.raw
  modified_base (229)..(229): a, c, t, g, unknown or other
  misc_feature (229)..(229): n is a, c, g, or t
  modified_base (245)..(247): a, c, t, g, unknown or other
  misc_feature (245)..(247): n is a, c, g, or t
  modified_base (249)..(270): a, c, t, g, unknown or other
  misc_feature (249)..(270): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataatactggcctccgacgttcgccaagggaccaggtggaatcaaacgactgtggctgcaccatctgtctcatcttcccgcatctgatcgtactgcgtctgagccggntgcaaggcgcatcggnnnannnnnnnnnnnnnnnnnnnnnn

SEQ ID NO: 261186 - DNA, 655 bp, Homo sapiens
  misc_feature: GYAE6OF02GLPV9.1.5.A05.1.454.CMB.1.raw
  modified_base (275)..(275): a, c, t, g, unknown or other
  misc_feature (275)..(275): n is a, c, g, or t
tcagacgagtgcgtcacgaccggtgctcgatttagatagatagacagggggacccgaacaaccacatccctcctcagaagcccccagagcacaacgccccaccatggacctggacctggaggtatcctctttttggtggcagcagccacaggtgcccactcccaggtccagcttgtgcagtctggggctgaggtgaagagcctggggcctcgagtgaggtttcctgcaaggcttcaggataccaccttcactaggtatgctatactattgggtcncgccacggcccccggacaaaggcttggagtggagtgggatggatcaacgtctggacaagtggtaaccaacgaaaaacttcaacaacgaacgttacgacgggtacacggaggtaccaccgtttaacgaacgggtaccaacacgttcccgacggtaacggtaactttaccgttaatacgttagggcgtacgtaggacgcgaacggtccgtagaaggtacgtacccggtaaagtaccgaaccgggtcttaggttaattctttttaggtcgtacgtacctttcgtaggttcgggtacggttcgtattaacttcggctacgtaattcgtaccgttcgtacggggacctacgggaccttcggtaccctccggttacctccgtaccg

SEQ ID NO: 261187 - DNA, 185 bp, Homo sapiens; identical to SEQ ID NO: 261015
  misc_feature: GYAE6OF02FLGYE.1.5.A05.1.454.CMB.1.raw
  modified_base (179)..(185): a, c, t, g, unknown or other
  misc_feature (179)..(185): n is a, c, g, or t

SEQ ID NO: 261188 - DNA, 588 bp, Homo sapiens
  misc_feature: GYAE6OF02IWMDN.1.5.A05.1.454.CMB.1.raw
  modified_base (396)..(396): a, c, t, g, unknown or other
  misc_feature (396)..(396): n is a, c, g, or t
  modified_base (413)..(413): a, c, t, g, unknown or other
  misc_feature (413)..(413): n is a, c, g, or t
  modified_base (420)..(420): a, c, t, g, unknown or other
  misc_feature (420)..(420): n is a, c, g, or t
  modified_base (455)..(455): a, c, t, g, unknown or other
  misc_feature (455)..(455): n is a, c, g, or t
  modified_base (464)..(464): a, c, t, g, unknown or other
  misc_feature (464)..(464): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgagtgaagagctggggcctcagtgaaggtttcctgcaagggcttcaggatacgaccttcactaggtatgctaatactattgggtgcgcctaggcccccggaacaaaggctgagtggtacgtgggactggatcgaacgcgtggcaagtaggtaacaacaaaaacttcacagaagttaccgaggcagtacgtctactttaccaggaacacacncgacgagtactacttanatggacntaggagtcgatcgtagagagtaccgaagacacggntagtacgtnttttacgtgtacgactacttaggtaccggtagtccgtaagttagttaccgtactacgtaagtttactacgttcggtacggaccgtacgggtacccgtaggtccgtaccgttcctccgtacccgg

SEQ ID NO: 261189 - DNA, 563 bp, Homo sapiens
  misc_feature: GYAE6OF02GZCJ2.1.5.A05.1.454.CMB.1.raw
  modified_base (391)..(391): a, c, t, g, unknown or other
  misc_feature (391)..(391): n is a, c, g, or t
  modified_base (414)..(414): a, c, t, g, unknown or other
  misc_feature (414)..(414): n is a, c, g, or t
  modified_base (427)..(427): a, c, t, g, unknown or other
  misc_feature (427)..(427): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaggcttcaggatacaccttcactaggtatgctatacattgggtgcgccacggcccccggacaaaggcttgagtggatgggatggatcgaacgcgtggcaagtggtaacaacaaaaaattccaacagaacgttccgagggacaggagtcacctttacgaggacactanccgcgacgtattactatatggancgtgagcagtccngagactcgaacgacacggctagtattattttgcgtcgtaccgtgtagtggtacgtacgtattacgttacgacttctaacgttgaccttcgtaggggcccacgggtaccttacggccgtaccgttcgtccctaccgg

SEQ ID NO: 261190 - DNA, 537 bp, Homo sapiens
  misc_feature: GYAE6OF02F9PWH.1.5.A05.1.454.CMB.1.raw
  modified_base (381)..(381): a, c, t, g, unknown or other
  misc_feature (381)..(381): n is a, c, g, or t
  modified_base (398)..(398): a, c, t, g, unknown or other
  misc_feature (398)..(398): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaattcacagaattccagggcagagtcacctttacaggacacatccgngagattactatatgagntgagcagcctgagatccgaagacacggctagtatacttttgcgcgtacctctagtgaggttcagtttattcgctacgtaatttgaccttcgtacggggtacccacgggtaacccttggtacctaccgttctcctacccg

SEQ ID NO: 261191 - DNA, 711 bp, Homo sapiens
  misc_feature: GYAE6OF02HVTSN.1.5.A05.1.454.CMB.1.raw
  modified_base (133)..(133): a, c, t, g, unknown or other
  misc_feature (133)..(133): n is a, c, g, or t
  modified_base (225)..(225): a, c, t, g, unknown or other
  misc_feature (225)..(225): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggnggcagcagccacaggtgcccactcccaggtccagcttgtgcagtctggggctgaggtgaagaagcctggggcctcaggtgaacggttttccngacaaggcttcaggataccgaccttcacgtaggtatgactatacagttggtgcgcgacggcccccggaagaaacggcttagagtgggaagtgggatggactcgaacgtcgtaggacaagtacggtaaacaaactaaaaaattcaaactaggtaaagttcccgaaggggcaaggtaacgtacctaaccgtttaaccgacgggtaaccacgaacgttacccgacgggtaaggttaatttaaccttaagttaaggtaggaacgtcgtaggaacggacgtaacggtcccgtaggaaacgtaacgttaacccggaaacggtaacgtacgggtacttaaggtttatttaaggtttttggacgttccgtaaccgttcgttaggtacggtaggttacctattttaaccgtacgttacgttacgtaagtttcgacgtcccgttacggggaccgtaacgggacccgtcggtaccctacccggtcttaccctaccgg

SEQ ID NO: 261192 - DNA, 778 bp, Homo sapiens
  misc_feature: GYAE6OF02GS3I1.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaggcttcaggatacaccttcactaggtatgctatacattggtgcgccaggcccccggacaaaggccttgagtggatggggatggatcgaacgctggcaagtggtaaacacgaaaaaaattccaacacgaagtttacccgaaggggaccaacggaagtcgaacccgttttaacccgacggggtaaccaccgaagttcccggacgaacgggtactttaaccgttaattaaagttcggggaaagtaccgttaggaacggtcgaacggtacccgttggaacggacgtttaccccgggaaacgtaaccgaaaccgggtccgttacggttaagtttaactttttttcgggtaggtacccggttaccgttaccgtttaagggttacgggtaacggtttccgttaagttttaaccgttttacggtacgtttacccgttaaaagtttttaaccgtaacccgtttaccgggttaccggggggtaaccccgttaaccggggggtaaacccccgttacggggtttaccccgtaacccgggttttccccgttacccgttaacccccgg

SEQ ID NO: 261193 - DNA, 793 bp, Homo sapiens
  misc_feature: GYAE6OF02F2Q4C.1.5.A05.1.454.CMB.1.raw
  modified_base (175)..(175): a, c, t, g, unknown or other
  misc_feature (175)..(175): n is a, c, g, or t
  modified_base (314)..(314): a, c, t, g, unknown or other
  misc_feature (314)..(314): n is a, c, g, or t
tcagacgagtgcgtcacgaccggtgctcgatttagatagatagacagggacccaacaaccacatccctcctcagaacgcccccagagcacaaccgcccaccatggactggacctggacgatcctcttttggtggcagcagcccacaggtcgcccactcccgaggtcccagcttgngcagtctggggctggaggtgaagagcctggggcctcagtgaaggtttcctgcaaggtcttacgaggactactaccttacgacgttaaggtatcgtactagtacctagttgggtcgccgtaccgacgggccccccggaanaaacggtcttaggaggtggtacgtgggtatggactacgaacggtccgtaggactaaacgttagggtaaacctaaaactaaaaactttccgaaaaccgacgtaaacggttaccgaagggtaccgaaagacggtttacccgaacccgttttaaccgaacggggtaacctaaccgtaccggtacccggtaccggaaggtaaaccttttaacttaacgttaacgttgggaagtcgtaacggtagacccgtacgtacccgtaggttaaggaacgtaccccggtaaagaacccgggtccggacgtttacggtttaacgtttagtttttacggtccgtaccgttacccgttacggttaagggtacggttacggtaacttaggtttaccttacgtccgttaacgtttaacgttcggtacgttacccgggttacgggacccgtaacgggacccgttacggtacccgttcccgttacctccgtaacccg

SEQ ID NO: 261194 - DNA, 894 bp, Homo sapiens
  misc_feature: GYAE6OF02G04CW.1.5.A05.1.454.CMB.1.raw
tcagacgagtgcgtcacgaccggtgctcgatttagatagatagacaggggaccaacaaccacactccctcctcagaacgccccacgacgcacaacgaccccaccactggactggacctggaggactcctcttttggtcggtcagcagccacaggtcgccactcccgacggtccagtccgttgtcgctaggtccgttgggggacttggagggtagaaacggtaaggcccgtacgggggtacctccgtaggtacggtaaacgggttttccgtcggaccgaaacggggtctttccggaaggggaacttacctaccgtttaccgaacgtttaaacgggtacgtacggttacctacgttaactaggtttacggggttaggtccggaccggtaaccggggacccccgggtaaccgtaaaggggtccgtttacggacgggttacgggtaacggtggggtacgtacggaacggttacgaaccggtcgtacgggacgtaaacggtacgggtaaacctaaagtaaaaaaccgttacgtaaacgtaaacggtaaacggtttaccgaacggggtaccgaacgtaacggttacctaaaacccggtttaaccgaacgggtaaaccgacgtaacgttacccgggtacgtaacggttaacgggtttaacctttaagtaccgtacggttaaggtaccgtacggttaacgcggtacgaccgtagtaacgcgttaacggacgtaacgcgtacgtacggttaatttacgttggttacgtacgttaaccgtagttacggtaaggttcggtaactacgtttaaccgtcgtacgttaacgttagtttaaccgccgttaccggtacgggtaccgtaaccgggtaccttaccggaccgttaccggtcttacccgttacg

SEQ ID NO: 261195 - DNA, 198 bp, Homo sapiens
  misc_feature: GYAE6OF02IHWHJ.1.5.A05.1.454.CMB.1.raw
  modified_base (180)..(198): a, c, t, g, unknown or other
  misc_feature (180)..(198): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttcctctctcgactctgagcgggctggcaaggcgcatagnnnnnnnnnnnnnnnnnnn

SEQ ID NO: 261196 - DNA, 646 bp, Homo sapiens
  misc_feature: GYAE6OF02GBXV3.1.5.A05.1.454.CMB.1.raw
  modified_base (340)..(340): a, c, t, g, unknown or other
  misc_feature (340)..(340): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcaggtgaaggtttcctggcaaggcttcgaggactactaccttcacgtaggtatgctatacattgggtgcgcacggcccccggacaaaggcttgaggtggagtgggatggatcaacgctggcaagtggtaacaanaaaaacttcaacaagtaacgttcgaggggcaaggacgtactacccgtttaaccgacggacacgatcccgacgacggatttacttaatagtaggacgtcgtagacgacacggacctagaggactaccgaacgaccggaacgaccttggtaatttcgtttttggtacgtaccgtaccttcgttaagtgggtacgtcggttaattacgttacgtcgtttactaacgttttacggtaaccgttccggttaggggacccgtaacggggtacccctaagggttcccgaacccggttccctacccggtacccg

SEQ ID NO: 261197 - DNA, 565 bp, Homo sapiens
  misc_feature: GYAE6OF02IX0VF.1.5.A05.1.454.CMB.1.raw
  modified_base (217)..(217): a, c, t, g, unknown or other
  misc_feature (217)..(217): n is a, c, g, or t
  modified_base (399)..(399): a, c, t, g, unknown or other
  misc_feature (399)..(399): n is a, c, g, or t
  modified_base (407)..(408): a, c, t, g, unknown or other
  misc_feature (407)..(408): n is a, c, g, or t
  modified_base (481)..(481): a, c, t, g, unknown or other
  misc_feature (481)..(481): n is a, c, g, or t
tcagacgagtgcgtcacgaccggtgctcgatttagatagatagacagggggacccaacaaccacatccctcctcagaagccccagagcacaacgcccaccatggactggacctggaggatcctcttttggtggcagcagccacaggtgcccactcccaggtccagcttgtgcagtctgggctgaggtgaagagcctgggcctcagtgaaggtttccngcaaggcttcaggatacacttcataggtatgctatacattgggtgcgccaggcccccggacaaaggcttgagtgatgggatggatcaacgctggcaatggtaacacaaaaattcaaccagaacgttccaagggcagagtacacgtttacagggacacatccgacgagattacttatatgganctaggaannagccgtgagactcgaagacacggtcctagtattacgttttgtacgcgtacctctaggtggaagttcaagtttnttacgtactacctaattttcgaccgttccgttagggacccgaacgggtaacccgtccggtaccgtaccgttccctccttacccg

SEQ ID NO: 261198 - DNA, 180 bp, Homo sapiens
  misc_feature: GYAE6OF02GH1RX.1.5.A05.1.454.CMB.1.raw
  modified_base (128)..(129): a, c, t, g, unknown or other
  misc_feature (128)..(129): n is a, c, g, or t
  modified_base (131)..(180): a, c, t, g, unknown or other
  misc_feature (131)..(180): n is a, c, g, or t
tcagacgagtgcgtcacgaccggtgctcgatttagatagatagacagggcaccaagggcccatcggtcttccacctggccaccctcctcacgtctacgtgcctgacgcgggctggcaaggcgcatagnncnnnnnnnnnnnnnnnnnnnnnnnnnnnnnnnnnnnnnnnnnnnnnnnnnn

SEQ ID NO: 261199 - DNA, 706 bp, Homo sapiens
  misc_feature: GYAE6OF02JBS4R.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctggaggtgaagaagccgtggggcctcagtgaaggtttcctggcaggtcttcgaggataccacttcactaggtatgctaatatagttgggtcgccgccgaccgggtaccccccggagtaaacgggtcgttggacggtagggtacgtaggggagtggataccgaaccgtcgttcgggacccaagttacgggtaaacctaaactaaaaaacgttaccgaaccgtaaaggtaacttaacccggaggggtaccacggaagttcccgaaccgtttaaccgacgggaacacgacgttcccgacggtacgtaacgtttaaccgttatagtacggtacgcgttaaggacgactacgtaccgtggaacgttacgtaacccgggtaacaccggtaccgtactacggtttaatttcgttttaggtccggtactccgttgtacgttggtacggtatacgttagtactattacttattacgtacgttccggtacggtacggtacggtccgtaggttaccctaccgtctaccgtacg

SEQ ID NO: 261200 - DNA, 728 bp, Homo sapiens
  misc_feature: GYAE6OF02IG33J.1.5.A05.1.454.CMB.1.raw
  modified_base (301)..(301): a, c, t, g, unknown or other
  misc_feature (301)..(301): n is a, c, g, or t
tcagacgagtgcgtcacgaccggtgctcgatttagatagatagacaggggacccaacaaccacactccctcctcagaagcccccagagcacaacgccccaccatggactggacctggagatccgtctttttggtggcagcagccacaggtgcccactcccaggtccagcttgtgcagtctggggctgaggtgaagagccgtggggcctcgagtgaaggtttcctgcaaggtcttcaggtatacctaccttcgacttaggtatgactatacgagttgggtgccgccgtacggcccccggaanaacggtccttaggaggtcggagtcgggagtggactacgaacggtctgggactaaggtacggtaaactaaacgtaaaaacttcgaacgtaagtaacgttaccggaggacgacggtacgttacctaaccgtttaccggagggtaccacgtacgtccgtacggacgttaactttaccgttaagtagttcgggaagtcgtaggtacgcgtaacgtccggtaggtaacgaacgtacccggtaaagaccgtacgtcttaggtttacgttagttttaggacgaccgttaccttaggttacgtaagggtacgttcttaagtttaccgttacgtccgttaacgttaacgttttcggaacccgttaccgggtacgggtaaccccgtacgggttacccgtccgggttacccggacccgtttcccgtacccgtacccgg

SEQ ID NO: 261201 - DNA, 816 bp, Homo sapiens
  misc_feature: GYAE6OF02IPLM2.1.5.A05.1.454.CMB.1.raw
tcagacgagtgcgtcacgaccggtgctcgatttagatagatagacaggggacccaacaaccacatccctcctcgagtagcccccagacgcacaacgccccaccatcggacgtggacctggagatcctcgttttggtggccaggaccagcctactaggttcgcccgtaactccccgaggtccacggaccttggtcgccgtagttccgttggggcctcgtacggtacgaaaggaacgccgtcggggcccttccctaggtcggtaaacggttttcccgtacgccgaaacggtccttccgaacggtaccgtaccaccgtttaccacgtaacggtacgtcgccgtactaacgtaacgttggggtacgccggttaccccgaccgggtaccccccggtaacgaaacgggttcgttcggacggttgggtaagtcggggtacgtacgggttacgacgaaaccggacgttcggactaaagttagggtaaccaaataaaaaacgtttcaaccgtaggtaaaacggttccggaacgggtaacgaacgtaacggttacctaaccccgttttaaaccgaacgggggaaacaaccgaacttacccgggacgtaacggtaacgtttactttaagttagtaccggaagtacgtagacggactaggtcccgagtacgacgtaccgtaacgagtacgcgttagttcttagtttcgttcgaacgttaccgtattcggaggttaggtaccttgtaccttaacgtcttataaacgttcgcttaaccgggtcggtaccgtacgggacccttggtacccgtaccgttcgtaccccgtacg

SEQ ID NO: 261202 - DNA, 745 bp, Homo sapiens
  misc_feature: GYAE6OF02JCCE3.1.5.A05.1.454.CMB.1.raw
tcagacgagtgcgtcacgaccggtgctcgatttagatagatagacaggggacccaacaaccacatccctcctcagaagccccagagcacaacgcccaccatggactggacctggaggatctctttgtggcagcagcacaggtgccactccaggtccagcttgtgcagtcgtgggctgaggtgaagaagccgtgggctcagtgaaggttctgacgtacggtacgtacgtaggtacgtacgtaccgttaccgtaacgtaacggtacgtacgtacgttaacgtaacgtacggttacgggtacggtaccggtcccggtaaccggaccccggaaccggtaaacggtacggttacggtacggtaggtaggtaggtaggtaggtacgtacgtaacggtacgtacggtacgtaacgtaacggtaaacgtaaacgtaaaacgtaacgtaacgtaacgtaacgtacgtaacggtacgtaacgtacgtacgtaaccgttaacgtaacggtaacgaacgtacgtacgtacgtacgtaacgttaacgttacgtaagtacggtacgtacgtacgtacgtacgtacgtacgtacgtacgtacgtacgaacgacgtacgtacgtacgttagttacgttacgtacgtacgtacgttacgtacggtacggtagtacgtagttacgttacgtacgtaacgttaacgttacgtacgtacggtacggtacggtacggtaccgtacggtaccgtaccgtacgtaccg

SEQ ID NO: 261203 - DNA, 644 bp, Homo sapiens
  misc_feature: GYAE6OF02FY5XL.1.5.A05.1.454.CMB.1.raw
  modified_base (207)..(207): a, c, t, g, unknown or other
  misc_feature (207)..(207): n is a, c, g, or t
  modified_base (220)..(220): a, c, t, g, unknown or other
  misc_feature (220)..(220): n is a, c, g, or t
  modified_base (485)..(485): a, c, t, g, unknown or other
  misc_feature (485)..(485): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctnagtgaggtttccngcagcttcaggatacaccttcactaggtatgctatacagttgggtgcgccgacggcccccggacgaaaggcgttgaggtggagtgggatggagtcgaacgcgtaggactaagtacggtaaacaacgtaaaaacttcaacagtaagttccgaagggcagtacgtactacctttacgacgggaactacgacgtccgagacggtactttaacgttagtagtggacgtacgtagagcacgccgtgaacgactacggaagaccgacggtnttagttagtttagtttttgacgtccgttaccgttgttagggtggtaacgttacgttacgtttacttacgtcttacttaaggtttaccgtaccgttccggttagggtacccgtaacgggttacccgttacgggtacccgtcccgttacccttccgtaccg

SEQ ID NO: 261204 - DNA, 794 bp, Homo sapiens
  misc_feature: GYAE6OF02HLNBY.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctgggctgaggtgaagaagccgtggggcctcgagtgaaggtttcctgcaaggtcttcgaggatacctaccttcactaggtatgctatactattgggtagcgtccacgggccccccggagaaacggcttggacggtggagtacggggatggaactacgaaacggccgttaggacctaagtacgggtaaaacctaaactaaaaaaacgttcaaactaaggtaaacgtttacccggaaggggtaccaaggtaacgttaccccgtaaaccgttttaaacccgaacgggggtaacccaaacgtaaccggttaccccgaacgggtaacgggttaaacttttaaaccgttttaagttaacggttaggggtaacggtacggttacggaacggtacgaaccggtcccgtaaggaacggtaacgtacccggtaaacggaaccgtaccgggtacgttacgtttaagtttacggtttttttcggaggtaacccgttaaccgttacgtttaagggtcggtacggtcttaacgtttaagtttaccgctttaacgtaagtttcgtaaccttccggtacgggaccggttaacgggacccgttcggttaacctcccggttaccgtcctacccgg

SEQ ID NO: 261205 - DNA, 777 bp, Homo sapiens
  misc_feature: GYAE6OF02G3ZOW.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaagtttctgcaaggcttcaggataccaccttcactaggtatgctatacattgggtgcgccgacggcccccggacaaggcttgaggtggagtgggagtggagtcgaacgcgtggacaagtaggaaactaactaaaaaattcaacgaagtaacgttaccgaacggggacaggaacgtccgtaaccgttttaccgaacggggaaccaaccgacgtacccggtaccgggtaacggtaactttaaccgtttaagttaacgttacgggacgtacgtaggtacggaccgaacgtcccgtaggaacgtacgtacccggaaacgaaccggtaccgggtccgtttaaggttacgttttacgtttttacggttacggtaccgttaacccgttacgtttaacggttacggggtaacggtttaaccgttaagttttaccgttaaccgttaccgttaaccgtttaacggttttaccgttaaccgttacccgggtttcgggggtaacccggttaaccggggttaaccccggtttcggttaaccccgggttacccggtttacccgttacccgttaacccgg

SEQ ID NO: 261206 - DNA, 632 bp, Homo sapiens
  misc_feature: GYAE6OF02JNXU5.1.5.A05.1.454.CMB.1.raw
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
  modified_base (281)..(281): a, c, t, g, unknown or other
  misc_feature (281)..(281): n is a, c, g, or t
  modified_base (313)..(313): a, c, t, g, unknown or other
  misc_feature (313)..(313): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgccactcccaggtccagcttgtgcagtctgggctgaggtgagagcctgggcctnagtgaggttccngacaggcttcgaggactacaccgttcactaggtatgactatacattggtgtcgcacggccccgganaaaggtctgaggtgagtggatggatcgaacgntaggctaagtaggtaacaactaaaaattcgaactaagaacgttcgaaggacaggacgtactaccgttaacgacggacacactccggacgaggtacttaacgttatagtggtaacgtcgtgaacggtacaggtacctaggaacggtacgtaaccggaagaccgtaacgggtcttaggttaagttacgtttttggacgaccgttacgttcgtaacggttggacgttacgtacgtttacgttacgtacttacgtaatttaccggtacttcccgggtaggtaccgtaccggtaccgttcggtacctaccggttctaccgtacg

SEQ ID NO: 261207 - DNA, 639 bp, Homo sapiens
  misc_feature: GYAE6OF02JXZJX.1.5.A05.1.454.CMB.1.raw
  modified_base (132)..(132): a, c, t, g, unknown or other
  misc_feature (132)..(132): n is a, c, g, or t
  modified_base (149)..(149): a, c, t, g, unknown or other
  misc_feature (149)..(149): n is a, c, g, or t
  modified_base (174)..(174): a, c, t, g, unknown or other
  misc_feature (174)..(174): n is a, c, g, or t
  modified_base (205)..(205): a, c, t, g, unknown or other
  misc_feature (205)..(205): n is a, c, g, or t
  modified_base (219)..(219): a, c, t, g, unknown or other
  misc_feature (219)..(219): n is a, c, g, or t
  modified_base (228)..(228): a, c, t, g, unknown or other
  misc_feature (228)..(228): n is a, c, g, or t
  modified_base (248)..(248): a, c, t, g, unknown or other
  misc_feature (248)..(248): n is a, c, g, or t
tcagacgagtgcgtcacgaccggtgctcgatttagatagatagacaggggacccaacaaccacatccctcctcagaagcccccagagcacaacgccccaccatggactggacctggagatcctctttttggnggcagcagccacaggtncccactcctaggtccagcttgtgcngtctgggctgaggtgaagagcctggggcctnagtgaaggtttccngcaaggctnaggatacacttcataggtangctatactagttgggtagccgccacgggtaccccccggaagaaacggtcttggagtcggagtgggatggagtcgaacggtcgtggacaagtaggtaaacaacgtaaaaactactaacgaagaaacgttcgagggtactagaacgttacctaaccgtttaaccgacgggaacacgaacgttcccggaacgtaaggtacttaacgtataagtgggacgtactaggagacggtagacccgtagaggtaactaccgaaggaccgacggtactgttacgtttagttttcgtacctcgtacttcgttaaggtacggtagtctaagttacgtactcgtacgtaacttcgtacgtccgtacggaccgtacgggtactcggtccaccggttccacttccg

SEQ ID NO: 261208 - DNA, 588 bp, Homo sapiens
  misc_feature: GYAE6OF02FTSK5.1.5.A05.1.454.CMB.1.raw
  modified_base (344)..(344): a, c, t, g, unknown or other
  misc_feature (344)..(344): n is a, c, g, or t
  modified_base (423)..(423): a, c, t, g, unknown or other
  misc_feature (423)..(423): n is a, c, g, or t
  modified_base (429)..(429): a, c, t, g, unknown or other
  misc_feature (429)..(429): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcgaggatacaccttcactaggtatgctatacattgggtgcgccaggccccccggacgaaaggcttgagtggatgggatggatcaacgctggcatggtaacaactaaaaattcanaagaagttccagggacagagtcaacctttaccgaagggaccacactcccgacgaggacttacttatatggagtctggancgagcngagtataccgaagaaccgacggctagtatttaagttttgtagtcgtacccttgttacggtggtacggttactatttacttacgtcttacgttaactttggaccttccggttcgggaccgtacggggaacccttcggtctacccggttcctcctacccgg

SEQ ID NO: 261209 - DNA, 536 bp, Homo sapiens
  misc_feature: GYAE6OF02FLILG.1.5.A05.1.454.CMB.1.raw
  modified_base (244)..(244): a, c, t, g, unknown or other
  misc_feature (244)..(244): n is a, c, g, or t
  modified_base (285)..(285): a, c, t, g, unknown or other
  misc_feature (285)..(285): n is a, c, g, or t
  modified_base (417)..(417): a, c, t, g, unknown or other
  misc_feature (417)..(417): n is a, c, g, or t
  modified_base (452)..(452): a, c, t, g, unknown or other
  misc_feature (452)..(452): n is a, c, g, or t
  modified_base (522)..(522): a, c, t, g, unknown or other
  misc_feature (522)..(522): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttnactaggtatgctatacattgggtgcgccaggccccccgganaaacggcttgagtggatggggatggatcaacgctggcaagtggaacaactaaaaattcaacagaagtccagggcagagtcaccttacaggacacatccgcgagattacttatacgtggagcgtgagcagccngacgatccgaagacgacgtctagtattagttttgngtcgtactcgtagtggtagtctattacttacgctcgtattcgctccgtgggactacgggacctggtaccnccgtctccgtaccg

SEQ ID NO: 261210 - DNA, 840 bp, Homo sapiens
  misc_feature: GYAE6OF02JPNLK.1.5.A05.1.454.CMB.1.raw
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
tcagacgagtgcgtcacgaccggtgctcgatttagatagatagacagggacccaacaaccacatccctcctcagaagccccagagcacaacgccccaccatggactggacctggaggatcctcttttggtggcagcagccacaggtgcccactccaggtccagctgtgcagtctggggctgagtgaagagctggggcctnagtgaaggtttccngcaggcttcgaggatacacctttcacgttaggtatgactatactattaggggttgcgtccacgggtccccccggacgaaacgggccttaggacggtgggagtggggaacgttggggtaactacggtaaaccggtcgttacgggacgtaaacgttcggggtaaaacctaaaccggtaaaaaaacttttaccgaaaacctaacggggttaaaacggtttacccggaaaggggggtacccgtaagtaaccgggtttaacccgtaaacccgtttttaaacccgggtaacgggggtaacccaaaccggttaacgtaccccggtaacgggtaacgggtaacgttttaactttaacgttaaccgttagggtaacggtcgttacggaaggtaccgtaaggtaccccggtaggtaacggtacggttacccggaaacgtaccggtaacgggtacgttaccggttagtttaacgtttttcggtaggtacccgtacgttacgttacggttagggtacggtacgttagtttaacgttacgtaccgttacgttaacgtttagttaccgtaccggttacggggtaccgtaacgggtacccggtacggtttaccggaacccgtttcccgtaccgttacccgg

SEQ ID NO: 261211 - DNA, 570 bp, Homo sapiens
  misc_feature: GYAE6OF02GTAK0.1.5.A05.1.454.CMB.1.raw
  modified_base (289)..(289): a, c, t, g, unknown or other
  misc_feature (289)..(289): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggataccaccttcactaggtatgctatacattgggtgcgtccaggccccccggaanaaaggcttgagtggatggggatggatcgaacgctggcaagtcggtaacaacaaaaaatcaactagaacgttcaggcagagtcaacctttaccgagggacacgagtccgacgagacttacttatatggagtcgtagagcgagcccgtagacgactcgaagcacggtctgtattattttgcgtcgtaccttgtagtggtacgtatattattaccgcttagtaactttgacgttccggtacgggccgtaacgggtacccgtggtaccgtaccgtcctcctaccg

SEQ ID NO: 261212 - DNA, 683 bp, Homo sapiens
  misc_feature: GYAE6OF02JCFV9.1.5.A05.1.454.CMB.1.raw
  modified_base (133)..(133): a, c, t, g, unknown or other
  misc_feature (133)..(133): n is a, c, g, or t
  modified_base (220)..(220): a, c, t, g, unknown or other
  misc_feature (220)..(220): n is a, c, g, or t
  modified_base (273)..(273): a, c, t, g, unknown or other
  misc_feature (273)..(273): n is a, c, g, or t
  modified_base (390)..(390): a, c, t, g, unknown or other
  misc_feature (390)..(390): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggnggcagcagccacaggtgcccactcccaggtccagcttgtgcagtctggggctgaggtgaagagcctgggcctcagtgaaggtttccngcgaaggtcttacaggtatacaccttcactaggtatgctatacagttgggtanccgtccacggtcccccggaagaacggcttgaggtggagtgggatagggatacgaacggcgtggtacaagtcggtaaacaacgtaaaaaattcgaactagtaacgttacgaagggtanaagacgtaccgtaaccgtttacgaaggtaccaacgatccggagtaacggtattacgttaatacgtggaacgtctagagacgacggtacctagacgtacgtaacggaacgacaccggtagtagttaatttacgtttggtcgtaccggttacctaggttacgttcgggtacgttattacgttaacgttacgtttacgtacgttaagttttccggaacgtttacccgggttacggtacccgggttaaccgggtaaccctttcggggtacccaccggtttacgtacccccgttacgg

SEQ ID NO: 261213 - DNA, 727 bp, Homo sapiens
  misc_feature: GYAE6OF02JSR8I.1.5.A05.1.454.CMB.1.raw
  modified_base (221)..(221): a, c, t, g, unknown or other
  misc_feature (221)..(221): n is a, c, g, or t
tcagacgagtgcgtcacgaccggtgctcgatttagatagatagacaggggacccaacaaccacatccctcctcagaagcccccagagcacaacgccccaccatggactggacctggatgatcctcttttggtggcagcagccacaggtgcccactcccaggtccagcttgtgcagtctgggctgaggtgaagagccgtggggcctcgagtgaaggtttccngcgaaggtcttcgaggatacgaccttcactagtatgctatacagttggtcgtcgccgacggcccccggaataaacggcttacggagtaggagttgggagttcggaatccgaacgtccgtgggacgtaacgtacgggtaaacaaacgtaaaaaagttcaaacgtacgtaaacggttacccgaaggggtacctaaaggtacgttaccgtaaaccgtttaaccggaacgggtaacctaaccgtaacgtacccggtaacgggtaacggttaacttaacttttaacggtaagtacggggtacgacgttacggtaaacgaccgtaacggccttaggaaccgtaagtaccggaacgtacgacggtcttacggtatttaacgttttggacgttccgacttagtacggtacggtacgttctaagtttcgtacgtaccgtaacttaacgtttcgtaaccttcggtaccgggtaccgtaaccgggtaacctcggtacccgttaccgttacccgtccg

SEQ ID NO: 261214 - DNA, 318 bp, Homo sapiens
  misc_feature: GYAE6OF02GMSI9.1.5.A05.1.454.CMB.1.raw
  modified_base (226)..(226): a, c, t, g, unknown or other
  misc_feature (226)..(226): n is a, c, g, or t
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
  modified_base (255)..(256): a, c, t, g, unknown or other
  misc_feature (255)..(256): n is a, c, g, or t
  modified_base (259)..(269): a, c, t, g, unknown or other
  misc_feature (259)..(269): n is a, c, g, or t
  modified_base (272)..(318): a, c, t, g, unknown or other
  misc_feature (272)..(318): n is a, c, g, or t
tcagacgagtgcgtcacgaccggtgctcgatttagatagatagacaggggcagttccagatttcaactgctcatcagcagcctgcagtactgaagattttgcagttttattactgtcagcagtataataactggcctccgacgttccggccaagggaccaaggtggaaatcaaagactcgtggctgcacatctgtcttcatccttccgccatctgatcgtactgcnctgagcggctggctaaggcncataagntnngannnnnnnnnnnatnnnnnnnnnnnnnnnnnnnnnnnnnnnnnnnnnnnnnnnnnnnnnnn

SEQ ID NO: 261215 - DNA, 776 bp, Homo sapiens
  misc_feature: GYAE6OF02JK45I.1.5.A05.1.454.CMB.1.raw
  modified_base (222)..(222): a, c, t, g, unknown or other
  misc_feature (222)..(222): n is a, c, g, or t
tcagacgagtgcgtcacgaccggtgctcgatttagatagatagacaggggacccaacaaccacatccctcctcagaagcccccagagcacaaccgccccaccatggactggacctggaggatcctctttttggtggcagcagccacaggtgcccactcccaggtccagcttgtgcagtctggggctgaggtgaagagcctggggcctcagtgaaggtttccngcaaggcttcgaggactaccaccttcacgtaggtatcgctatacagttggtgcgccgacggtcccccggacgaaaggtccgttagacggtggaagtggggatggactacgaacggtcgtaggactaagtacggtaaacaaacgtaaaaaacttcgaacgaagtaacggttaccgagggtacgtagaacggttacctaacccgtttacgacggggaacctaaccgtacgtacccggacgtaacggtactttaacgttaacgtacgtagggtaacgtcgtacggacgtcgaacggtacccgtaggaacgtacggttaacccggaaacggtaccgaccgggtactcgttaagtttacgtttttaggaccggtacctaaccggttcgtaacggttgggtacgttaaaccgttagttttaaccgttaccggttacccgtttaacgttaaacggtttttcctaacggttaccccggttacgggggtaaccccgttaaccggggttacccctttaccgggggtttacccctaccccggtttaccgtccccgtttacccggg

SEQ ID NO: 261216 - DNA, 722 bp, Homo sapiens
  misc_feature: GYAE6OF02FKXB1.1.5.A05.1.454.CMB.1.raw
  modified_base (286)..(286): a, c, t, g, unknown or other
  misc_feature (286)..(286): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcgaggatacaccttcactaggtatgctatacattgggtgcgccacggcccccgganaaaggcttgagtggagtgggatggatcgaacgcgtaggacaagtaggtaaacaactaaaaaagttcaactaagaacgttccgagggacagtacgtactacctttaccgagggaaccacgtacgtccggacgaaggtactttacttagtagttggacgacgttagacgtcgacggtaccgtaggaagtacgtaccggaagtaccgaccggtcgtttaggttaacgttttagtttttaggtacgtacccgttaaccgtttcgttaaaggttcgggtaacggttacgttaacgttttaacgttaccgtacgtttacgttaaacggttttaccggtaacccgtttacccggggttacgggggtaaccccgtaaccgggggttaaaccccgttccgggttaacccgttaccccggtttacccgttaccccgttaaccccgg

SEQ ID NO: 261217 - DNA, 546 bp, Homo sapiens
  misc_feature: GYAE6OF02G0EP9.1.5.A05.1.454.CMB.1.raw
  modified_base (459)..(459): a, c, t, g, unknown or other
  misc_feature (459)..(459): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccccggacaaaggcttgagtggatggggatggatcgaacgctggcaagtggtaacaacaaaaattcacagaagttccagggcagagtctaccttacgaggacacatccgcgagattactatagtggagcgtgagcagccgtagagtacgtaccgaagacgacggctggtattagtttttgngtacgtactcgtagtggagtcgtattatacgtctactaagtttcgactccgtgggccgacggaccgtggtccacgttcctccgtacg

SEQ ID NO: 261218 - DNA, 548 bp, Homo sapiens
  misc_feature: GYAE6OF02JYWPZ.1.5.A05.1.454.CMB.1.raw
  modified_base (284)..(284): a, c, t, g, unknown or other
  misc_feature (284)..(284): n is a, c, g, or t
  modified_base (398)..(398): a, c, t, g, unknown or other
  misc_feature (398)..(398): n is a, c, g, or t
  modified_base (411)..(411): a, c, t, g, unknown or other
  misc_feature (411)..(411): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccgganaaaggcttgagtggatgggatggatcaacgctggcaatggtaacacaaaaattcacagaagttccagggcagagcacttacagggacacatccgcgaggtatacttatatgganctgagcagctganatccgaagacacggctggtattagttttgcgtcgtaccttgtaggtggtagtcctattacgttacgcttacgtaatttcgaacttccgtacgggacctaacggggtaccctacgggtcctaccgttccttcgtaccg

SEQ ID NO: 261219 - DNA, 364 bp, Homo sapiens
  misc_feature: GYAE6OF02H08O4.1.5.A05.1.454.CMB.1.raw
  modified_base (286)..(287): a, c, t, g, unknown or other
  misc_feature (286)..(287): n is a, c, g, or t
  modified_base (290)..(291): a, c, t, g, unknown or other
  misc_feature (290)..(291): n is a, c, g, or t
  modified_base (293)..(364): a, c, t, g, unknown or other
  misc_feature (293)..(364): n is a, c, g, or t
tcagacgagtgcgtcacgaccggtgctcgatttagatagatagacgagggggcagttccagatttcaactgctcatcagcagcctgcagtctgaagtattttgctagttttattactgtcagcaagtataataactggcctccgacgttcggccaagggaccaaggtgaaaatcaaaacgaactgtcggctgcaaccatctgtcttcattccttcccgctatctagacttcgtactgtccgctgacggcgggtctagggaccgttaaaagggcgcctaaaagtggnnacnncnnnnnnnnnnnnnnnnnnnnnnnnnnnnnnnnnnnnnnnnnnnnnnnnnnnnnnnnnnnnnnnnnnnnnnnn

SEQ ID NO: 261220 - DNA, 833 bp, Homo sapiens
  misc_feature: GYAE6OF02IERBD.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtcgtgggctgaggtgaagagccgtggggcctcagtagagggtttcctgctaacggccttcgaaggtataccaccttcacgtaggtactgtcttatactagttgggtgcgtcccgacggaccccccggaacgaaacggtcgttacggaggtggaacgtgggagtcgggtactacgaacggtctaggaccgtaagttacgggtaaactaaaacgtaaaaaattaccgtaacaacgggttaaacgtttacccggaggggtacccgaaggtaacgttacccgtaacccgttttaacccggacgggtaaaccgactaccgtacccggtaacggtacggttaacgtttaaccgtttaactttacgtaagggtaagtaccggtaggttacgcggtaacgtcccgtagtaacgttaaccgtaacccggaacggaaccggtacggtaccttaggtttaacgttttaacggtttttagccggtaacccgttacgttacggttaacgggttcggtacgttaaccgtacgttttacttaccgtacgtttaaccgtaacgttttccgttacccgttccgggtaaccggggttacccggtaaacccgggttaccccggtttaccggggttaacccctttacccggggttacccgttacccggttaaccccg

SEQ ID NO: 261221 - DNA, 766 bp, Homo sapiens
  misc_feature: GYAE6OF02FSK7V.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctgggctgaggtgaagagcctggggcctcagtgaaggtttcctgcaaggcttcaggatacaccttcactaggtatgctatacattgggtgcgccacggcccccggacaaaggcttgacgtggagtgggatggatcaacgcgtggcaatggtaacaacgaaaaaattcaacaagaacggttaccgaggggtcaggtagtacctaaccgttttaccaacggggtaacaactacgtacccggaccgaagggtaactttaaccttaagttaacgttgggaacgtcgtaggtaacggaccgtaacggcccttacggaagtaacgtacccggtaaacggaacccgtaacgggccctttaggttaacttttaacgttttttacggtacggtaccgtaacccgtttacgtttaacgggtacgggttaacggttacgttaacgttttaacgtttaccggtaccttaaccggttaaagttttaccggtaacccggtttaacccgggttaccgggggtacccggtaaacccgggggttaaccccggttaccggggtttaccccgtaaccccggggtttcccttacccccgtttaaccccgg

SEQ ID NO: 261222 - DNA, 697 bp, Homo sapiens
  misc_feature: GYAE6OF02JVM1F.1.5.A05.1.454.CMB.1.raw
  modified_base (599)..(599): a, c, t, g, unknown or other
  misc_feature (599)..(599): n is a, c, g, or t
  modified_base (605)..(605): a, c, t, g, unknown or other
  misc_feature (605)..(605): n is a, c, g, or t
  modified_base (618)..(618): a, c, t, g, unknown or other
  misc_feature (618)..(618): n is a, c, g, or t
tcagacgagtgcgtcacgaccggtgctcgatttagatagatagacaggggacccaacaaccacatccctcctcagaagcccccagagcacaacgccccaccatggactggacctggagatcctcttttggtggcagcagccacgaggtcgcccactccccaggtcccaggcttgtgcagtcgtggggctgaggtagaagagtccgtggggcctcgagtggtaagggttttcctggaccgtaagggtcttacgaggattaccaccttacacgttaggtatcggacttaatacctagttgggtagccgaccgtacgggacccccggaagaacggtctaggtaggtacggacgtgggagtcggatacgtacgtacgtcgggactaagtacggtaaccgaactaaaacgttcaacgtacgtaagttaccgacggtacaacgtactaccgtaaccgttacgtaagggacctacgacgttccggaacgtaggtaactttaccgtaagtacgtagacgtcgtagacgtacgacgtaccgtagacgtacgtacgaaacgtcgacgtgtaagtctttagtttcgagaccgttctacggtagttacggngttaanacgtttacgtacnctttacgtattaccggacgttaccggtacgggtcccgtaacggtacccgtcggttccctaccggtttccaccggttccg

SEQ ID NO: 261223 - DNA, 841 bp, Homo sapiens
  misc_feature: GYAE6OF02IX7PW.1.5.A05.1.454.CMB.1.raw
  modified_base (232)..(232): a, c, t, g, unknown or other
  misc_feature (232)..(232): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcaggcagccacaggtcgcccactcccaggtccagtcttgtgcagtcgtggggctggaggtgaagacgccgtggggcctcgaggtgtaacggtttccngacaacggtcttacgaggtataccaccttacacgttaggtatgctatacgtagttgggtgcgtccgacggacccccgaagtaaacggtcttagaggttcggagttgggatggactcgaacgtcgtggacctaagtacggtaaaccaaactaaaaacttcgaactaaggtaaccgttaccggaacgggtacaaggtaaccgtttaacctaacccggttttaacccggaacgggtaacctaacctaccggttacccggacggtaacgttaaacgtttaaccgtttaaacgttaggaacggtaacgtacgtacggtaacgtaccgacgtaccggtaagtaaggaaccgttaaccggaaacggtaacccgtaccgggtagttaacgtttaagttttacggtttttacgcggtaaccgttacccggttacgttaacgggtacgggttaacggttaaacccgttagttttaacccgttacgttaacgtttaccgtttaaacggtttacccggtaccggtttaacccgggttaccggggtaacccggttaacccgggtaccccggttaccgggttaaccccgttaccccgggtttacccgtaccccgttaacccgg

SEQ ID NO: 261224 - DNA, 580 bp, Homo sapiens
  misc_feature: GYAE6OF02FYWK8.1.5.A05.1.454.CMB.1.raw
  modified_base (412)..(412): a, c, t, g, unknown or other
  misc_feature (412)..(412): n is a, c, g, or t
  modified_base (562)..(562): a, c, t, g, unknown or other
  misc_feature (562)..(562): n is a, c, g, or t
tcagacgagtgcgtcacgaccggtgctcgatttagatagatagacagggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaagggcttcaggatacaccttcactaggtatgctatacattgggtgcgccaggtcccccggacaaaggcttgagtggatgggatggatcgaacgctaggcaatggtaaacaacaaaaattcaacagaacgttcagggcagagtcactttacgagggacacgactcgacgagtacttacttatatgganctagatcacgcctagagactaccgaagacgacggtctagttacttagtttgtcgtcgtaccttcgtaggtcggtaggttacagtttacgtacgtcgttactaagtttcggtacctaccggttgggacccgacgggtaccctgggttaccncccgttactcccgtaccg

SEQ ID NO: 261225 - DNA, 908 bp, Homo sapiens
  misc_feature: GYAE6OF02HH5WB.1.5.A05.1.454.CMB.1.raw
  modified_base (227)..(227): a, c, t, g, unknown or other
  misc_feature (227)..(227): n is a, c, g, or t
tcagacgagtgcgtcacgaccggtgctcgatttagatagatagacaggggacccaacaaccacatccctcctcagaagcccccagagcacaacgccccaccatggactggacctggatgatcctcttttggtggcagcagccacaggtgcccactcccaggtccagcttgtgcagtcgtggggctgaggtgaagaagcccgtaggggcctgagtggtaaggtttccngcgaaggtcttacgaggataccacctttcacgtaggtatgactatactagttgggtgccgtccgaccggcccccggaacgaaaggcttaggagtgggacgtggggagtggatccgaacgcgtagggacctaagtacgggttaaaaccaaactaaaaaaacgtttccgaaacgtaaaggtaacggttacccggaaggggactacggtaacgttaccgtaacccgttttaaccgaagggtaacctaccaaccgttaccgggaccggtaaggtaacgttttaaccgttaagttaacggtacgggtaacgtacggttacggtaacggaccgtaacgggtacccgttagggaacgtacgttaaacccggaaacgggtaaccgtaacccggggtacttaacgggtttaaacgttttaacggttttttacggtaccgtaacccggttaacccctttacggtttaaaccggggttagggttaaaccgggtttacccgtttaaagtttttaaccggtttaacccgggttaccttttaaacggttaacccgttttttaaggtaaacccccgggttttacccggggttaacccgggggggttaaccccggtaaacccgggggttaaacccccgggtttacccgggggtttaaccccgttaccccggggtttacccccttttaaccccccggg

SEQ ID NO: 261226 - DNA, 785 bp, Homo sapiens
  misc_feature: GYAE6OF02FICSM.1.5.A05.1.454.CMB.1.raw
  modified_base (292)..(292): a, c, t, g, unknown or other
  misc_feature (292)..(292): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtctggggctggaggtagaagagccgtggggcctcagtgaaggtttcctgcaggcttcaggatacaccttcactaggtatgctatacattgggtagcgccgacggaccccccgganaaaggcttaggaggtggagtgggataggataccgaacggcgtcggactaagtaggtaaaacaaactaaaaaaacttccaacgtaaggtaaacgttaccgaacggggtaccgaagtaacgtacctacccgtttaaccggaacgggaaccaaccgtaccgttcccggaacggtaacgggtaaccttttaacgttttaactaaggttacggaagtacccggttagaaaccggtactaacgtacccgttaggtacgtaacgttaaccccggaaaggtaccccgtaacgggttaccgtttagggttaaacgttttacggttttttacggtacggttaccccgttaaccgttttacgttaacgggttaggttacggttacgttaagttttaaacgtttaccgtacttaccggtttaactttcggtaacccgttccggtacgggttcccgtaacgggtaccccgtttggtacccgtacccggttccgttaccctacccgg

SEQ ID NO: 261227 - DNA, 723 bp, Homo sapiens
  misc_feature: GYAE6OF02H7V48.1.5.A05.1.454.CMB.1.raw
tcagacgagtgcgtcacgaccggtgctcgatttagatagatagacaggggacccaacaaccacatcccctcctcagaagcccccagagcacaacgccccaccatggactggacctggaggatcctctttttggtggcagcagccacaggtgcccactcccaggtccagcttgtgcagtcgtggggctgaggtgaagaagccgtggggcctcaggtgtaaggtttcctgacaaggcttcgaggatacaccttcactaggtatgctatactagttggtgcgccgaccggaccccggacgaaacggcttggagtggagtagggagtggatacgaacgcgtaggacgtaagtacggtaaacaaacgtaaaaaattacaaacgtaaggtaaacgttaccggaaggtacaaggtaacgtacctaaccgttaaccgtaggggaaaccaaccgacgtaccggaacggaaggtaacgtttaaccttaaggttacgtaggtacgtacgtacgtagaccgacgacgttggaacggtacgtaaccgaaagaaccgtacggtacgtagttaagtttagttttacggtgtacggtaccgttacgttacggttaggtacggtagttacgttaacgttaccgtacttacgtaagttttccgtaaccgttccggttacggtacccggtaacgggttacccggtaccgttaccccggtacggttacccgtccttaccccgg

SEQ ID NO: 261228 - DNA, 943 bp, Homo sapiens
  misc_feature: GYAE6OF02H8CDY.1.5.A05.1.454.CMB.1.raw
  modified_base (172)..(172): a, c, t, g, unknown or other
  misc_feature (172)..(172): n is a, c, g, or t
tcagacgagtgcgtcacgaccggtgctcgatttagatagatagacagggacccaacaaccacatccctcctcagaagcccccagagcacaaccgccccaccatggactggacctggaggatcctcttttggtggcagcagccacaggtgcccactcccaggtccagcttgtncagtctgggctgaggtgaagaagccgtggggcctcgagtggtaaggtttccgtagactaaacgggtcttcgaagggtaacttaaccgaccctttactaaccgttaaggtaacgttcgtacgttaattaaccgtaacgttttggggttaccggaccggtaccccggtaaccggggaccccccccggtaaaacgaaaaaccggggttccgttttagggaacggttacgggtaacggttaggggtacgttacgggtaacttaaccggtaaccggtaccgttacgggaaccgtaaaggttaacgggtaaaacctaaaaacgttaaaaaaaacgtttccaaaacgtaaacggtaaaccggtttacccgggaacggggtaaccgtaaggtaaccggtttaacccgtaaaccccgttttaaaccggaaacggggtaaccctaaaccgtaacggtacccggtaacgtaaacgggttaaccttttaaaccgtttaaggtaaacggttacgggtaacgtacggtacggtaaccgtaccgtaaacggtcgttaagaaccggttacgtaaacggaacgaaccggttacgtaaccgttagtttaacgtttaggtttttcggccgttaccgtaaccttaggttaacgttacgggtacgttaacgttagtttaacgttaccgtacgtttaacgtacggttacgtacccgtcggggttaaccggacccgttaccgggtaacccgttccgggttacccgtaccggttaccccgttaccgttaccccgg

SEQ ID NO: 261229 - DNA, 686 bp, Homo sapiens
  misc_feature: GYAE6OF02GBBHK.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctgggcctcagtgaaggtttcctgcaaggcttcaggatacaccttcactaggtatgctatacattgggtgcgccacggcccccggacaaacggcttgagtggagtgggatggatcgaacgctggcaagtggtaacaactaaaaattcaacgaagtaacgttaccgagggacgaagtacgtactaaccgtttaccgaacgggtacaaccgacgtaccggaccggtaaggacttttaacgttaacgttaagtacgggtacgtacgttaggaacgacgtacggccgtagaggtacgtaccgaacgaccgacggtacgttagttacgtttagttttacgtacgtaccgtacccttagttacgggttgtaacgggttacttacgtttaattacgttaccttacgttaacgttttacgtaccgttccggttacggggtacccgtaaccgggtaccccgtttcgggtacctaccccggtttccctaccgttacccg

SEQ ID NO: 261230 - DNA, 714 bp, Homo sapiens
  misc_feature: GYAE6OF02GI4YW.1.5.A05.1.454.CMB.1.raw
  modified_base (703)..(703): a, c, t, g, unknown or other
  misc_feature (703)..(703): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtcgtggggctggaggtgaagacgccgtggggcctcgagtgtaaggtttcctgacaggtcttacgaggactacaccttcacgtaggtatgcttaatacagttcggtgccgccgacggcccccggaagaaacggtcgttagaggtaggtacgtgggtacttgggactaccgaacggcgtcggactaagttggtaaaaccaaactaaaaacttcgaaactaacggtaacgttaccggaacggacgtagtaacgtaccttaacctttaacggaacggtaacaccgtacgtaccggacggtaaggtacttttaaccgtaagtacgtaagggtacgtacgtagacggtacgacgtaccgtagaacggtactaaccggaaacgcgtaacggtcttagttagttttagttttcggctacggtaccttggtagtggtaacggttactagtttacgttacctacttaacgtagttttacggacttccgggtacggacccgtaacgggtaccccttggtaccgtacccggtttaccncccgttacccg

SEQ ID NO: 261231 - DNA, 700 bp, Homo sapiens
  misc_feature: GYAE6OF02GDJQX.1.5.A05.1.454.CMB.1.raw
  modified_base (241)..(241): a, c, t, g, unknown or other
  misc_feature (241)..(241): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctggaggtgaagagcctggggcctcgagtgaaggtttcctgcaggcttcgagactacnccttcacgtaggtatgctatactagttgggtcgcgccgacggcccccggacaaacggtcttgagtggagtgggtatggatcgaacgcgtaggcaagtaggtaaacaaacgtaaaaattcaaacgtaaggtaaacgttccgaagggacaggtacgtacctaacccgtttaccgacgggtaaccacgacgtaccggacggaaggtactttaacttaagtagtgggaagtcgtagacgtacgacgtaccgtaggaacgtacgtaccgaacgtaaccgacgggtcttacggtttaatttacgtttttcggtcggtacccgtaccgttacggttacggttaggtacggttacttatttacgttaccgtacttacgttaagtttacggaccgttcccggtacggggtacccggtaaccggggttacccgtacgggtaccctacccggttccctaccgttaacccg

SEQ ID NO: 261232 - DNA, 742 bp, Homo sapiens
  misc_feature: GYAE6OF02HTWFL.1.5.A05.1.454.CMB.1.raw
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
  modified_base (240)..(240): a, c, t, g, unknown or other
  misc_feature (240)..(240): n is a, c, g, or t
  modified_base (288)..(288): a, c, t, g, unknown or other
  misc_feature (288)..(288): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtcgtggggctgaggtgaagagccgtggggcctcgagtgagtttccngcaaggcttnaggatacnccttcactaggtatgactatacagttggtgcgccgacggcccccgganaaacggcttgagtggagtgggatggatacgacgtcgtggactaagtacggtaaacaactaaaaacgttcaacgaagtaacgtaccgacgggacaggtacgtacctaaccgtttaccggaaggaccaactacgtccgacggaacgttactttaacgtagttacgttaggtaacgccgtagacgacgacggtccgtaggtacgtaaccgttaccgggaaacgtaaccggacggttcgttaaggtttacgtttttacggtttttaggacggttacccgttaaccgttaacgggtttagggttacgggtaacggttacgtttaacgtttaacggtttaaccgttcgttaaccgtttaacgttttacggttaacccggttcccggtaccggggttacccgtaacggggttaccccgtacgggtttacccgtacccggttcccgtacccgttaaccccgg

SEQ ID NO: 261233 - DNA, 308 bp, Homo sapiens
  misc_feature: GYAE6OF02JFR2U.1.5.A05.1.454.CMB.1.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
  modified_base (256)..(256): a, c, t, g, unknown or other
  misc_feature (256)..(256): n is a, c, g, or t
  modified_base (263)..(263): a, c, t, g, unknown or other
  misc_feature (263)..(263): n is a, c, g, or t
  modified_base (267)..(308): a, c, t, g, unknown or other
  misc_feature (267)..(308): n is a, c, g, or t
tcagacgagtgcgtcacgaccggtgctcgatttagatagatagacagggggcagttccagatttcaactgctcatcagcagcctgcagtctgaagtattttgctagttttattactgtcagcagtataataactggcctccgacgttcgccgaaggaccaaggtgaaatacaaacgactgtggctgcacatctgtcttnatccttcccgcatctgatcgtactgcnctagaggtccggcgtggacgaacggccganatagcanccgnnnnnnnnnnnnnnnnnnnnnnnnnnnnnnnnnnnnnnnnnn

SEQ ID NO: 261234 - DNA, 725 bp, Homo sapiens
  misc_feature: GYAE6OF02HPEG8.1.5.A05.1.454.CMB.1.raw
  modified_base (292)..(292): a, c, t, g, unknown or other
  misc_feature (292)..(292): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgtaaggtttcctgacaaggcttcgaggatacaccttcactaggtatgctatactattgggtgcgccacggaccccccgganaaaggcttggagtaggatgggatggataccgaaccctggacaagtagggtaaacaactaaaaattaccaacgaagtaacgttaccgaggggacgtaggaacgtacctaacccgtttaaccgacgggaacacgtactcccgacggagtaacgtttaacttatagttgggaatcgtagagacacgtccgtagagagtaccgaagacgacggctgttaacgtttagttttcgtacgtaccgtacccttacgttaggttacggggtaacggttacttaacgtttaacgttttacccggtactttaccgttaaacgttttttcggaacccgttttcccgggggttaaccgggggtaccccgggttaacccgggggtaaccccgttacgggtacccttaaccccgggtttaccccttaccccgttaccgtacccccggg

SEQ ID NO: 261235 - DNA, 696 bp, Homo sapiens
  misc_feature: GYAE6OF02GAABE.1.5.A05.1.454.CMB.1.raw
  modified_base (78)..(78): a, c, t, g, unknown or other
  misc_feature (78)..(78): n is a, c, g, or t
  modified_base (222)..(222): a, c, t, g, unknown or other
  misc_feature (222)..(222): n is a, c, g, or t
  modified_base (253)..(253): a, c, t, g, unknown or other
  misc_feature (253)..(253): n is a, c, g, or t
  modified_base (479)..(479): a, c, t, g, unknown or other
  misc_feature (479)..(479): n is a, c, g, or t
tcagacgagtgcgtcacgaccggtgctcgatttagatagatagacaggggacccaacaaccacatccctcctcagaancccccagagcacaacgccccaccatggactggacctggaggatcctctttttggtggcagcagccacaggtgcccactcccaggtccagcttgtgcagtcgtggggctgaggtgaagagccgtgggcctcagtgaaggtttccngcaaggcttcgagactacaccttcactaggntgactatactattgggtcgcgaccgacggccccccggaacgaaaggtccgttagagtggagtgggagtggagtaccgaacggtcgtaggactaagttacggtaaaccaaacgtaaaaaacttcaaacgaagtaacgtaccgagggacaagacgtacctaaccgtttaccgacggacaacacgtacccgagtaacgtatttaaccttagtagtacggagttccgagnggaacgtacgtaccgtacgaacgtacgtaacccgaaacggaccgacggtaccttaggtttaatttcgttttaggtcgtaccgtaccgttacgttacgggttaggtacgttacgtaagtttacgttacgtccttaacgttagtttaccgtaccggttcccggtcgggaacccgttacgggtaaccccgttggtcccgtaccgttcccgttacctaccg

SEQ ID NO: 261236 - DNA, 773 bp, Homo sapiens
  misc_feature: GYAE6OF02HKHB1.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccgacaggtgcccactcccaggtccagcttgtgcagtctgggctgaggtgaagaagccgtggggcctcgagtagtaaggtttcctgcaaggtcttcgaggataccaccttacactaggtatgtctatacgtattgggtgcgtaccacggaccccccggtaagaaggtcgttacgaggtggtagtcgggaagtcgggaataccgaaacggtcgtacggtactaaagtacggtaaaccaaacgtaaaaaaacttccgaacgtaagaaacgtttacccgaaggggtacgaaggtaacgttacccgtaaacccgttttaacccggaaacggggacaacctacgttacccggacgtaacgggtaatttaccgttaaagttaaggtacgggtaactacgttaggaacgtaccgtaacggccgttacggaaaggttacctaccgggtaaaacggacccgtaacgggtacttacggtttaaagtttccgttttttaagtacgtacccgtacgttcgttaacgtacgggtaaggtaccttaagtttacgtaccggtctttacggtaaattcgtaaccgttcccggtacgggaccgtaacgggtacccgttcggtaaccgtcccggttaccttcctacccgg

SEQ ID NO: 261237 - DNA, 713 bp, Homo sapiens
  misc_feature: GYAE6OF02F5K1I.1.5.A05.1.454.CMB.1.raw
  modified_base (369)..(369): a, c, t, g, unknown or other
  misc_feature (369)..(369): n is a, c, g, or t
tcagacgagtgcgtcacgaccggtgctcgatttagatagatagacaggggacccaacaaccacatccctcctcagaagcccccagagcacaacgccccaccatggactggacctggatgatcctctttttggtggcagcagccacaggtgcccactcccaggtccagcttgtgcagtctggggctggaggtgaagagcctgggcctcgagtgaaggtttccctgacaaggcttcaggatacaccttcactaggtatgctatacatttgggtgcgccacggacccccggacgaaaacggcttacgagtggagtgggatggatcgaacgctggcaatgtaacacaaaaattcacaagaagttccaggcagngtactacctttaaccgagggtacaacgactaccgacgtagggtactttacttaattaacgtagggaagtcctaggtacggacgtacggccgttacggaacgtacgtacccggtaaacggtaccgtaccggtaccgttacggtttaacgtttagttttttagggttacgtaccgttaacccgtttcgttaacggttacgggtaacggttacgttacttaagttttaccggtacctttacttaacggttttaccgtaaccgttacccgggtttacggggtacccgggtaaccgggttaacccccggtacggggtttaccccgtacccggttacccgtttaaccccg

SEQ ID NO: 261238 - DNA, 954 bp, Homo sapiens
  misc_feature: GYAE6OF02H4DFY.1.5.A05.1.454.CMB.1.raw
  modified_base (207)..(207): a, c, t, g, unknown or other
  misc_feature (207)..(207): n is a, c, g, or t
  modified_base (221)..(221): a, c, t, g, unknown or other
  misc_feature (221)..(221): n is a, c, g, or t
tcagacgagtgcgtcacgaccggtgctcgatttagatagatagacaggggacccaacaaccacatccctcctcagaacgcccccagagcacaaccgccccaccatggactggacctggaggatcctcttttggtggcagcagccacaggtcgcccactcccaggtccagcttgtgcagtctgggctgaggtgagaagcctgggcctnagtgaaggtttccngcgaaggtcttacgaggtactacaccttcaacgtaggtatgactatactagttgggtcgcgccgaccggacccccggaagtaaacggtcgttaggaggtacggagtgggagttacggactacgaacgcgtacgggactaaggtacgggaaacctaaagtaaaaaacgttcaaactaacggtaaacgttcccggaaaggtcggaacggtacgtacccttaacccgtttaaacgacggggtaactaaccgtacgttacccggaacgggtaacggtaacttttaaccggttaagttaacggtacgggtacgtacggtacgggagtacccgtaacggtacccgttaacgggaacggttaacccggttaaacccgggaaacggtaaacccccggttaaccgggtaccggtttaaacgggtttaaattttttaaccgggtttttttcgggtaacccgtttaaacccgggttacccgttttaacccgggttttaaggggttaaccgggggtttaacgttaaaccccggttttaagtttaaaccccggtttttaacgggtacccgttttttaaacccgggttaaacgtttttaccccggggtttaaaccgtacccccgggggttttttaaaccggggggacccccggttaaaccccggggggtttaaccccggtttaaccggggtttaccccccgtttaaaccccgggtttttccccccgtacccgttttaaccccccggg

SEQ ID NO: 261239 - DNA, 710 bp, Homo sapiens
  misc_feature: GYAE6OF02IHC7G.1.5.A05.1.454.CMB.1.raw
  modified_base (227)..(227): a, c, t, g, unknown or other
  misc_feature (227)..(227): n is a, c, g, or t
  modified_base (256)..(256): a, c, t, g, unknown or other
  misc_feature (256)..(256): n is a, c, g, or t
  modified_base (504)..(504): a, c, t, g, unknown or other
  misc_feature (504)..(504): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtcgcccactcccaggtccagcttgtgcagtctggggctggaggtgaagagccgtggggcctcaggtggtaaggtttccngacaagggccttcgaggataccaccttanacgttagtatgacttatactagttgggtgcgccacgggcccccggaagaaacggcgttagaggtggagtagggattagggatacgaacgcgtggacgtaagttacggaaaacaacgtaaaaaacttcgaacgtaacggtaaacgtccgtaacgggcgaacggtacggtaccctaaccgttttaccggaacggtaaccgaacgtaacgttaccggacggaaggttacttaacgtttaaggtatacgggngcttaggaacgtcgaacggtccgtagaccgaacgttaccgaaacgaacgacggcttaacggttagtttacgttttagtcggtaccgttacgttcgtacgtgggtaggtactagtttacgtacgtaccttactaacgttccgtacggttccgttacgggcccgtaacggtaacccggtcgtaccggtaccgttccgtacctacccgg

SEQ ID NO: 261240 - DNA, 687 bp, Homo sapiens
  misc_feature: GYAE6OF02H8TNX.1.5.A05.1.454.CMB.1.raw
  modified_base (256)..(256): a, c, t, g, unknown or other
  misc_feature (256)..(256): n is a, c, g, or t
  modified_base (293)..(293): a, c, t, g, unknown or other
  misc_feature (293)..(293): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagccttgtgcagtcgtggggctgaggtgaagaagcctggggcctcgagtgaagtttcctgcaaggcttcaggatacaccttcactaaggtntgactatacattgggtgccggccacggcccccggaanaaaggtcttggagtagagtaggagtcggagtctaacgcgtacggagtaataggtaacgaaacaaaaacttacaaccgtaagaacgttaccgaggtacagagtacctaaccgttaaccgtacgggacctaacactacccggtacgtacggtaacttaacgtttaacgtagttagggactacgtcggagaccgtacggtacctaggtaacgaacgtacccgaaaggtacccgaagtccgttagttaacgtttagtttttaggacgtccgtaaccttagttacgtacgggagttaccgttattaccgttacgtccttacgtcgtttacgtaccgtaccggtacgggtacccggtacggacccgttacggtcccgtaccggttcccttccgtaacccg

SEQ ID NO: 261241 - DNA, 586 bp, Homo sapiens
  misc_feature: GYAE6OF02GNPAP.1.5.A05.1.454.CMB.1.raw
  modified_base (220)..(220): a, c, t, g, unknown or other
  misc_feature (220)..(220): n is a, c, g, or t
  modified_base (282)..(282): a, c, t, g, unknown or other
  misc_feature (282)..(282): n is a, c, g, or t
  modified_base (468)..(468): a, c, t, g, unknown or other
  misc_feature (468)..(468): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttccngcaaggcttcaggatacaccttcactaggtatgctatacattgggtgcgccaggcccccganaaaggcttgagtggatgggatggatcgaacgcgtaggcaatggtaaacaactaaaaattcaacaagaagttccaggggcagatcacttacgagggacacatccgcgagtattacttatatggatcgtgacgcgacgccgtgaacgtactaccggaagaccgacggtcttagttatttagttttcgngtaccgtacgttcgtaggtcggtaggtactagttattaccgacttacgttaatttcgaccttccggtacggggtccctaacggggtaccctgggttaccaccgttccctccgtacccg

SEQ ID NO: 261242 - DNA, 785 bp, Homo sapiens
  misc_feature: GYAE6OF02HJOYV.1.5.A05.1.454.CMB.1.raw
  modified_base (270)..(270): a, c, t, g, unknown or other
  misc_feature (270)..(270): n is a, c, g, or t
  modified_base (290)..(290): a, c, t, g, unknown or other
  misc_feature (290)..(290): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagccgtggggcctcagtgaaggtttcctgcaaggcttcaggatacaccttcactaggtatgctatacagttgggngcgccgacggccccccgganaaaggccttggagtggagtgggatggatcgaacgcgtgggactaagtcggtaaacaaactaaaaaattccgaacgtaaggtaaacggttaccgaaggggtactaaggaacgttacctaacccgtttaccgaaggggtaaccaacgtacgtaccggacggtaacggtaactttaaccgtttaagtacgtttagggacgtcgttaggagtacgtacggtaccctagggaacgtacgttaccgggaaacgtaccggaccgggtactttaggttaagttttacgttttttagggtacggtaccgttaacccgtttcggttaaacgggttcggggttaacggttaacgttaagttttaaaccgttacggttaaccctttcggtttaaacttttccggaaccttttaccccgggcgggggtttaaccccgaacgggggtttaacccccgttcggggttaaccccggttaccccggtttacccgttaccccgttaaccccgg

SEQ ID NO: 261243 - DNA, 788 bp, Homo sapiens
  misc_feature: GYAE6OF02II8Z2.1.5.A05.1.454.CMB.1.raw
  modified_base (222)..(222): a, c, t, g, unknown or other
  misc_feature (222)..(222): n is a, c, g, or t
  modified_base (287)..(287): a, c, t, g, unknown or other
  misc_feature (287)..(287): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttccngcaaggtcttcaggatacaccttcactaggtatgctatacattgggtgcgccacggcccccgganaaaggcttgagtggagtggggatgggatcgaacgcgtaggcaagtacggtaacaaactaaaaaattcaacagaaacgttccgaagggacaagtacgtacctaaccgttttaacccgagggtaaccaacgtacgtacccgacgggtaagggtaacttttaaccgtttaagtaagtacgggaacgtcttaggaacggtaccaacgggtacccgtagggaacgttaacgtaacccggaaaggtaacccgacgggtaccgttaggtttaaagttttaacgttttttcggttacggtaacccgttacccgtttaccggtaagggtttacgggtaacggtttaacctaacgtttttaagttacccggtacctttaaccgtttaaacgttttttaccggtaccggttttaaccccgggttacgggggttacccccggtaaaccgggggttaacccccgttcgggggtttaacccctaaccccggtttccccgttaccccgttacccgg

SEQ ID NO: 261244 - DNA, 753 bp, Homo sapiens
  misc_feature: GYAE6OF02JFKGH.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtcgtggggctgaggtgaagagcctggggcctcagtgaaggtttcctgcaaggcttacgaggataccaccttcacgtaggtatgctatacattgggtgcgccacggcccccggacaaaggtcttggagtggagtgggatggatacgaacgcgtggacaagtacgggtaaacaacgtaaaaaaactttcaacgtaacgtaacgttaccgaaggggaccaggacgttaccgtaacccgttttaaccgaaggggtaaccctaacgaacgtacccggtacggtaacgggtacttttacgttaattaacgttggaacgtcgtagaggacgtacggccgttaggaagtaacgtaccggaaacggtaccgacgggtaccgttagtttaacgtttagttttttaggtacgtaccgttaccgttacgttaacgggttgggtaacgggttacttaacgttttacgtttaccgtcgttacgtttaaacgttttacggtacccgttaccgggttccggggtaacccggttaaccggggttaaccccgttccgggttacccgaaccccgttttccgtacccgttacccgg

SEQ ID NO: 261245 - DNA, 184 bp, Homo sapiens
  misc_feature: GYAE6OF02F1SDG.1.5.A05.1.454.CMB.1.raw
  modified_base (178)..(184): a, c, t, g, unknown or other
  misc_feature (178)..(184): n is a, c, g, or t
tcagacgagtgcgtcacgaccggtgctcgatttagatagatagacagggcaccaagggcccatcggtcttcccctggcaccctcctccaagagcacctctgggggcacagcggccctgggctgcctggtcaaggactacttccagtactctatctgagcggctggcaaggcgcatagnnnnnnn

SEQ ID NO: 261246 - DNA, 590 bp, Homo sapiens
  misc_feature: GYAE6OF02HK6I6.1.5.A05.1.454.CMB.1.raw
  modified_base (220)..(220): a, c, t, g, unknown or other
  misc_feature (220)..(220): n is a, c, g, or t
  modified_base (396)..(396): a, c, t, g, unknown or other
  misc_feature (396)..(396): n is a, c, g, or t
  modified_base (479)..(479): a, c, t, g, unknown or other
  misc_feature (479)..(479): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttccngcaaggcttcaggatacaccttcactaggtatgctatacattgggtgcgccaggccccccggacaaaacggcttggagtggagtggggatgggatcaacgctggacaagtggtaaacaactaaaaaattcaacagaagttaccagggacagatcacctttacgaggacacatccgngacggattacttatatggagctgagcaggcctaggagactacgaagaccgacgtctagtattagttttggtcgtacgtacctnttaggtggtagtcgttaattagttaccgtcgttacttaatttcggaacttccggtacggggtccctacggggtaccccttagggtaccctacccgttcgtccccgtacccg

SEQ ID NO: 261247 - DNA, 256 bp, Homo sapiens
  misc_feature: GYAE6OF02H3CTH.1.5.A05.1.454.CMB.1.raw
  modified_base (249)..(256): a, c, t, g, unknown or other
  misc_feature (249)..(256): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgcatctgatcgtatgcgctgacgcggctggcaaggcgcatagnnnnnnnn

SEQ ID NO: 261248 - DNA, 730 bp, Homo sapiens
  misc_feature: GYAE6OF02JKKS7.1.5.A05.1.454.CMB.1.raw
  modified_base (253)..(253): a, c, t, g, unknown or other
  misc_feature (253)..(253): n is a, c, g, or t
  modified_base (272)..(272): a, c, t, g, unknown or other
  misc_feature (272)..(272): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttcctgacaggcttacaggactacaccttcactaggtntgctatactagttgggtcnccggccacgggaccccccggaacaaacgggtccttaggaacggttggagtcggggaattggtactacgtaacggcttacgggactaagtagggtaaaccaaacgtaaaaaactttccaacgaacggtaaacgttccggaaggggtacacggtacgtactaacccgtttaacgaacggggaactactacgtccggaacgtaggtactttaacgttaatagtacgggtaactcgtagacggacctaacggtcccgtaggtaacgtacggttaacccgaaacggtaccggtaaccggtacttagggttaacctttaggtttttacggtcgtaacccgtacgttacgttacgggttaggtacgtacttacgtttaacgttaccgtcgttaacgttaagtttacgaaccgttccggtaccggaccggtacggtaccgtacggtcctaccgttctacccgtacg

SEQ ID NO: 261249 - DNA, 716 bp, Homo sapiens
  misc_feature: GYAE6OF02HMC2X.1.5.A05.1.454.CMB.1.raw
  modified_base (125)..(125): a, c, t, g, unknown or other
  misc_feature (125)..(125): n is a, c, g, or t
  modified_base (273)..(273): a, c, t, g, unknown or other
  misc_feature (273)..(273): n is a, c, g, or t
  modified_base (387)..(387): a, c, t, g, unknown or other
  misc_feature (387)..(387): n is a, c, g, or t
tcagacgagtgcgtcacgaccggtgctcgatttagatagatagacaggggacccaacaaccacatccctcctcagaacgccccagagcacaacgccccaccatggactggacctggaggatcctntttttggtggcagcagccacaggtcgcccactccaggtccagcttgtgacagtcgtggggctggaggtgaaagaagcccgtggggcctcgaggtagtaagggtttcctggacgaaggtcttcgaaggactacaccttcacgtaggtancgtactatacgtagttggtgcgcgacggccccggaacgtaaaggcttaggacgttaggacgtgggactggatacaacgcgtagacgtaagtggaacaacgtaaaaaattcgaanaagtaacgttacgagggacaggtacgtactaaccgtttaaccgaggaaccgactagtaccgagaacgggtaactttaacgttaatacggttaggacgtagtcggtaagtcggaacgtcctaggtaagtaacgttaccggaaacgacgtaaccgggtacttacggtaactttaagtttttcgtacggccgttaccgttcgtaacgggttagggtacgttaacgttaacgttacgttacgtacgttactaaacggtttaggtacctccgggtttacggacccggtaacgggtaacccggttagttacccggaccttacgttacctacccgg

SEQ ID NO: 261250 - DNA, 778 bp, Homo sapiens
  misc_feature: GYAE6OF02H63D9.1.5.A05.1.454.CMB.1.raw
  modified_base (135)..(135): a, c, t, g, unknown or other
  misc_feature (135)..(135): n is a, c, g, or t
  modified_base (192)..(192): a, c, t, g, unknown or other
  misc_feature (192)..(192): n is a, c, g, or t
  modified_base (207)..(207): a, c, t, g, unknown or other
  misc_feature (207)..(207): n is a, c, g, or t
  modified_base (382)..(382): a, c, t, g, unknown or other
  misc_feature (382)..(382): n is a, c, g, or t
  modified_base (442)..(442): a, c, t, g, unknown or other
  misc_feature (442)..(442): n is a, c, g, or t
tcagacgagtgcgtcacgaccggtgctcgatttagatagatagacaggggacccaacaaccacatccctcctcagaacgccccagagcacaacgcccacatggacctggacctggaggactccgtctttttaggnggcagctaggccctagcggtcgcccacgtcccgaggtccagtcttgtacgcagtcgnggggtactgacggtnacgagccgttagggcctagaggtcgtaacggtttccagactaacggctttagacgggtaactaccgtccgtttacgaacgtagggtatcggtacctagttaccggttagttcgggtacggccggtacgtaaccgggacccccggtaaggtaacggtcgttacggtacggtacggnggttacggagtacggtactacgaggtcgtacgggtaactagtacggtaacaaacgttaanacgtacaacggtacttcggaacgggtccagacttaccgaacgtttacgacggtacacgtacgtacggtacgtacgttagtaccgttagtacgttacggaagtaccgtgggaacgtacctacggtaccgtagaccggtaacgtaccgaacggacttacgggtattacggttactttacgggttactacgtaccggttacctacgttacgggtacgtaacgggttataaccggttacgttaccgtacgtttacctaacgttaccgtacggtccggttaaccgggtccgtaaccgggttccgttacgggtacccggtacgttcccggttagtaccccgg

SEQ ID NO: 261251 - DNA, 701 bp, Homo sapiens
  misc_feature: GYAE6OF02F2T7C.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggactacaccttcactaggtatgctatacattgggtgcgtccaggcccccggacaaaggcttgagtggatcggggatgggatcgaacgtcgtggtcaagtgggtaaaccaacgtaaaaaattcgaacaagtaagttacccgaaggggccaaggacgttaccgaaccttttaacccgaaggggacctaaccgacgtacccggcggaacggtaagtttaacgtttaactagtacgggtagtcgtaggtagcgtaagcccgtagaggacttccggaaacgtaccgacggtacgttacgtaattacgtttttaggtgtaccggtacttaccgtttagtagggtacggttactacgtttagttaccggtacctttacgtaacgttttcgtaacgtttccccggtaggggttacccgtacggggtaaccccgttcgggttacccgtaccccggttacccgttcccttaacccggg

SEQ ID NO: 261252 - DNA, 594 bp, Homo sapiens
  misc_feature: GYAE6OF02GX4CE.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccccggacaaaggcttgagtggagtgggatggatcgaacgcgtggcaagtggtaaacaacaaaaattccaacaagtaacgttaccgagggacagacgtacacctttaccgaggtacacactccgcgaggacttacttatactggagtctgagcagcctagacgactaccgaagacgacggctagtatttagttttgtacgtacgtaccgttgttagtcggtagtactagtttactacgtacttactaagtttacgtacgttccgtacgggacctacggggtaaccctcgggtacctccggttcctacccgtaccgg

SEQ ID NO: 261253 - DNA, 661 bp, Homo sapiens
  misc_feature: GYAE6OF02GL69L.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcaggtgaaggttttcctgcaggcttcaggataccacttcactaggtatgctatacattggtgcgccaggcccccggacgaaaggcgttgagtggatgggactggatcaacgcgtggcaagtaggtaacaactaaaaaacttccaacgaagaaacgtttccgaagggtacagaagtaccgaaccgtttacgaacgggaacaacgtactcccgacgaaggtacttaacgttaattagtaggacgcttaggagtacagaccgtgaagtactacggaaagacgtacggactttaggtaactttgttttaggtgtaccgtaccgttaccgtagttacggtacggttactagttacgttacgtacgttacctaaacggtttcggtaaccttccggttcgggacccggttaacggggtaacccgttagggtaccccggtccggttacctcccgtaccccgg

SEQ ID NO: 261254 - DNA, 670 bp, Homo sapiens
  misc_feature: GYAE6OF02F9W1L.1.5.A05.1.454.CMB.1.raw
  modified_base (220)..(220): a, c, t, g, unknown or other
  misc_feature (220)..(220): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttccngcaaggcttcaggactacaccttcactaggtatgctatacattgggtgcgccaggcccccggacaaacggcttgagtcggagtgggatggatcaacggctgggcaatcggtaacaacgaaaaaatttcaacgtagaagttaccgagggacagagtcacctttaccgaggacacatccgcgaagattactatatggagtctgacgcgagcctgacgagtaccgaacgacgaccggtactaggttaacttagtttttcggtacggtcccgttaaacccgttacgttaacgggttacgggtaacgggttactaacgttttacgtttaccgtaccgttaccgtaaacggttttacgtaaacccgtttccccggtagggggtaccccggtaacgggtaacccccggtttcgggttacccgttaaccccgggttcccttaccccggttaacccggg

SEQ ID NO: 261255 - DNA, 533 bp, Homo sapiens
  misc_feature: GYAE6OF02F83VQ.1.5.A05.1.454.CMB.1.raw
  modified_base (344)..(344): a, c, t, g, unknown or other
  misc_feature (344)..(344): n is a, c, g, or t
  modified_base (457)..(457): a, c, t, g, unknown or other
  misc_feature (457)..(457): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggccccccggacaaaggcttgagtggatgggatggatcaacgctggcaatggtaacacaaaaaattcaanagaagttccagggcagagtcacctttaccgagggacacatccgcgaggattacttatatggagctgagcagcctgagatccgaagacacggctgtattattttgtgcgacctntagtggagtcattattacgctctaatttcgacttccgtgggaccacgggtaaccctggtccaccgttctacctccg

SEQ ID NO: 261256 - DNA, 827 bp, Homo sapiens
  misc_feature: GYAE6OF02F94UO.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctggaggtagaagagccgtggggcctcgaggtgtaagggtttcctgcgtaaggccttacgaggtactaccgacctttacacgttaggtatggcttaatactagttgggtcgcgccgtacgggccccccggaagaaacgggtccgtttaggacggtagggtacggtgggggtacgtagggtaactaccgaaaccggtcgtacgggactaaggtacggtaaacgaaaacgttaaaaaacttccaaacgttaggtaaacgttaccgggaacgggtacgaacggtacgtttaccctaaccggtttttaaccggaacgggtaaccaacgtacggtaccccggacgggtaaaggttactttaacgttaacgtacggttagggaacgtcgttagtacggaccgtacggtccgttaaggaacggttaactacccgggaaacaccggtaagggttcctttacggttaagtttttacggtttaggtcgtacccggtttaaccgtagtttagggtacgggttaacgtcttaacgtttaacgttactccgtttaacttaacggttaccgtaaccgggttcccgggtaacggggtcccggttaacggggtacccctttacggggttacccctaccggtttaccccgtcctaacccggg

SEQ ID NO: 261257 - DNA, 630 bp, Homo sapiens
  misc_feature: GYAE6OF02FWWBG.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcgagtggaaggtttcctgcaaggcttcaggatacaccttcacgtaggtatgctatacattgggtgccgccgacggccccccggaacgaaacggcttggagtggagtcgggatggatcgaacgctggacaatggtaaaccaacaaaaaacttcaacgaagtaacgttaccgaagggcagacgtctaacctttaccgagggtaccaacacgtccgacgaggtacttacttagtacgttaggagtcttagacgcacgtacctgaagaacgtcgaaagacgacggtactagttatttaagttttgtagccgtaccgttacgttaggttagggaggttactatttacgttacgtacttacgttaatttcgaccgttccggtagggaccgtaccggtaccgtcggttaccgcccgttcctccgttacccg

SEQ ID NO: 261258 - DNA, 462 bp, Homo sapiens
  misc_feature: GYAE6OF02FNWBR.1.5.A05.1.454.CMB.1.raw
  modified_base (251)..(253): a, c, t, g, unknown or other
  misc_feature (251)..(253): n is a, c, g, or t
  modified_base (256)..(256): a, c, t, g, unknown or other
  misc_feature (256)..(256): n is a, c, g, or t
  modified_base (265)..(265): a, c, t, g, unknown or other
  misc_feature (265)..(265): n is a, c, g, or t
  modified_base (272)..(272): a, c, t, g, unknown or other
  misc_feature (272)..(272): n is a, c, g, or t
  modified_base (274)..(275): a, c, t, g, unknown or other
  misc_feature (274)..(275): n is a, c, g, or t
  modified_base (277)..(278): a, c, t, g, unknown or other
  misc_feature (277)..(278): n is a, c, g, or t
  modified_base (280)..(280): a, c, t, g, unknown or other
  misc_feature (280)..(280): n is a, c, g, or t
  modified_base (289)..(289): a, c, t, g, unknown or other
  misc_feature (289)..(289): n is a, c, g, or t
  modified_base (291)..(291): a, c, t, g, unknown or other
  misc_feature (291)..(291): n is a, c, g, or t
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
  modified_base (310)..(310): a, c, t, g, unknown or other
  misc_feature (310)..(310): n is a, c, g, or t
  modified_base (347)..(347): a, c, t, g, unknown or other
  misc_feature (347)..(347): n is a, c, g, or t
  modified_base (360)..(360): a, c, t, g, unknown or other
  misc_feature (360)..(360): n is a, c, g, or t
  modified_base (362)..(362): a, c, t, g, unknown or other
  misc_feature (362)..(362): n is a, c, g, or t
  modified_base (374)..(374): a, c, t, g, unknown or other
  misc_feature (374)..(374): n is a, c, g, or t
  modified_base (389)..(389): a, c, t, g, unknown or other
  misc_feature (389)..(389): n is a, c, g, or t
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
  modified_base (402)..(402): a, c, t, g, unknown or other
  misc_feature (402)..(402): n is a, c, g, or t
  modified_base (404)..(404): a, c, t, g, unknown or other
  misc_feature (404)..(404): n is a, c, g, or t
  modified_base (414)..(414): a, c, t, g, unknown or other
  misc_feature (414)..(414): n is a, c, g, or t
  modified_base (437)..(437): a, c, t, g, unknown or other
  misc_feature (437)..(437): n is a, c, g, or t
  modified_base (460)..(460): a, c, t, g, unknown or other
  misc_feature (460)..(460): n is a, c, g, or t
tcagacgagtgcgtcacgaccggtgctcgatttagatagatagacaggggcgagttccagatttcaactgctcatcagcagcctgcagtctgaagattttgcagtttattactgtcagcagtataataactggcctcgacgttcggccaagggaccaaggtggaaatcaaacgaactgtggctgcgaccatctgtcttcgatcttcccgcatctgatcgtactgcgctgagcggctggcaaggcgcatagnnngangcagcagcnctgacgngnngnngncatacacangngngananatcgtacgtganacgtacgtacgtagagtacgacgtacgtctcacacancgtacgatacgananagagacgacgtntacgagtacgagtanancganacganananacgcgacacnctcgtactgatcgcgcgacacgnacacactacgtacgagcacgacncg

SEQ ID NO: 261259 - DNA, 699 bp, Homo sapiens
  misc_feature: GYAE6OF02JKW2T.1.5.A05.1.454.CMB.1.raw
  modified_base (220)..(220): a, c, t, g, unknown or other
  misc_feature (220)..(220): n is a, c, g, or t
  modified_base (253)..(253): a, c, t, g, unknown or other
  misc_feature (253)..(253): n is a, c, g, or t
  modified_base (289)..(289): a, c, t, g, unknown or other
  misc_feature (289)..(289): n is a, c, g, or t
  modified_base (591)..(591): a, c, t, g, unknown or other
  misc_feature (591)..(591): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctggggcctcagtgaaggtttccngcaaggtcttcaggatacaccttcacgtaggtntgctatacagttgggtgcgtccgacggcccccgganaaacggtcttggagtggatgggactaggatcgaacgctaggacaagtaggtaaacaactaaaaaattcaaccgtagtaaacgttccgaaggggtacaagtacgtacctaacctttaaccgaacgggacaactacgtccggacgaaggttaacttacttaagtagtacggtagtacttaggaagacgtacggcctaggacgtacgtaaccggaaacgacgacggtacctaggttaactttagtttttgacggtccgttaaccgttagtacgggttaggtacgttacgtagtttaacttacgtntaaccgttaaggttttacgaccggtttacccggtacggggtaacccgtaacccggggtaacccggttccggttaaccgtaccccgggtttcctaccccgttaacccgg

SEQ ID NO: 261260 - DNA, 704 bp, Homo sapiens
  misc_feature: GYAE6OF02JRFA7.1.5.A05.1.454.CMB.1.raw
  modified_base (211)..(211): a, c, t, g, unknown or other
  misc_feature (211)..(211): n is a, c, g, or t
  modified_base (344)..(344): a, c, t, g, unknown or other
  misc_feature (344)..(344): n is a, c, g, or t
  modified_base (473)..(473): a, c, t, g, unknown or other
  misc_feature (473)..(473): n is a, c, g, or t
  modified_base (518)..(518): a, c, t, g, unknown or other
  misc_feature (518)..(518): n is a, c, g, or t
  modified_base (532)..(532): a, c, t, g, unknown or other
  misc_feature (532)..(532): n is a, c, g, or t
tcagacgagtgcgtcacgaccggtgctcgatttagatagatagacaggggacccaacaaccacatccctcctcagaagccccagagcacaacgcccaccatggactggacctggaggatcctcttttggtggcagcagccacaggtgccactcccaggtccagccttgtgcagtcgtggggctggaggtgaagagccgtggggcctcgagngtaaggtttcctgacgagggcttcgacggtataccaccttcgacttagggtatgtactaactacgtaagttcgggtgtccggaccgacgggcccccggaacgaaacgggtcctagtaggtaggacgttagggngtaggtactacgaacggtcgtggtacgtaagtagggtaaacctaaacgtaaaaacgttcgaaacgtaaggtaaacgttacggaacgggttaccaaggttacgtaccgtaacctttacggaaccggtaanacctagtaccgcggtaaggtactttaacgtatacgttaggatcgngactgacggtaccngtagacgttacgacgaccaaggtcgtacgttattacgtttagcggtcgtaacgttgtacggtacggtagtcgttaagtccgttacgtcgttaccgtaagtttccgtaccggttaccggtggggtaaccgtaaccggtaccggttagtcccggtacgttccctaacccgtccg

SEQ ID NO: 261261 - DNA, 294 bp, Homo sapiens
  misc_feature: GYAE6OF02F0ZQB.1.5.A05.1.454.CMB.1.raw
  modified_base (230)..(230): a, c, t, g, unknown or other
  misc_feature (230)..(230): n is a, c, g, or t
  modified_base (233)..(233): a, c, t, g, unknown or other
  misc_feature (233)..(233): n is a, c, g, or t
  modified_base (243)..(243): a, c, t, g, unknown or other
  misc_feature (243)..(243): n is a, c, g, or t
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
  modified_base (265)..(294): a, c, t, g, unknown or other
  misc_feature (265)..(294): n is a, c, g, or t
tcagacgagtgcgtcacgaccggtgctcgatttagatagatagacagggggcgagttccagatttcaactgctcatcagtcagccttgcagtctgaagattttgcaagtttattactgtcagcagtataataactggcctccgacgttcggcctaagggaccaaggtgaaattacaaacgaactgtggctgcaccatctgtcttcagtcgtcccgcatctgatcggtacngcnctgagcgggntggcaaggcggacatagngnannnnnnnnnnnnnnnnnnnnnnnnnnnnnn

SEQ ID NO: 261262 - DNA, 187 bp, Homo sapiens
  misc_feature: GYAE6OF02IEVV4.1.5.A05.1.454.CMB.1.raw
  modified_base (180)..(187): a, c, t, g, unknown or other
  misc_feature (180)..(187): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttccacgcactcgtctgagcgggctggcaaggcgcatagnnnnnnnn

SEQ ID NO: 261263 - DNA, 657 bp, Homo sapiens
  misc_feature: GYAE6OF02FNTHK.1.5.A05.1.454.CMB.1.raw
  modified_base (559)..(559): a, c, t, g, unknown or other
  misc_feature (559)..(559): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagccgtggggcctcagtgaaggtttcctgcaggtcttcgaggatacaccttacactaggtatgctatacagttgggtcgcgccgacggccccccgaagaaacggcttggagtggagtggggatagggataccgaacgcgtaggactaagtacggtaaaccaaacgtaaaaaattccgaaacgaaggtaacgttccgaagggtacaaggtacgtacctaaccgtttaacgaagggtaaccacgtacgtaccggacgtaagtacttaacgttatagtggagtcgtaggagtcacgtcgtagagtactacggaacgacgacggtgtagttagtttacgtttgtctaccgtacttcgtaggtggtacgtntaagttacgtacgcttacgtaagttcggtaaccgttccggtagggtacccgtaacgggttcccttacgggtcccgtaaccggttcctacccgtacccg

SEQ ID NO: 261264 - DNA, 701 bp, Homo sapiens
  misc_feature: GYAE6OF02HFDJY.1.5.A05.1.454.CMB.1.raw
tcagacgagtgcgtcacgaccggtgctcgatttagatagatagacagggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagccgtggggcctcgagtgtaaggtttcctgcaaggtcttcgaggatacaccttcactaggtatgctatactagttgggtgcgccgacggcccccggacgaaacggcttgagtggagtgggatggatacgacgctggcaagtacggtaacaacaaaaattacaacaagtaacgtaccgagggacgaagtagtacctaccgtttaaccgagggtaaccactacgtacccggtacggaaggttaacgtttaactttaacgttagttagggacgtcgtagacgacgagccgtagacgtacgtaccgaacgaaccgtaccggtacgtagttatttaacgtttttcgggtcgtaccgttacccttagttaacgggttcgggtaacggttacgttaattttacgtaccgttacttacgttaacttttacggtaccgtttcccggtacggggttacccgtacggggtaacccgtttcggtacccgtacccggttccgttacccgtaccccgg

SEQ ID NO: 261265 - DNA, 861 bp, Homo sapiens
  misc_feature: GYAE6OF02H62V2.1.5.A05.1.454.CMB.1.raw
  modified_base (169)..(169): a, c, t, g, unknown or other
  misc_feature (169)..(169): n is a, c, g, or t
tcagacgagtgcgtcacgaccggtgctcgatttagatagatagacaggggacccaacaaccacatccctcctcagaagcccccagagcacaacgccccaccatggactggacctggagatcctcttttggtggcagcagccacaggtgcccatcccaggtccagcttgngcagtctggggctgaggtgaagtacgccgtgggccttcgaggtaggtaaggtttccctggaccaagggtccttacggaggtactaccacccgtttcacgtaggtatcgacgttatactagttcgggtgccgccgaacgggtcccccccggaagaaacggtcgtttaggacggtagggtagtaggggacttagggacgttacccgaaacggtcgtcgggtaccggtaaagttacgggtaaaacctaaaccgtaaaaaactttaccgaacgtaacggtaaacggtttaccgaagggtaaccgaagtacgttacctaacccgtttaccgacggggtaccacggtactcccggagaacgttactttactataacgtgggtacgacgttggaacgtcgtacgtaccgtaggtacgtacggttaaccggaagacccgacgggtacgttaacggtttagttttaaccgttttgggtaaccggttcccgtaaccggttcggttaaacggggttaccggtacgggttttaacccttaaggtttaaccccgggtttcttaaccccggtttaagtttaaagggtttacccggttaaacccgggttccggggtttaaccggggggtaccccggttaaaccgggggttaaccccggttgggtaaccccggtttacccggttcccggttaccccttaaccccgggg

SEQ ID NO: 261266 - DNA, 696 bp, Homo sapiens
  misc_feature: GYAE6OF02IJ4P7.1.5.A05.1.454.CMB.1.raw
  modified_base (208)..(208): a, c, t, g, unknown or other
  misc_feature (208)..(208): n is a, c, g, or t
tcagacgagtgcgtcacgaccggtgctcgatttagatagatagacaggggacccaacaaccacatccctcctcagaagcccccagagcacaacgccccaccatggactggacctggatgatcctctttttggtggcagcagccacaggtgcccactcccaggtccagcttgtgcagtcgtgggctgaggtgaagaagccgtgggcctnagtgtaaggtttctgcgaaggtcttcgaggactactaccttcacgtaggtatgctatactagttgggtcgcgccgacggcccccggagaaacggcttgagtggagtggggagtggactacgaacgcgtggacaaagtagtaaaccaaactaaaaaattcaacgaagtaacgttaccgaagggcgaagacgtacctaaccgtttaacgacgggaacacgtacgtacccggacggtaaggtactttaacttagtaagtagggtacgtcgttaggacgacgaacgtccgtagacgtacgtaccggaacgaccgtaccggtacttagttaatttagtttttggtacgtaccgtaccgttcggttaaggtaggtaacggttacttaagtttacgttacgtacttacgttaacgtttcggtaacccttccggttaccggggtaccgtaaccggggttaacccgttgggtacccttacccggttaccttaccccg

SEQ ID NO: 261267 - DNA, 593 bp, Homo sapiens
  misc_feature: GYAE6OF02JJL1V.1.5.A05.1.454.CMB.1.raw
  modified_base (210)..(210): a, c, t, g, unknown or other
  misc_feature (210)..(210): n is a, c, g, or t
  modified_base (224)..(224): a, c, t, g, unknown or other
  misc_feature (224)..(224): n is a, c, g, or t
  modified_base (233)..(233): a, c, t, g, unknown or other
  misc_feature (233)..(233): n is a, c, g, or t
  modified_base (254)..(254): a, c, t, g, unknown or other
  misc_feature (254)..(254): n is a, c, g, or t
  modified_base (323)..(323): a, c, t, g, unknown or other
  misc_feature (323)..(323): n is a, c, g, or t
  modified_base (444)..(444): a, c, t, g, unknown or other
  misc_feature (444)..(444): n is a, c, g, or t
tcagacgagtgcgtcacgaccggtgctcgatttagatagatagacaggggacccaacaaccacatccctcctccagaagcccccacgagcacaacgccccaccactggactggacctggaggatcctcttttggtggtcagcagccacaggtgcccactcccaggtccagcttgtgcagtctggggctgaggtgaagagcctggggcctnagtgaaggtttccngcaggcttnaggatacaccttcatggtatnctatacattggtgtcgccgacggcccccggacaaggctaggacgtgggataggggatggatcgaacgcnggcaagtggaacaacaaaattacaacagaagttaccgaagggtacaggagtacacctttaaccgagggtaccactactaccgacggaggtacttacgttaatagtaggtaacgctaggtancgacgtctaggagactcgaacgacacgtctagttagtattttagcgtcgtacctagttcgtaggtgtactattacgttagtacgtactaagttatacgttccgtacggtccgacgggttacccgtgtacccgtacgtcctcccgtaccg

SEQ ID NO: 261268 - DNA, 182 bp, Homo sapiens
  misc_feature: GYAE6OF02HIUYU.1.5.A05.1.454.CMB.1.raw
  modified_base (181)..(182): a, c, t, g, unknown or other
  misc_feature (181)..(182): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttccagttactctatctgagcgggctggcaaggcgcatagnn

SEQ ID NO: 261269 - DNA, 578 bp, Homo sapiens
  misc_feature: GYAE6OF02HRV1N.1.5.A05.1.454.CMB.1.raw
  modified_base (449)..(449): a, c, t, g, unknown or other
  misc_feature (449)..(449): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttggagtggatgggatggatcgaacgctaggcaagtggtaacaactaaaaaattcaacagaagttaccagggacagagtcactttacgaggacacatccgacgaggtattactatagtaggagtctgagcagcgtagagtactacggaagacgacgtntacgttattattttggcgtacgtacctagtagttgggtacggtactagttacgttacgcgttactaagtttcgtacgtccgttggggacctacgggtaccctcggtaccgaaccgttccgtacctaccg

SEQ ID NO: 261270 - DNA, 625 bp, Homo sapiens
  misc_feature: GYAE6OF02FOMMF.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccacggaccccccggacaaaacgggctttggagtggagtgggagtggatcaacgctggcaagtggtaacactaaaaattcaacagtaacgttccaggggcaggacgtaccaccgtttaccagggacacacgtccgacgaggtattactttagataggatacgtagactcgagcctaggagactaccggaagtaccgacggtctgttacttagttttggtagtaccgtaccttcgttaggtggtacggttctagttaatttacggtacttacgtaacgtttacgtaccgttccggtacggggtaccgtacgggtaacccggttccggtaccgtacccggttcctacccgtacccg

SEQ ID NO: 261271 - DNA, 799 bp, Homo sapiens
  misc_feature: GYAE6OF02FGSME.1.5.A05.1.454.CMB.1.raw
tcagacgagtgcgtcacgaccggtgctcgatttagatagatagacaggggacccaacaaccacatccctcctcagaagccccagagcacaacgccccaccatggactggacctggaggatcctctttttggtggcagcagccacaggtgcccactcccaggtccagcttgtgcagtctggggctgaggtgaagaagcctggggcctcgagtgtaacggtttcctggacaagggtcttcgaggataccgtaccttcactacggtatgctatacgtagttgggtcgtcgccgtacggccccccggaataaacggcttcggagtagggtagttacggggataggaacttaccgaacggtcgtacggacgaagttacggtaaaccaaacgtaaaaaacttcgaacgtaacgtaacgttaccgagggacagtaacgtaccctaacccgtttaacgaacggggtaacctaaccgtacggtcccggtaacggtacggtaacgttttaacgttacgtaacggtgggtaaccgtacggttgaacggtcgtaccggtaccgtaggtaacgtaaccgttaccggaaaacggtaccgtaacgggtacgtttacggttaactttttaacggttttttcggaccggttaccgttaacccgttacggttaagggtacgggtaaacggtttcttaaacgtttacgttaccggttacctaggttaaaccggttttcgaacccggtttaaccgggtccggggaacccgttaaccgggacccgtttaggccccttaaccggttccgtacccttacccg

SEQ ID NO: 261272 - DNA, 652 bp, Homo sapiens
  misc_feature: GYAE6OF02F5T86.1.5.A05.1.454.CMB.1.raw
  modified_base (266)..(266): a, c, t, g, unknown or other
  misc_feature (266)..(266): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggctcagtgaagtttcctgcaaggcttcaggatacaccttcactaggtatgctatacattgggtncgcacggcccccggacaaggcttgagtggatgggatgatcaacgctggacaataggtaaacaactaaaaaattacaacgaagaacggttacgagggacgagtacgtctacctttacgacgggaacacagtccgacgaggtacttacttatagtggagtctagtagcgacgccgtagacgtataccggaagaccgacggactacggttatttagtttttagtgtaccgtaccgttacgttaggttacgggtaggttacgttaagtttacgttaccgtaccttaacgttaacgtttacggttaccgttacccggttcggggtaacccgttaccggggtaaccccggttagggttacccgaacccggtttcccgtaccccgttaacccg

SEQ ID NO: 261273 - DNA, 732 bp, Homo sapiens
  misc_feature: GYAE6OF02HXQ5N.1.5.A05.1.454.CMB.1.raw
  modified_base (134)..(134): a, c, t, g, unknown or other
  misc_feature (134)..(134): n is a, c, g, or t
  modified_base (232)..(232): a, c, t, g, unknown or other
  misc_feature (232)..(232): n is a, c, g, or t
  modified_base (264)..(264): a, c, t, g, unknown or other
  misc_feature (264)..(264): n is a, c, g, or t
  modified_base (422)..(422): a, c, t, g, unknown or other
  misc_feature (422)..(422): n is a, c, g, or t
tcagacgagtgcgtcacgaccggtgctcgatttagatagatagacaggggacccaacaaccacatccctcctcagaacgcccccagagcacaacgccccaccatggactggacctggaggatcctctttttggnggcagcagccacgaggtgcccactcccaggtccagcttgtgcagtcgtggggctggaggtgaagacgtccgtgggcctcgaggtgtaacggttttccngacgaacgggtccttagaggataccaccttanacgttaggtactgtactatactagttagggtcgaccgaccgaccggacccccggaacgaaacggtcgttacggagtcggagtacggggagtcggactacgaacgcgtaggacaagtacgtaacaaacgtaaaatcgaacgaggtaacgtacgacggtnacggagtactaaccgttacgacggtacacgtactaccggtacggacgttacttagttaacgttaggtacggacgtacgtagacgtacgacgtaccgtaggtaactaccgtaccgaaggtaccgtacgggtaccttagttaacgttttaggttcgtacgtacgttaccgttacggtcgttacgggtattccgttaagtttacgtaccgtcgtttacggtaacgtttacggtaccccgttagggtacccgggtacgtaacccgggtacccggtaccgggttaacccgtcccggttaccgtacccgttaccgg

SEQ ID NO: 261274 - DNA, 914 bp, Homo sapiens
  misc_feature: GYAE6OF02G7188.1.5.A05.1.454.CMB.1.raw
  modified_base (752)..(752): a, c, t, g, unknown or other
  misc_feature (752)..(752): n is a, c, g, or t
  modified_base (823)..(823): a, c, t, g, unknown or other
  misc_feature (823)..(823): n is a, c, g, or t
tcagacgagtgcgtcacgaccggtgctcgatttagatagatagacagggggacccaacaaccacatccctcctcagaacgcccccagagcacaacgccccaccatggactggacctggaggatccttctttttggtggcaggcagccacaggtcgccactcccaggtccagcttgtgcagtcgtggggctggaggtgaagagccgtggggcctcgaggtcggtaagggtttccctggacgtaagggccttacgacgggtacttaccgacctttacaaccgttaggtactcggtacttaacgttaaccgtagtttcgggggtactcccgggtacccgtaaccggggtaccccccccgggaaagtaaaaaccggggtccttttacgggtaaggggtttacggggaacggttacggggggtaacgttacggggaacgtttacccggaaaccggtccggttacgggaaccgtaaaacggttaacggggtaaaaaccctaaaaaccttaaaaaaaacggttttcccgaaaccggttaaaacgggtaaacggtttaccccgggaaagggggtacccgtaaacggtaaacggttaccccgtaaaacccggttttacccggaaacggggtaaaccctaaacggtaaccgtacccgggacggtaaggtaacctttaacgttaagtacggtagggacgtacgttagggaacgacgttacggaccgttaggaaccgttaacgacccgggaagaccgtacggtnttacggttaaatttgtttttacgcggtaccgtacttacgtaggttacgtaggtacgttaatacgtttaccncgttaacgttagtttacggaccgttcgggtaccgggaaccgttaaccgggtaccgttccggtacccggtacccttcgggtacccttaccgg

SEQ ID NO: 261275 - DNA, 268 bp, Homo sapiens
  misc_feature: GYAE6OF02GRIXX.1.5.A05.1.454.CMB.1.raw
  modified_base (249)..(249): a, c, t, g, unknown or other
  misc_feature (249)..(249): n is a, c, g, or t
  modified_base (256)..(268): a, c, t, g, unknown or other
  misc_feature (256)..(268): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctcgacgttcggccaagggaccaaggtggaaatcaaacgactgtggctgcaccatctgtcttcatccttcccgcctatctgatcgtactgcgctgagtcgggctgggcaaagggcncatacgnnnnnnnnnnnnn

SEQ ID NO: 261276 - DNA, 667 bp, Homo sapiens
  misc_feature: GYAE6OF02IGV9G.1.5.A05.1.454.CMB.1.raw
tcagacgagtgcgtcacgaccggtgctcgatttagatagatagacaggggacccaacaaccacatccctcctcagaagccccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccacggcccccggacaaaggcttgacgtggatgggatggatacgaacgcgtggcaagtaggtaacaacgtaaaaaatcaacagaagttaccgagggacaggagtccgaaccgtttaaccaaggggaccaacactacccggacggacggattttaacttactaagttagggtaggcttagagcgaacgccgttggaacgtacgtacccgtaaaggacgaaccgggctagttagtttaactttttggtagtaccgtaccctttacggtagttagggaacggttcgtaagtttaaccgttacgtctttaacgtaacgtttaccgtaacgttcccggtcggggtacccgacggggttaacccgttcggtacccgtaccggttcccgttcccttaccccgg

SEQ ID NO: 261277 - DNA, 736 bp, Homo sapiens
  misc_feature: GYAE6OF02JJ4BO.1.5.A05.1.454.CMB.1.raw
  modified_base (205)..(205): a, c, t, g, unknown or other
  misc_feature (205)..(205): n is a, c, g, or t
  modified_base (267)..(267): a, c, t, g, unknown or other
  misc_feature (267)..(267): n is a, c, g, or t
  modified_base (285)..(285): a, c, t, g, unknown or other
  misc_feature (285)..(285): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctgggcctnagtgaaggtttcctgcaggcttacgaggatacaccttcactaggtatgctatacattgggtntcgccacggcccccgganaaaggcttgacgtggagtgggatggatacgaacgtctgggacaagtacgtaacgaactaaaaagttccgaacgtaaggtaacgttacccgaaggggacaaggtacgtaccgtaaccgttttaacccggaaggggtaacccaaccgtaacgtacccggtaaccgtaacgggtaacttttaaccgttaacgtaagttcgggaaacgtcgtacggaaaggtactaggtcccgtaaggtacgtaacggtacccgaaacggaaccgtacgggtacttaggttaacgtttagtttttacggtacgtaccgttaaccgtccggttaagtacgggtacgttaacgtacgtttaagtaccgtacttacgttaacgtttaccggtacgtacccggttacggggacccgtaccgggttaacccttcgggttaccctaccggttaccggttcccttaacccgg

SEQ ID NO: 261278 - DNA, 815 bp, Homo sapiens
  misc_feature: GYAE6OF02JCS8B.1.5.A05.1.454.CMB.1.raw
  modified_base (225)..(225): a, c, t, g, unknown or other
  misc_feature (225)..(225): n is a, c, g, or t
  modified_base (288)..(288): a, c, t, g, unknown or other
  misc_feature (288)..(288): n is a, c, g, or t
  modified_base (731)..(731): a, c, t, g, unknown or other
  misc_feature (731)..(731): n is a, c, g, or t
tcagacgagtgcgtcacgaccggtgctcgatttagatagatagacaggggacccaacaaccacatccctcctcagaagccccagagcacaacgacccaccatggactggacctggaggatcctctttttggtggcagcagccacaggtgcccactcccaggtccagcttgtgcagtctggggctgaagtgaagagccgtaggggcctacgagtgtaaggtttccngacaaggcttacgaggtactacgaccttacaccgtaggtactgtactaatactagttgggtcncgtccgaacggcccccggtaagaaaggtccgttagacggtggacgtaggggacgtgggtactaccgaacggtccgtagggactaaacgggtaccgttaaaaccgtaaaacgtaaaaaacttccgaacgttaaggtaaccggttaccgaaggggtacctaacggaaccgtttacccgtaacccggttttaaccggaaacgggtaccaaaccgtaacccgggtacccgtaccgggtaaaggttaaccttttaacgttaacgttacgaagggtactacgggttaagaccgtaccgtacgtaccgttacgaacgtacgttacccggaaagtacccggtacgtaccgttaggtttaacttttaggttttacggtacgtaccgtttaccgttacgggttagttaacggggacgtttaactaacgttttacgtacccgttataacggttntttaaccggcgttaacccgggtgggtaaccccgtagggttaccccggttacggtaccgtttacccgtccgtttacccggacccg

SEQ ID NO: 261279 - DNA, 758 bp, Homo sapiens
  misc_feature: GYAE6OF02FHKBI.1.5.A05.1.454.CMB.1.raw
  modified_base (291)..(291): a, c, t, g, unknown or other
  misc_feature (291)..(291): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaagtttcctgacaaggcttacaggatacaccttcacttaggtatgactatacagttgggtcgcgccacggcccccggaanaaaggtcttggagtggagtgggatggatcgaacgcgtggacaagtaggtaaacaaactaaaaacttcaacgtaagtaacgttccgaagggacaaggtaaccgtacctaacccgtttaacgaacgggtaccaacgtacgtacccgacggtaacggtatttaaccgttagtaggtcggaacgtcgtaacggtacgacacggtcccgtaaggtaacggtaacgttaacccggaaagtaccgaaccggtcgtttaaggtttacgttttaaagtttttcgggtaaccgtacccgttaaccgtttcggtttaagggtacgggttacggtttacctaacgtttttaaccggttaccgtacgttaaccgtttaaggtttaccgtaacccggtttcccgggtaccggggtacccgtaaccggggttaccccgttagggttacccccgtacccggtttaccttaccccgtaacccgg

SEQ ID NO: 261280 - DNA, 188 bp, Homo sapiens
  misc_feature: GYAE6OF02FYPK1.1.5.A05.1.454.CMB.1.raw
  modified_base (180)..(188): a, c, t, g, unknown or other
  misc_feature (180)..(188): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttcctcgtactgcgctgagcgggctggcaaggcgcatagnnnnnnnnn

SEQ ID NO: 261281 - DNA, 961 bp, Homo sapiens
  misc_feature: GYAE6OF02HBLZK.1.5.A05.1.454.CMB.1.raw
  modified_base (286)..(286): a, c, t, g, unknown or other
  misc_feature (286)..(286): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccacggccccccgganaaacggcgttcgaggtggacgtggggactaggactacgaacggccgttggacaaagtggttaaacgaacaaaaaaactttccaacaaggtaacgtttacccgaggggtaccaaggtaacgttccgtaaaccgttttaacccgaacgggggtaacctaaaccgtacgtaccccggtaccgggtaaacgggttaacgtttttaaccgtttaaacgtttaacgtttaacgggggtaaccggttaccgttacgggttaaaacgggcccgtaaacggttacccccgttaaggggtaaaccgggtaacccggtttaaacccccggggtaaaaaccgggaaacccgggttaacccggggtacccgtttaaggggttttaacgtttttaacggtttttttttaccgggttaccgggtaaccccggttaaccgttttacccggtttaaagggtttaccgggggtaacggggtttaacccctaaagttttttaccgggtttaaaccccgggttcctttaaacccggttaacgttttttaacccgggtaaacccgttttccccgggtttaacccgggggggaacccgtttaaacccggggggtttaaccccccggtttaccggggggttaacccccctttaaccccggggttttccccggtttaaacccccggtttaccccccggg

SEQ ID NO: 261282 - DNA, 799 bp, Homo sapiens
  misc_feature: GYAE6OF02GZWPY.1.5.A05.1.454.CMB.1.raw
tcagacgagtgcgtcacgaccggtgctcgatttagatagatagacaggggacccgaacaaccacatccctcctcagaagcccccagagcacaacgccccaccatggactggacctggaggatcctctttttggtggcagcagccacaggtgcccactcccaggtccagcttgtgcagtcgtggggctgaggtgaagagcctggggcctcaggtgtaaggtttcctgacaaggtcttcgaggactacaccttcaacgtaggtatacgtcttaacgtactagttagggtagccgaccgacgggacccccggaaacgaaacgggtcttacggaggtaggtacgtagggtacgtaggaacgtaccaaacggtcgtacggacctaaagtacggtaaacctaaacgtaaaaaaacttccgaaacgaacggtaaacgttaccggacgggtacgacgtaacggtacctaaaccgtttaacgaaacgggtaacaacgtacgtacccggtacgaaggttactaacgtttaatacggttacggaacgtcgtaaggtacgacgtaacgtccggtagtaacgtaacgtaaccggaaacgtaaccgtaaccggtattaacgtttaagtttacggtttttacgaacggtaccgtaacctttacgggtaacgggtttaacgaaggttacccgttaagttaacgttacccgttacgtttaaggtaacctttacggtaccgttaacgggtaacccgggtaccgtaacccgggttaacgtttccggaacccgttacccggttaccctaccgtaccccg

SEQ ID NO: 261283 - DNA, 752 bp, Homo sapiens
  misc_feature: GYAE6OF02G7JWZ.1.5.A05.1.454.CMB.1.raw
  modified_base (220)..(220): a, c, t, g, unknown or other
  misc_feature (220)..(220): n is a, c, g, or t
  modified_base (652)..(652): a, c, t, g, unknown or other
  misc_feature (652)..(652): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtcgtggggctgaggtgaagagcctgggcctgagtgaaggtttccngcaaggcttacaggataccaccttcactaggtatgctatacagttgggtcgcgccgaccgggccccccggaagaaacggtcttaggaggtggtagtggggatgggactacgaacggtcgtgggactaaaggtacggtaaacaaacctaaaaagttaccaacgtaaggtaaacgttaccggaaggggtacgaacggtaacgtaccgttaacccgtttaaccggaacgggtacctaaccgacggtacccggacggtaacgggttaacttttaaccgttaagttaaggttacggggtaacggtaccgttaggaaccgtcgacggtaccgtaggaacgtaacgtaccggaaacgacgacggtactaggttactttagttttgacgtacctaccgttagttagggtacggtacgttaacgttagttacgttaccgtnttaaccgttaagtttaccggtaccgttccgggttaccgggtaccccggtaacgggttaccccgtaggttaccccgttaccgttaccgtcccgttaacccg

SEQ ID NO: 261284 - DNA, 675 bp, Homo sapiens
  misc_feature: GYAE6OF02GXFVZ.1.5.A05.1.454.CMB.1.raw
  modified_base (248)..(248): a, c, t, g, unknown or other
  misc_feature (248)..(248): n is a, c, g, or t
  modified_base (257)..(257): a, c, t, g, unknown or other
  misc_feature (257)..(257): n is a, c, g, or t
  modified_base (286)..(286): a, c, t, g, unknown or other
  misc_feature (286)..(286): n is a, c, g, or t
  modified_base (349)..(349): a, c, t, g, unknown or other
  misc_feature (349)..(349): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccacctcccaggtccagcttgtgcagtctggggctgaggtgaagaagccgtggggcctcagtgaaggtttcctgcaaggcttcgaggatacaccttnactaggtangctatacattggtgcgcaggcccccgganaaaggctgagtgagtgggatggatcgaacgctggctaagtggtaaacaacgaaaaaattcaanagaagttaccgaagggcagagtactaccgtttacgaggtacaacactccgacgaaggtattacttaagtagtggaacgtctagagtacagtcctagagtacgtaccggaaagaccgacgtacgtacgttaagtttaagtttttcggtacgtaccgtaaccgttcgttaacgggttagggtaacggttacctaagttttaaccgttacgtaccgttacgttaaaacgttttcggaaccctttcccgggtacgggggtaccccgtaaacgggggtaaccccgtttacgggttacccgtaacccggtttcccttacccgttaaccccgg

SEQ ID NO: 261285 - DNA, 704 bp, Homo sapiens
  misc_feature: GYAE6OF02IDFKY.1.5.A05.1.454.CMB.1.raw
  modified_base (126)..(126): a, c, t, g, unknown or other
  misc_feature (126)..(126): n is a, c, g, or t
  modified_base (135)..(135): a, c, t, g, unknown or other
  misc_feature (135)..(135): n is a, c, g, or t
  modified_base (231)..(231): a, c, t, g, unknown or other
  misc_feature (231)..(231): n is a, c, g, or t
tcagacgagtgcgtcacgaccggtgctcgatttagatagatagacaggggacccaacaaccactatccctcctcagaagcccccagagcacaacgccccaccatggactggacctggaggatcctntttttcggnggcagcagccacaggtcgcccacgtcccaggtccagcttgtgcagtcgtgggactgaggtgaagaagccgtggggcctcgaggtgtaaggtttccngcgaaggcttacgaggataccgaccttcacgttaggtatgactataacgtagtttgggtgccgaccgaccgggacccccggaagaaacggtccttaggaggtggagtggggaagtggatacgaacgcgtagggactaagtacggtaaacaaacgtaaaaattcgaacgaagtaacgttaccgaagggacagactcgttaaccgttacgaggacactacgtaccgagtacggtaactttacgtagtagtaggagtcgtagacgacacgcgtagaacgacgtaccgaagaccgtaggtacttagttatttagttttcggacgtaccgtacccgttaggtagggttcggtaacggttcttaacggttacgttaccggttactttaacgttaacgtttcgtaccggttccgggtaacgggtaccccggtacgggtaacccgttccggtaacccgtcccgttcccgtaccgtacccgg

SEQ ID NO: 261286 - DNA, 803 bp, Homo sapiens
  misc_feature: GYAE6OF02I8HP1.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctgggctgaggtgaagagctgggctcagtgaaggtttcctgcaaggcttcaggatacaccgttcactacggtatcgacttatacgtattgggtgcgtccgacggcccccggaacgtaaacggtcgttacggaacggtcggtaagtggggtaagttggaacgttcgaaacgcgttagggactaaagtacggttaaacgaaacgtaaaaaaactttccgaaacgtaacggtaaacgtttacccgaacggggtaccgaaaggtaacggttacccgtaaaccgttttaacccgaaaggggtaaccaacgtaacgtaccccggtacgaacggtaacctttaacgttaaacgttaacgtacgggtaacggtccgtacggtaacgacggtacgtaccgttaggaacggttaacgtaccggaaacgtaaccggaccgggttctaacggtttagtttaacggtttttggtacgtaccgtaaccgtttacgttaacggtttaggtaacggttccgttaaagtttacgtttaccggtacgttaccgttaaacgtttcgtaccggtttaccgttaccggggttacccgtaacgggtaaccccgttcggtaaccggttaccgtaccgttcccttaccgg

SEQ ID NO: 261287 - DNA, 623 bp, Homo sapiens
  misc_feature: GYAE6OF02HKBUA.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggtcttcaggatacaccttcactaggtatgctatacattggtgcgccacggcccccgacaaaggctgagtgatgggatggatcgaacgcgtgggactaagtaggtaaacaactaaaaaacttcgaactagaaacggttccgaagggacaagtacgtcctaaccgtttaaccgagggaccacgatacccggacggtagactttaacttagtagtaggagctggagacaggtacctggaagtacgtaccgaaacggtaccgacggtacagtttaacttacgtttttggacgtacgtaccgtcgttaaggttgggaacgttgtaatttacgtcgttactacgtaagtttacacgtccgtgggaccgtacgggtaaccctggtccacccgttctccctaccg

SEQ ID NO: 261288 - DNA, 169 bp, Homo sapiens
  misc_feature: GYAE6OF02HUS2W.1.5.A05.1.454.CMB.1.raw
  modified_base (127)..(169): a, c, t, g, unknown or other
  misc_feature (127)..(169): n is a, c, g, or t
tcagacgagtgcgtcacgaccggtgctcgatttagatagatagacagggcaccaagggcccatcggtcttccacctgggccaccctcctcacgtctacgtgctgagcgggctggcaaggcgcatagnnnnnnnnnnnnnnnnnnnnnnnnnnnnnnnnnnnnnnnnnnn

SEQ ID NO: 261289 - DNA, 282 bp, Homo sapiens
  misc_feature: GYAE6OF02G0QMA.1.5.A05.1.454.CMB.1.raw
  modified_base (266)..(282): a, c, t, g, unknown or other
  misc_feature (266)..(282): n is a, c, g, or t
tcagacgagtgcgtcacgaccggtgctcgatttagatagatagacaggggcagttccagatttcaactgctcatcagcagcctgcagtctgaagattttgctagtttattactgtcagcagtataataactggcctccgacgttcggccaaagggaccaaggtggaaatcaaaacgaactgtggctgcaccatctgtcttcatccttccgcatctgactcgtactgcgtctgacggcgggctggcaaagggccggacaataaggcnnnnnnnnnnnnnnnnn

SEQ ID NO: 261290 - DNA, 657 bp, Homo sapiens
  misc_feature: GYAE6OF02GGQOQ.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtcccagcttgtgcagtcgtggggctgaggtgaagagccgtgggcctcagtgaaggtttcctgcaaggtcttcgaggataccaccttcactaggtatgactatacatttgggtgcgccgacggcccccggaacaaaggcttaggagtggagtgggatggatcgaacgctggactaagtaggtaaacaacaaaaaatttcaacgaacgtaagtttaccgagggtacagtacgtaccttaccgtttaaccgaagggaacccacgacgtaccggacggtaacggtaagtttactttatagtgggagtcgttagagcgacgccgtagacgtacgtaccggaaagaccgacggtacgtagttactttagttttgtacgtaccgtacgttacgtagttggtacggtcttaagttacttacgaccgttacttaagtttcgtaccgttccggttcgggacccgtacgggtacccgttcggtaccgtacccgttcctacctccg

SEQ ID NO: 261291 - DNA, 740 bp, Homo sapiens
  misc_feature: GYAE6OF02IZ3Z1.1.5.A05.1.454.CMB.1.raw
  modified_base (241)..(241): a, c, t, g, unknown or other
  misc_feature (241)..(241): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtcccagcttgtgcagtctggggctgaggtgaagaagcctggggcctcagtgaggtttcctgcaaggtcttcaggatacnccttcactaggtatgctataccattgggtgcgccacggtccccccggacaaaggcttgagtggatggggatgggatcgaacgcgtggcaagtggtaaacaacgtaaaaaacttcaacgtaagtaaacgttaccggtagggaccaaggtaacgtaccgtaacccgttttaaacccgaacgggggtaaccaacgaccttacccggaccggtaacgggtaactttacccgttaagttaacgttagggacgtaccgtggtaacgccaacggtccctagggacgtacgtacccggaacgaaccgacgggtactagggttaatttaacgttttttcggtggtaaccgtaccgtttacgttacggggttacggtacggttactaacgtttaacgtttaccgcgttttaacgtaacgttttcggtaccctttaccgggtccgggtacccgtacccgggggtaacccgttaccgggttacctacccgggttccttacccgtaacccgg

SEQ ID NO: 261292 - DNA, 655 bp, Homo sapiens
  misc_feature: GYAE6OF02GSUQI.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcataggtatgctatacagttggtgcgccacggcccccggacaaaggcttgagtggagtgggatggatcgaacgcgtggacagtaggtaacaacaaaaattcacagtaacgtccgaggacaggacgtactaaccctttacgaggacacgacgtccgacgaaggtactttacgtttagtacgtgggacgtcgtacggagccgacggtccgtagacgacgttacccggaaagtaaccgaccgggtcttacggttaagttttacgtttttggaccgtaccgttaacccgttcgttagggtacggtacggtttactaactttacgttacgtccttacgttaatttacggaccttcccggtacgggtaccggtaacgggtaccggacccggttactcccggttacctcccgtaccgg

SEQ ID NO: 261293 - DNA, 663 bp, Homo sapiens
  misc_feature: GYAE6OF02F2CQD.1.5.A05.1.454.CMB.1.raw
  modified_base (207)..(207): a, c, t, g, unknown or other
  misc_feature (207)..(207): n is a, c, g, or t
  modified_base (219)..(219): a, c, t, g, unknown or other
  misc_feature (219)..(219): n is a, c, g, or t
  modified_base (238)..(238): a, c, t, g, unknown or other
  misc_feature (238)..(238): n is a, c, g, or t
  modified_base (538)..(538): a, c, t, g, unknown or other
  misc_feature (538)..(538): n is a, c, g, or t
tcagacgagtgcgtcacgaccggtgctcgatttagatagatagacaggggacccaacaaccacatccctcctcagaagcccccagagcacaacgccccaccatggactggacctggaggatccttcttttggtggcagcagccacaggtgcccactcccaggtccagcttgtgcagtctggggctggagtgaagagccgtgggcctnagtgaggttccngcaaggcttcgaggatacnccttcagtaggtatgacttatactagttagggtcgtcgtaccgacgggccccccgaagaaaacggtcgttagaggtacggtagtcggggattagggatcgaacgcgtggtacaataggtaacaacgtaaaaatactaacagtaacgtcagggacagtaacgtctaaccgttacgaacggcaaccacgttccgacggtaagtaagttaccgttaatacgtacggagtacgtagtacgacgtacgtaccgtaggtacgtacgtaccggaacgtacgaacgtcgtaggtaatttggttttacncggtacgtaccttagttaggtacgggtagtgtaactttagttacgactacgttaatttcgtaccgttccggtaccgggacggtaacggcccgttaccgggttccgtacccttcggtaccctaccg

SEQ ID NO: 261294 - DNA, 270 bp, Homo sapiens
  misc_feature: GYAE6OF02FX6S8.1.5.A05.1.454.CMB.1.raw
  modified_base (224)..(224): a, c, t, g, unknown or other
  misc_feature (224)..(224): n is a, c, g, or t
  modified_base (254)..(254): a, c, t, g, unknown or other
  misc_feature (254)..(254): n is a, c, g, or t
  modified_base (260)..(261): a, c, t, g, unknown or other
  misc_feature (260)..(261): n is a, c, g, or t
  modified_base (263)..(270): a, c, t, g, unknown or other
  misc_feature (263)..(270): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaagggtggaaatcaaacgaactgtggctgcaccatctgtcttcatccttcccgccatctgatcgtacngcgctgacggcgggctcggacaaagggccncatagnntnnnnnnnn

SEQ ID NO: 261295 - DNA, 581 bp, Homo sapiens
  misc_feature: GYAE6OF02ILU89.1.5.A05.1.454.CMB.1.raw
  modified_base (187)..(187): a, c, t, g, unknown or other
  misc_feature (187)..(187): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgnggtgaagaagcctggggcctcagtgaaggtttcctgcaaggcttcaggataccacctttcactaggtatgctatacattgggtgcgccaggcccccggacaaaggcttgagtggatgggatggatcaacgctgggacaataggtaacaacgaaaaaacttcaacaagaacgttccgaagggcagagtcacctttacgaggacacgatccgagagattactatatggagctgagacgagcctgagacgtaccgaacgacacggctagtattagtttttagcgtcgaacttcgtagtggtagtacgtattattacgacttacgtaacgttttcgaccttccggtcgggacccgtacgggaacccttaggtaccgtaacccgtttcacccgttaccg

SEQ ID NO: 261296 - DNA, 599 bp, Homo sapiens
  misc_feature: GYAE6OF02GDR0Q.1.5.A05.1.454.CMB.1.raw
  modified_base (264)..(264): a, c, t, g, unknown or other
  misc_feature (264)..(264): n is a, c, g, or t
  modified_base (282)..(282): a, c, t, g, unknown or other
  misc_feature (282)..(282): n is a, c, g, or t
  modified_base (394)..(394): a, c, t, g, unknown or other
  misc_feature (394)..(394): n is a, c, g, or t
  modified_base (466)..(466): a, c, t, g, unknown or other
  misc_feature (466)..(466): n is a, c, g, or t
  modified_base (475)..(475): a, c, t, g, unknown or other
  misc_feature (475)..(475): n is a, c, g, or t
tcagacgagtgcgtcacgaccggtgctcgatttagatagatagacaggggacccaacaaccacatccctcctcagaagccccagagcacaacgccccaccatggactggacctggaggatcctctttttggtggcagcagccacaggtgcccactcccaggtccagcttgtgcagtctggggctgaggtgaagagcctgggcctcagtgaggtttcctgcaaggcttcaggatacacttcactaggtatgctatacattgggtntcgcctaggcccccgganaaaggccttgagtcggatgggatggatcgaacgcgtggcaatgggtaaactaacaaaaattcaacagaagttccagggcagacgtcaccgtttacgaggacactactaccgngagtacttaacttataacgttggagcttggagtcagcctgagactcgaacgaccgacggtctgtaacgtttnttttacggngtccgtacgttcgttacgtggtaacgtccgtaagttacgttacgcttacgttaactttagtaccgttccgttacggggccgtaacgggtacccgttggtaaccgtcccggttactcccgtaccg

SEQ ID NO: 261297 - DNA, 634 bp, Homo sapiens
  misc_feature: GYAE6OF02HAQ78.1.5.A05.1.454.CMB.1.raw
  modified_base (461)..(461): a, c, t, g, unknown or other
  misc_feature (461)..(461): n is a, c, g, or t
  modified_base (516)..(516): a, c, t, g, unknown or other
  misc_feature (516)..(516): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagccgtggggcctcagtgaaggtttcctgcaaggcttcaggatacaccttcactaggtatgctatacattgggtgcgcacggcccccggacaaaggctgacgtggatgggatggatcaacgctggcaagtggtaaacaaaccaaaaaattccaacaagtaacgttccgagggcagagtacacctttaccgagggaccacatccgcggaaggtattaccttatacgtggagtcgtgagcaggccctaggagatccggaagacgacgtntgttatttagtttttggcgtcgtaccttcgttaggtcgggtacgtcttaacgttnttacggtcctttacgttaaagttttgaacccgtttccgggttaccgggggtacccgtaacccgggggttaaccccttcggggttaccctaaccccgggtttccgtcccgttaaccccg

SEQ ID NO: 261298 - DNA, 770 bp, Homo sapiens
  misc_feature: GYAE6OF02GLHG5.1.5.A05.1.454.CMB.1.raw
  modified_base (219)..(219): a, c, t, g, unknown or other
  misc_feature (219)..(219): n is a, c, g, or t
tcagacgagtgcgtcacgaccggtgctcgatttagatagatagacaggggacccaacaaccacagtccctcctcagaagcccccagagcacaacgccccaccatggactggacctggaggatcctcttttggtggcagcagccacaggtgcccatcccaggtccagcttgtgcagtctgggctgaggtgaagaagcctggggctcagtgaaggtttccnggtcaaggccttcgagggatacaccttgactaggtatgtctatacagttagggtgtcgccgaggccccccggtaactaaaacggcctttaggaagttggaattaggggactgggatcgtaacgcgttacggctaagttcggtaaacaacgaaaaaacttcaacctagaagtttaccgagggcaaggagttccgaacctttaaccgaagggtaacacgactccgtccgaggtactttaccttaatacttaggacggtctaggtaggtccgacggtaccgtagggtaacgtaaccgttaccggaaacgtaaccgttaaccggggcctttacgggttaactttaacggttttttaggaccgtaacccggttacccgttagtttaacggtacgggtaaaccggttaccgttaaacttttaacgggtttaaccggcctttaaacgttaaacggttttcggtaacccgtttaccgggttaaccgggggttacccgaaccggggttaaaccccttggggtaacccttaacccggggtttccctacccggtttaacccg

SEQ ID NO: 261299 - DNA, 606 bp, Homo sapiens
  misc_feature: GYAE6OF02F9336.1.5.A05.1.454.CMB.1.raw
  modified_base (284)..(284): a, c, t, g, unknown or other
  misc_feature (284)..(284): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattggtgcgccaggcccccgganaaggcttgagtggatgggatggatcgaacgcgtggcaatggtaacaacgtaaaaattcaacgaagaacgttccgagggcaggagtcacgtttacgagggacacataccgcgagattacgtatatggagctgagcagcctgacgtataccggaagacgacgggctacggttatttacgttttgacgtacgtacctacgttacgtaggtacgtcgttaacttagttaccgtacttacgttaaatttccgaacgtttcccggtacggggacccttaacggggtaaccccgttaggtaccgtacccggttccttacccgttaccgg

SEQ ID NO: 261300 - DNA, 605 bp, Homo sapiens
  misc_feature: GYAE6OF02HXNO4.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggataccaccttcactaggtatgctatacattggtgcgccacggccccccggagaaacggtcttggagtcggagtgggatggatcgaacgcgtggcaagtaggtaaacaacgtaaaaattcaacagtaacgtccgagggacagagtcctaaccgttacgaaggacacacgtccgacgtagtacttacgttaactagtggagtctaggacgtcgagtccgtagacgacttccgaagccgaacgtctaggtattagttttgacgtcgtactcgtagtggacgtacttagttacttcgtacttacgtaatttcgaaccgttcggtacgggtccgtaacgggtaccgtacggtacccgtaccgttcctcccgtaccg

SEQ ID NO: 261301 - DNA, 613 bp, Homo sapiens
  misc_feature: GYAE6OF02ID2XC.1.5.A05.1.454.CMB.1.raw
  modified_base (323)..(323): a, c, t, g, unknown or other
  misc_feature (323)..(323): n is a, c, g, or t
  modified_base (341)..(341): a, c, t, g, unknown or other
  misc_feature (341)..(341): n is a, c, g, or t
  modified_base (377)..(377): a, c, t, g, unknown or other
  misc_feature (377)..(377): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcgagtgaaggtttcctgcaaggcttcaggatacaccttcactaggtatgctatacattgggtgtgccacggcccccggaacaaaggcgttgagttggagtgggatggatacgacgngtcggacaagtcggaaanaaacaaaaaatcaacaagtaacgttaccgagggtanaggtaatacctaaccgtttaacgaacgggaaccaacagtcccgagaacggtatttacgttagtatggagacgtgagtcaagctagaagtactaccgaagacaacggcttaggtaatttagtttttgcgtacgtaccttacgtacgtggtaggtctaagtttataccgtctattaattacgaccgttcggtacggaccgtacggaacccgtgtacccgtaccgttccgtcctaccgg

SEQ ID NO: 261302 - DNA, 1199 bp, Homo sapiens
  misc_feature: GYAE6OF02IRW5H.1.5.A05.1.454.CMB.1.raw
tcagacgagtgcgtcacgaccggtgctcgatttagatagatagacaggggacccaacaaccacatccctcctcagaacgcccccagagcacaacgccccaccatggactggacctggagatcctcttttggtggcagcagccacgaggtcgcccaactcccgaggtccagtcttgtgcagtcgtgggctgaggtgaagagccgtgggcctacgagtgtaacggtttcctgactaaaggtcttacgaaggtaactaaccgtaccctttacgaaccgttaaggtactacgtactaaacgttaaccgtaaagttttcgggggttagtacccggtaccccgtaacggggaccccccccggtaaaccgtaaaaacggggtacccgttttacgggaaacggtttacggggtaaaccgggtttaacgggggtaaagtttccggggggtaaaacgtttaaaccccggttaaaaccggtaccccggtttaccggggtaaaacccgtttaaaaacgttaaaaccggggggtttaaaaaacccctaaaaaaacggttaaaaaaaaaaaccccgttttccgtaaaaaacccgggttaaaccgggttaaaaacccgggttttaaacccccggtaaaacggggggtaaaccccgtttaaaccgggggtaaaaaccgggttttaaccccggttaaaaaccccccggtttttttaaaccccgggaaaaaccgggggtaaaccccgtttaaaaccccgtaaacggggtttaaaccccccgggtaccggggtttaaaaaccgggggtttaaaccgttttttaaaaccccgttttaaaacggttaaagggttttaaaaccggggtaaaccggtttacccgggttaaacggggtaaaccgggttaaaccccggttaaaccgggggttacccccccgtttaaaggggtaaaccgggttaaaaccccggtttaaaacccccggggaaaaaccgggttaaaaccccgggtaaaccccggggtttaaccggttaaccgggtttttaaaaacgttttttaacggtttttttaacccggggttaaccggttaaacccccgggtttttaaaccccgggtttaaaccggtttaacgggggtttaaccgggttaaacgggttttacccgttttaaaaaccggttttaaagggtttaaaccccccgggttttacctttaaaccgggttt

SEQ ID NO: 261303 - DNA, 888 bp, Homo sapiens
  misc_feature: GYAE6OF02HLJFD.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgctagtcgtggggctgaggtgaagaagccgtggggcctcgaggtgtaacgggtttcctggcgtaagggtcctttcgaggtactacctaccttcacgtaggtatgactatacagtttgggtgccggtccgacggacccccggacgaaaggtcgttaggaggtggtacgtgggagtgggactacgaacggtcgtggacaaagttacgggtaaacaaacgtaaaaaatttcgaacgtaacgtaaacgtttaccgaagggtacgaacgacgttaccgttaaccctttaccggtaacgggaaccgtaacgtaccgttacccggtaacgggtaacgggtaacttttaaccgtttaacgttaacgttaacgggtacggtaccgttaagggaacgtaccgtaaacgggtacccgttaggaaacggttaaccgtttaaccccgggaaaacggtaaccgtaacccgggtaacgttacgggtttaacgttttaaggtttttttaccgggtacggttccccggtaaacccggtttacgtttaacgggttaccgggggttaaacgttaaccgtttaacgtttaacggtttaccggaccttttaacgtttaaccggtttaacggtacccgtttaccggggttaacccgggggtacccgttaaacccggggttaacccggtccgggtttaaccccgtaacccggggtttccctaccccgggttaaccccgg

SEQ ID NO: 261304 - DNA, 747 bp, Homo sapiens
  misc_feature: GYAE6OF02JQ7NV.1.5.A05.1.454.CMB.1.raw
  modified_base (208)..(208): a, c, t, g, unknown or other
  misc_feature (208)..(208): n is a, c, g, or t
  modified_base (223)..(223): a, c, t, g, unknown or other
  misc_feature (223)..(223): n is a, c, g, or t
  modified_base (577)..(577): a, c, t, g, unknown or other
  misc_feature (577)..(577): n is a, c, g, or t
tcagacgagtgcgtcacgaccggtgctcgatttagatagatagacaggggacccgaacaaccacatccctcctcagaagcccccagagcacaacgccccaccatggactggacctggatgatcctcttttggtgtcagcagccacaggtgcccactcccaggtccagcttgtgctagtctggggctgaggtgaagagccgtgggcctnaggtggaggtttccngcagggcttcgaggtataccaccttcgaactaggtacttgacttattacgtagtttagggtctacggtcccgacgggacccccccggaagtaaaccggtcgttacggaggtacgggaggtgggtagtacggattaccgaaccggtgttacgggactaggtaacggtaactaactaaaaaagttcaacgaacgtaacgtacgaagggtcaagtagtacgttaacccgttaaccggaaggtaccaacctaatcccgggaacgtaagggtacctttaaccttaagttaggtacggtaacgtacgtaggtaccgaactacggtccgtaagtacgagttaacccgaagtacgtaccggngtttaacgtagtttaggttttacggtagaccgttaccgtttaggtaacggtacggtcggtaacttaagttacgttacgtccgtaaagttactttacgggtactaccccggggttaggacccggttaacgggtaccccggtttggacccgttacccggtttctaaccccgg

SEQ ID NO: 261305 - DNA, 266 bp, Homo sapiens
  misc_feature: GYAE6OF02GKVQV.1.5.A05.1.454.CMB.1.raw
  modified_base (185)..(185): a, c, t, g, unknown or other
  misc_feature (185)..(185): n is a, c, g, or t
  modified_base (194)..(194): a, c, t, g, unknown or other
  misc_feature (194)..(194): n is a, c, g, or t
  modified_base (221)..(221): a, c, t, g, unknown or other
  misc_feature (221)..(221): n is a, c, g, or t
  modified_base (233)..(233): a, c, t, g, unknown or other
  misc_feature (233)..(233): n is a, c, g, or t
  modified_base (244)..(244): a, c, t, g, unknown or other
  misc_feature (244)..(244): n is a, c, g, or t
  modified_base (251)..(266): a, c, t, g, unknown or other
  misc_feature (251)..(266): n is a, c, g, or t
tcagacgagtgcgtcacgaccggtgctcgatttagatagatagacaggggcagttccagatttcaactgctcatcagcagcctgcagtctgaagattttgctagtttattactgtcagcagtataatactggcctccgacgttcgcaagggaccaaggtgaaatcaaacgactgtggctgacacntctgtcttnactcttccgctatctgatcgtactgcnctgagcgggtcnggacaagggcnctaatgnnnnnnnnnnnnnnnn

SEQ ID NO: 261306 - DNA, 669 bp, Homo sapiens
  misc_feature: GYAE6OF02GWSKE.1.5.A05.1.454.CMB.1.raw
  modified_base (221)..(221): a, c, t, g, unknown or other
  misc_feature (221)..(221): n is a, c, g, or t
  modified_base (285)..(285): a, c, t, g, unknown or other
  misc_feature (285)..(285): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctgggctgaggtgaagaagcctggggcctcagtgaaggtttccngcaaggcttcaggatacaccttcactaggtatgctatacattgggtgcgccacggcccccgganaaaggtcttgagtggagtgggatggatacaacgtcgtaggctaagtggtaaacaaacaaaaaactttcaactaagaacgttaccgaggacgagacgtactaccgtttaaccgagggaaccaacgacgtccgacggtaaggtaaccgtttaactttagtagttagggagtacgtgtacgacacgtcccgagacggacgttaccgaacgaccgacggtacgttagtttaagtttagtttttacggcgtacgtaccgtttcgttaaggtggtaacggttcttaagtttacgttaccgtacgttaccgttaagttttcgtaccgttccgtacggggtaccgtaaccgggtaccgttcggttacccgtacccgttccgtccctacccgg

SEQ ID NO: 261307 - DNA, 695 bp, Homo sapiens
  misc_feature: GYAE6OF02F6NB6.1.5.A05.1.454.CMB.1.raw
  modified_base (224)..(224): a, c, t, g, unknown or other
  misc_feature (224)..(224): n is a, c, g, or t
  modified_base (248)..(248): a, c, t, g, unknown or other
  misc_feature (248)..(248): n is a, c, g, or t
tcagacgagtgcgtcacgaccggtgctcgatttagatagatagacagggggacccaacaaccacatccctcctccagaagcccccagagcacaacgccccaccatggactggacctggaggatcctcttttggtgcagcagccacaggtgcccactcccaggtccagcttagtgcagtcctggggctgaggtgaagaagcctggggcctcagtgaaggtttccngcaaggcttcaggactacaccttnactaggtatgctatacagttggtgcgcctacggcccccggtacaaacggtcttacggagtaggagtcgggagtggtatcgaacggcgtcggacaagtaggtaaacaactaaaaacttcaacgtaagtaacgttaccgagggcagtacgtctaaccgaccgtagggacactagtaccggacgaacggtatttaacgtagtagtacggacgtacgtagacgtcgtacgtccgtagaaggtacgaccggaacgacctacgggtctaggttactttagttttacggtacgtaccgttacctcgttagggttacgggtacggttacgtaagtttaccgttacgttcttaccgttaacgttaccgttaccggttacccggttacggggtacccgtaaccgggtaacccggtttccgggtaacccgtacccggtttacccgtcccgttacccgg

SEQ ID NO: 261308 - DNA, 828 bp, Homo sapiens
  misc_feature: GYAE6OF02FO1S8.1.5.A05.1.454.CMB.1.raw
  modified_base (150)..(150): a, c, t, g, unknown or other
  misc_feature (150)..(150): n is a, c, g, or t
  modified_base (223)..(223): a, c, t, g, unknown or other
  misc_feature (223)..(223): n is a, c, g, or t
tcagacgagtgcgtcacgaccggtgctcgatttagatagatagacaggggacccaacaaccacatccctcctcagaagcccccagagcacaaccgccccaccatggactggacctggaggatcctcttttggtggcagcagccacaggtncccactcccaggtccagcttgtgcagtcgtggggctgaggtgaagagccgtggggcctcagtgaaggtttccngacaaggcttcaggatacctaccttcacgtaggtatcgctatactagttgggtcgccgacgaccgggaccccccggaagtaaacggtcgttacggtaggtcgggtaagtggggtaagtgggaactaccaacggccgtacgggaccgtaaagttacgggtaaaaacctaacgtaaaaaaacgttaccaaacgaacggtaaacgtttacccggaacggggtactaggtaacggttacccgttaacccgtttaacccggaaggggtaaccctaaacgtacgtaccccgggtaacgtaacgggtttaactttaaccgtttaaagttaaacggtgggtaaaccgtcggtaaggaacggtaccgaacggtacccgttagggaacgtaacgttacccgggaaagtaaccggaccggttacgtagtttaacgtttagttttacggtacgtccggtaacccttggttaacgggtacgggtacggtcgtttaagtttaccgtacgtacgttacgtttaacgtttcggttaacccgttccgggttaccgggtaacccggttaccgggtaacccgttacggttcccgtaacccggttcccgttaccccggtaacccg

SEQ ID NO: 261309 - DNA, 675 bp, Homo sapiens
  misc_feature: GYAE6OF02GIYWU.1.5.A05.1.454.CMB.1.raw
  modified_base (295)..(295): a, c, t, g, unknown or other
  misc_feature (295)..(295): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctgggctgaggtgaagagccgtggggcctcgagtgtaaggtttcctgacaaggcttcgaggatacaccttcacgtaggtatgctaatacatttgggtgcgccgacggccccccggaanaaacggtcttggagtcggagtggggatggatcaacgcgtggctaagtaggtaaacaactaaaaaattcaacaagtaacgttaccgagggacagagtacctacctttaacgaaggaacacgacgtccgacgaagtactttacttaagtatagggacgtactagacgacgacgtccgtaggagtaacgtaccgaagaaccgacggtacctagttatttagttttagtcggtaccgtaccgttacgttaggtacggtacggttactagtttaacgttacgtacttacgtaagttttaccgaccgttcccggttaccggggtacccgtaaccgggtacccgttacgggttaccccgtaccccggttaccgttcccgttacccgg

SEQ ID NO: 261310 - DNA, 742 bp, Homo sapiens
  misc_feature: GYAE6OF02GMKPZ.1.5.A05.1.454.CMB.1.raw
  modified_base (259)..(259): a, c, t, g, unknown or other
  misc_feature (259)..(259): n is a, c, g, or t
tcagacgagtgcgtcacgaccggtgctcgatttagatagatagacaggggacccaacaaccacatccctcctcagaacgcccccagagcacaaccgccccaccatggactggacctggaggatccttctttttggtggcagcagccacaggtcgcccactcccaggtccagcttgtgcagtcgtggggctggaggtgaagagccgtggggcctcgagtagtacggtttcctgcaaggtcttacaggtataccaccttanacgtaggtatcgtctatactagttgggtcgccgaccgaccgggacccccggaagaacggtcgttggaggtggagtgggagtggactcgacgtcgtggactagtacggtaactaaactaaaacgttcaacgaagtaacgtacgagggacagtacgtacgtaaccgttaccgagggacctacgaccgtaccggacgtaacgttactttaacgttagtacgttagggacgtacggtacgacgtacgtacggtaccgttaggaacggttaacgtacccggaaagtaccggtacggtcttaaggtttacttttagttttcggttacggtaccgttaccgttacgttacgggtacggtacgttacgttaacgtttaccgttacgtcgtttaacgttaacgtttacggtacccgttaccggtaccggggtacccgtaaccgggttacccggttccggttaaccctcccgtttacccgtacccgtacccgg

SEQ ID NO: 261311 - DNA, 711 bp, Homo sapiens
  misc_feature: GYAE6OF02H4DTQ.1.5.A05.1.454.CMB.1.raw
  modified_base (285)..(285): a, c, t, g, unknown or other
  misc_feature (285)..(285): n is a, c, g, or t
tcagacgagtgcgtcacgaccggtgctcgatttagatagatagacagggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgtaaggtttcctgcaaggcttcgaggatacaccttcactaggtatgctatactattggtgcgcacggccccgganaaaggcttgagtggagtagggatgggatcgaacgcgtaggactaagtaggtaaacaaacgtaaaaattcgaaactagtaaacgttaccgaagggtacaagacgtacctaaccgtttaaccgacgggaactacgacgtccgacggtacgtactttaacgttatacgttaggagtacgtaggacgtacacggtccgtagagtacgtaccgaaagaccgtacgtacgtcgttaaagtttagtttttacggacgtaccgttaacccttagttaacgggttacggtaacggttacgttaactttaacgttaccgtaccgttttaacgtaacgttttaacggtacccgttacccggttacggggaccccggttaacggggtaaccccgttggggttaccccttaacccggttacccgtttacccgtaccccg

SEQ ID NO: 261312 - DNA, 725 bp, Homo sapiens
  misc_feature: GYAE6OF02FPOLG.1.5.A05.1.454.CMB.1.raw
  modified_base (223)..(223): a, c, t, g, unknown or other
  misc_feature (223)..(223): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcgagtgaaggtttccngcaaggcttcaggatacaccttcacttaggtatgctatacagttggtgcgccaggcccccggacaaggcttgaggtggagtgggatggatcgaacgctggcaagtggtaaacaagtaaaaattcaacgagtaagttccgagggcagagtcaaccgtttacgaggtacacactccgacgtaggtactttacttagtattagggactacggtaggacgacgtacggtaccgtaggacggtaacgtacccggaaaggaccggtaccggtacgttacggttaagtttacgtttttacggtcggttaccggtaaccgttcgttacgggttacgggtacggtttaccgttaagttttaacgttacgggttaccttaaccggtttaaacgtttttaccgaaccgtttaccccggggtacggggttaacccccggtaaccgggggttaaccccggtttacggggttaccccggttacccccggtttaccccggttcccgttaacccccgg

SEQ ID NO: 261313 - DNA, 537 bp, Homo sapiens
  misc_feature: GYAE6OF02G7RYU.1.5.A05.1.454.CMB.1.raw
  modified_base (467)..(467): a, c, t, g, unknown or other
  misc_feature (467)..(467): n is a, c, g, or t
  modified_base (535)..(535): a, c, t, g, unknown or other
  misc_feature (535)..(535): n is a, c, g, or t
tcagacgagtgcgtcacgaccggtgctcgatttagatagatagacagggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaacggcttgagtggatggggatggatcaacgctggcaatggtaacacaaaaattcacagaagttccagggcaggagtcacctttacacgggacacataccgcgacggattacttatatggagactgagcagcctgagagtccgaagtacacggactggtactatttttcgtgtcgacctnttacgtggaggtcgattagttacgctcaatttgactcttgggccgacgggacctcggtcacgtctccncg

SEQ ID NO: 261314 - DNA, 644 bp, Homo sapiens
  misc_feature: GYAE6OF02HAKYM.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagcaacaggtgcccactcccaggttcacctggtgcagtctggagctgagctgcagaagccgtggggcctcgagtgatggtctcctgcagtgcttctggttacattctttccactacgtatgattggtgagacgacggcccccggaggacggggcttggaggtcggtagtgggagtcggagtcgacggcccgttaacggaaacgtaaacgagagtagtacggagtagaaggttacgaagggcaggtagtacatacactcgaccggcgacgtacacgtaccgacgacgtacacgctacgagtacggaacgtaggacggacgccgtacgtaacgacttacgtacggaacgacgtaccggtaaccctaacgtttacgtttaacggtacgaccggtacgaacggtaagtactttacgttcgaacgtacgttaccgggtcgttcgggtacgttaccggttaaccggacgttcggttccggttaccgggacgtacggtacggggtaaccccgg

SEQ ID NO: 261315 - DNA, 602 bp, Homo sapiens
  misc_feature: GYAE6OF02FKPZ9.1.5.A05.1.454.CMB.1.raw
  modified_base (206)..(206): a, c, t, g, unknown or other
  misc_feature (206)..(206): n is a, c, g, or t
  modified_base (284)..(284): a, c, t, g, unknown or other
  misc_feature (284)..(284): n is a, c, g, or t
  modified_base (333)..(333): a, c, t, g, unknown or other
  misc_feature (333)..(333): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctgggcctnagtgaaggtttcctgcaaggcttcaggatacaccttcactaggtatgctatacattgggtgcgccaggccccccgganaaaggcttgagtggagtgggagtggatcaacggctggcaatggtaacanaaaaaattcaacagaacgttcgagggcaggtagtcaacctttaccgaaggacacatccgcgagattacttagtatggagcgtgagcagcctaggagataccgaagaccgacgtctagttattagttttgtgtccgtccttacgttaggttgggtaagtcgttaagttatttaccgcgtagttaacgtttcgtaaccgttccccgttaggggacccgtaacggggtaaccccgttgggtaccccgtacccgttccgacccgtttacccgg

SEQ ID NO: 261316 - DNA, 691 bp, Homo sapiens
  misc_feature: GYAE6OF02JOBLD.1.5.A05.1.454.CMB.1.raw
tcagacgagtgcgtcacgaccggtgctcgatttagatagatagacaggggacccaacaaccacatccctcctcagaagcccccagagcacaacgccccaccactggactggacctggaggatcctcttttggttggcgagcagccacaggtgcccactcccaggtccagccttgtgcagtctgggctgaggtgagagctgggcctcagtgtaggttcctgcaaggtcttgaggtatactccttacacgtaggtagtgcgtatactagttgggtgcgtccgaccggcccccggacgaaacggcgtggtacggtggaggtaggaggtgacgtacgaacgtccgtaggacgaacgtaggtaacgaactaaaaagtactaacgaaggtaacgttacgaacgggtagaacggagtacctacccgttacggaacggtaacgtaaccgtagtaccgacggtacgattaacgttatatcgagcgtagagactacggacctgagtagccgtaaggaccacggtaccgtagttacgtttagtttacggtacgtcgtaccgttcgttagtacgggagttacgtacgtttacgttacgtacttacgttaacggtttcgtacccggttccggttaccgggtaaccgttacccggggtaacccggttccggtccgtaaccccggtttcgttaaccccgtcccggg

SEQ ID NO: 261317 - DNA, 301 bp, Homo sapiens
  misc_feature: GYAE6OF02FJ5I4.1.5.A05.1.454.CMB.1.raw
  modified_base (268)..(301): a, c, t, g, unknown or other
  misc_feature (268)..(301): n is a, c, g, or t
tcagacgagtgcgtcacgaccggtgctcgatttagatagatagacaggggcagttccagatttcaactgctcatcagcagcctgcagtctgaagtattttgctagttttattactgtacagcagtataataactggcctccgacgttcggccaaggccaaggtgaaatcaaacgaactgtggctgacctaccattctgtcttcaactcttccccgcattctgactccgtactgcgctgagcgggtctggcaacggcgacctagtacgnnnnnnnnnnnnnnnnnnnnnnnnnnnnnnnnnn

SEQ ID NO: 261318 - DNA, 772 bp, Homo sapiens
  misc_feature: GYAE6OF02GTXUH.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtcgtggggctggaggtgaagaagccgtgggcctcgaggtgaaggtttcctgcgaaggcttcgaggatacaccttcactaggtatgctatactagttggtgcgtccgaccggcccccggaagaaaggtcttacggaggttgggacgttggggacgtagggactaccggaacggtcgtggtaccgaaagtacgggtaaaactaaacgtaaaaaattccgaacgtaagtaaacgttaccgaagggactacggtaacgttacccgttaacccgtttaaccggaacgggtaaccctaacggaaccggttccggtaacccgggaaggttaaccttttaacgttaacgttaacggtacgggtaagtccgttaagggacaccgtacggtaccgtaggaagttaaccgacccggtaaacgacgtacccggtagttagtaaacgttttcgtttaggtcgtaacccgtccgttacgttaagggtacggtagttacctaagtttaacgtcggtaccttacgttaacgttaccgttaccgttccggggtacggaccgttaaccggggttacccttagggttccctaaccggtcccgttccgtaacccgg

SEQ ID NO: 261319 - DNA, 651 bp, Homo sapiens
  misc_feature: GYAE6OF02IN6F6.1.5.A05.1.454.CMB.1.raw
  modified_base (209)..(209): a, c, t, g, unknown or other
  misc_feature (209)..(209): n is a, c, g, or t
  modified_base (219)..(219): a, c, t, g, unknown or other
  misc_feature (219)..(219): n is a, c, g, or t
  modified_base (226)..(226): a, c, t, g, unknown or other
  misc_feature (226)..(226): n is a, c, g, or t
  modified_base (234)..(234): a, c, t, g, unknown or other
  misc_feature (234)..(234): n is a, c, g, or t
  modified_base (244)..(244): a, c, t, g, unknown or other
  misc_feature (244)..(244): n is a, c, g, or t
  modified_base (433)..(433): a, c, t, g, unknown or other
  misc_feature (433)..(433): n is a, c, g, or t
  modified_base (439)..(439): a, c, t, g, unknown or other
  misc_feature (439)..(439): n is a, c, g, or t
  modified_base (489)..(489): a, c, t, g, unknown or other
  misc_feature (489)..(489): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtcgcccactcccaggtccagcttgtgcagtcgtggggctgaggtgaagagccgtgggcctnagtgagttcngcagctnagactacnctcatagtangctatacagttggtgcgccgcggacccccggagaaacggtcgttagaggtggagtggggagtgggatacgaacgcgtggactaagtaggaaactaactaaaaaattcaaacaagaacgttccgaagggacacgaagtcctaacctttacacgggtaacacactccgacgtaggactttacgtattaagnggagtntggacgtcgcgccgtgaagtcgtaaccggaaacgccggtaacgttacgtnttagtttaagttttcgttacgtaccgtactttacggtacgtagggttactactttagttaccgtttacgtccgttacttaagttttacgtaacttccgggttaaccgggacccgtaaccggtaacccggttccggtaccctaccggttcctccccggtaacg

SEQ ID NO: 261320 - DNA, 963 bp, Homo sapiens
  misc_feature: GYAE6OF02H6ISZ.1.5.A05.1.454.CMB.1.raw
  modified_base (135)..(135): a, c, t, g, unknown or other
  misc_feature (135)..(135): n is a, c, g, or t
tcagacgagtgcgtcacgaccggtgctcgatttagatagatagacaggggacccaacaaccacatccctcctcagaagcccccagagcacaaccgccccaccatggactggacctggaggatccttctttttggnggcagcagccacaggtgcccactccccaggtccagcttgtgcagtctggggctgaggtgaagagcctggggcctcagtgaaggtttcctgcaaggcttcaggataccaccttcacgttaggtatgactatacagttgggtgcgcccgacggtacccccggaacgaaacggtccttggaagtcgggaagttggggagttagggataccgtaacggtctgggaccgtaaagttacgggtaaactaaaccgtaaaaaaaatttccgaaacgtaacggtaaacggtttacccgaaacgggggtaaccgtaacggtacggttaacccgtaaaccccgtttttaaacccggaacggggggtaaacccaacccgttaaaccggttaccccggggtaaccggtaaccgggggttaaactttttaaacgtttaaacgtttaacggttaacggggtaaacggtacgttacggaacggtacgtacggtaccccgttaagggtacgaacggttacccggaaacggtaaccggtaaaccgggtccgtttaacgttaacggttttaacgttttttaacgggcggtttaaacccgggtaccccgtttacggtttaacgggttaccggggtaaacgggttaccgtttaaacttttaaaccgtttacgggttaaaccgtttaacgtttaaaccggttttttaaccgtacccggttttaaccccggggtttaaccggggggtacccccgggttaaacccgggggtttaaacccccggttacccgggggttttacccccgttaaaccccccgggttttacccggtttacccccggttaacccccggg

SEQ ID NO: 261321 - DNA, 860 bp, Homo sapiens
  misc_feature: GYAE6OF02IAR3Z.1.5.A05.1.454.CMB.1.raw
tcagacgagtgcgtcacgaccggtgctcgatttagatagatagacaggggacccaacaaccacatccctcctcagaacgcccccagagcacaacgccccaccatggactggacctggaggatccttctttttggtggcagcagccacaggtcgcccactcccaggtccagcttgtgcagtctggggctggaggtgaagaagccgtggggcctcgaggtggtaacggttttcctaggacgtaacggtccttacgaggtaacttaaccgtaccctttaccgtaacgttaagggttacttacggtaccttaacgttaaccgtaaggttttcggggtacgtccggaccccggtaacccggggacccccccgggtaaacgtaaaacggggtccgtttaggtaacgggttacgggaaggttgggggtaacgttacgggaacttaccggtaaccggtcggtacgggtaaccgttaacggtaacgggtaaaccaaaaaccgttaaaaaaacgttccgaaacgtaaacggtaaacggttaacccgaaggggtacgaacggtaccgttaacccttaccggtttaacccgacgggaacctaacgtaccgtacccggaacggtaggtaaccttttaacgttagtaaggtacggtaacgtcgtaaggacgtacgacggtaccgtaggaacgttaccggaaccgaaagtacccgacgggttactacggttaattttacggttttcgacggttccgttaccgtagtttagggtggtacggttattagttaacgttactcgttacgtaaggtttcgtaccgtcgggtacggtccggtacgggaccgttccggtaccttaccggtcctccgtaccgg

SEQ ID NO: 261322 - DNA, 705 bp, Homo sapiens
  misc_feature: GYAE6OF02IOBAM.1.5.A05.1.454.CMB.1.raw
  modified_base (222)..(222): a, c, t, g, unknown or other
  misc_feature (222)..(222): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagccgtggggcctcagtgaaggtttccngcaaggcttcaggatacaccttcacgtaggtatgactatactagttgggtagcggccgacggacccccggaagaaacggtcttaggaggtcggagtgggagtggataccgaacggtctaggactaagtaggtaaacctaaacgaaaaattacgaacaaggtaacgttccgaagggcagacgtacctaaccgttacgacgggaaccacgtacgtcccggacggtacggtaactttaacgttaagtaacggtacgggtacgtaccgttaggacgacgtacgtacccggtagtaacggtaacgtacccggaaacgtaaccgtacggtacgttacgtttaagttttaacgttttggtaccggttacccgtacgttacgttaagggtcggtacgtcgttaatttacgtacgtactagttaactttcgaccgttcgtacgggtacccgaccgggtaacccgtggtacccgtacgttcccgtacgtaccg

SEQ ID NO: 261323 - DNA, 794 bp, Homo sapiens
  misc_feature: GYAE6OF02HB09E.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtcgtggggctggaggtgaagagccgtggggcctcgagtgtaaggtttcctgacaaggcttacgaggtactacctaccttcacgtaggtatgacttaatactagttgggtcgccggaccgaccgggaccccccggaagaaaacgggtccgttaggaacgggttgggaaggttacgggggattcggggactaccgaaccgtcgtacgggacgtaaagtacgggtaaaacctaaacgtaaaaaactttccgaaacgtaaggtaacggttaccggaagggacctaaggtacgtacctaaccgtttacggaacgggtaccaacgtacgtaccgagtaaggtaacttaacgttagtaacgtggacgtacgtggtaaccgcgtaacgtaccgtaggaacgtaacgtacccggaaaacggaccgaaccgggtcgttaaggtttaacttttaggtttttacgacgtaccgtaccgttacgttagggtggtaacgttacgttacgttaacgttacggtaccttaacggttagttttaccgaccggtttaccgggtacggggtaaccccgtaacggggttaaccccgttacggtcccggttaacccggttaccctacccggttaacccgg

SEQ ID NO: 261324 - DNA, 206 bp, Homo sapiens
  misc_feature: GYAE6OF02G7ZSP.1.5.A05.1.454.CMB.1.raw
  modified_base (175)..(175): a, c, t, g, unknown or other
  misc_feature (175)..(175): n is a, c, g, or t
  modified_base (180)..(206): a, c, t, g, unknown or other
  misc_feature (180)..(206): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttccagtactctatctgagcgggctggcaaggcgnatagnnnnnnnnnnnnnnnnnnnnnnnnnnn

SEQ ID NO: 261325 - DNA, 669 bp, Homo sapiens
  misc_feature: GYAE6OF02H0X54.1.5.A05.1.454.CMB.1.raw
  modified_base (454)..(454): a, c, t, g, unknown or other
  misc_feature (454)..(454): n is a, c, g, or t
  modified_base (471)..(471): a, c, t, g, unknown or other
  misc_feature (471)..(471): n is a, c, g, or t
  modified_base (653)..(653): a, c, t, g, unknown or other
  misc_feature (653)..(653): n is a, c, g, or t
tcagacgagtgcgtcacgaccggtgctcgatttagatagatagacaggggacccaacaaccacatccctcctcagaacgcccccagagcacaacgccccaccatggactggacctggaggatcctctttttggtggcagcagccacaggtgcccactcccaggtccagtcttgtgcagtcgtggggctgaggtgaagagccgtgggcctcgagtggtaacggtttcctgacgaacggtcttacgaggtaactacctaccttcgaacgttaggtatacgtacttactacgtagtttacgggtcggtacgaccgaccggacccccggaagaacggtcgttaggtaggtggacgtagggtagtaggatacgtacgcgtggactacgtaagtaacaaactaaatacaacgagtacgtacgacgtacgagtactactacgtacgtagacacgtacgcgngagtactaagtagtagngtagcgtagactcgacgtcgtagaacgtcgaaccgagtaccggtagtcgtagttactttacggtttcgaccgtcgaaccgtttgtacgtcggtacgtaagttacgttacttacgtcgtttactaagttccgtcgtaccgggtacggaccgttaaccgggtaccgtcggtaaccccggtttanccccgttataccccgg

SEQ ID NO: 261326 - DNA, 184 bp, Homo sapiens
  misc_feature: GYAE6OF02F23GJ.1.5.A05.1.454.CMB.1.raw
  modified_base (180)..(184): a, c, t, g, unknown or other
  misc_feature (180)..(184): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttcctactgctagtctgagcgggctggcaaggcgcatagnnnnn

SEQ ID NO: 261327 - DNA, 198 bp, Homo sapiens
  misc_feature: GYAE6OF02IE9P8.1.5.A05.1.454.CMB.1.raw
  modified_base (172)..(172): a, c, t, g, unknown or other
  misc_feature (172)..(172): n is a, c, g, or t
  modified_base (178)..(198): a, c, t, g, unknown or other
  misc_feature (178)..(198): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttccagtactctatctgagcgggctggcaaggcncatagnnnnnnnnnnnnnnnnnnnnn

SEQ ID NO: 261328 - DNA, 568 bp, Homo sapiens
  misc_feature: GYAE6OF02FV9IZ.1.5.A05.1.454.CMB.1.raw
  modified_base (448)..(448): a, c, t, g, unknown or other
  misc_feature (448)..(448): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacacgaaaaaattcaacagaattcgaggcagtagtcacttacagggacacatccgcgagattactatatggagctgacgcagcctgagacgtaccgaagacgacggctagtattattttgngcgtaccttgtagtggtagtcgtaattattaccgcttactaagtttcgaccttaccggtcggggtaccctaacggggtacccgttagggttcccaacccggtttcctcccgttaacccgg

SEQ ID NO: 261329 - DNA, 626 bp, Homo sapiens
  misc_feature: GYAE6OF02H2A5W.1.5.A05.1.454.CMB.1.raw
  modified_base (387)..(387): a, c, t, g, unknown or other
  misc_feature (387)..(387): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttttggtggcagcagccacaggtgcccactcccaggtccagcttgtgcagtctggggctgaggtgaagaagcctggggcctcagtgaaggtttcctgcaaggcttcaggatacaccttcactaggtatgctatacattggtgcgccaggccccgacgaaggcttgagtggagtgggagtggatcgaacgcgtggacaagtaggtaacaactaaaaatacaacagtaacgttcgaggacagagtcactttaccgaggacanactcgcgagactttacgttatagtaggagctaggaagcacgccgtagacgtacgtaccgaagtacgacggctagttagtttatttttaggtagtcgtaaccgttcgtagttgggtaaacggttctaagtttacgttacgtccttacgtaagttttacgtaccgttccggttaacggggaccgtaccgggggtaacccgttcgggttaacccgtacccggttaccgttcccgttacccgg

SEQ ID NO: 261330 - DNA, 1061 bp, Homo sapiens
  misc_feature: GYAE6OF02IQOUA.1.5.A05.1.454.CMB.1.raw
  modified_base (272)..(272): a, c, t, g, unknown or other
  misc_feature (272)..(272): n is a, c, g, or t
  modified_base (289)..(289): a, c, t, g, unknown or other
  misc_feature (289)..(289): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcaggtgaaggtttcctgacaaggcttcgaggatacaccttcactaggtatgctatacattgggtncgccacggcccccgganaaacggcttgagtggagtggatggatcaacgcgtggcaagtaggtaacaacaaaaattcaacgaagtaacgttaccgaagggtacaaggacgttccaacccgttttaaccgaaggggtaaccaacgtaacgttacccggaacggtaacgggtaacttttaaccgtttaagttaacgttaacggggtaacggtaccgttaggtaacggtacctaacgggtacccgttaggggaaacgttaaacccggttaacccgggttaaaaaccgggaacccgtaaaccgggggttaaccgttaacggggttttaaacgttttttaacgggtttttttttaccgggtacgggtttaacccccggggttaaacccgttttaccgggttttaaacggggttacccggggggttaaacgggttttacccgtttaaaacggttttttaaccgggttttaacccccggttaaccggtttttaaccccggtttaaaacggttttttttaacccggggttaaaaccccccgggtttttttaccccccgggggttttaaccccggggggggggggggttaaaaccccccccccggggttttttaaaaaacccccccgggggggggggggtttaaaaaaccccccccccgggttttttacccccgggggggggggtttttaaaaaccccccccctttttaaaacccccccccccggggggggggttttttttaacccccccccttttaacccccccggggtttttttaaaaacccccccccccggggggg

SEQ ID NO: 261331 - DNA, 653 bp, Homo sapiens
  misc_feature: GYAE6OF02JF2C2.1.5.A05.1.454.CMB.1.raw
  modified_base (225)..(225): a, c, t, g, unknown or other
  misc_feature (225)..(225): n is a, c, g, or t
  modified_base (357)..(357): a, c, t, g, unknown or other
  misc_feature (357)..(357): n is a, c, g, or t
  modified_base (427)..(427): a, c, t, g, unknown or other
  misc_feature (427)..(427): n is a, c, g, or t
tcagacgagtgcgtcacgaccggtgctcgatttagatagatagacaggggacccaacaaccacatccctcctcagaagcccccagagcacaacgccccaccatggactggacctggaggatccttcttttggtggcagcagccacaggtgcccactcccaggtccagcttgtgcagtcgtggggctggaggtgaagacgccgtggggcctcagtgtaagtttccngacaggtcttacaggtatacaccttcacgtaggtatcgtctatactagttgggtcgccgtaccgacggccccccggaagaaacggtccttaggacggtcggagtcgggataggactacgaacgcgtacgganaacgtaggaaaccaaactaaaaattcaacaagtaagtccgaggacagacgtactaacttaacgagacacncgaccgagagtattacgtatagtggactgtagacgactacgcgtaagacgtaacgtaccgaagacgacggtactagttaacttgttttaccggagtaccgtaacgttcggtagtacggttacgtcgttaactttacgtacctacttacgttacgttacgtaccgtccgggtccgggaacccggttaccggtaccgtacggtaccctacccggttctcccgtaccgg

SEQ ID NO: 261332 - DNA, 787 bp, Homo sapiens
  misc_feature: GYAE6OF02JHBIF.1.5.A05.1.454.CMB.1.raw
  modified_base (286)..(286): a, c, t, g, unknown or other
  misc_feature (286)..(286): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagccgtggggcctcagtgaggtttcctgcaggcttcaggatacacctttcacgtaggtatgctatacattgggtgcgccgaggcccccgganaaggctgcgtggacgtgggatggatacgacgcgtggactaagtcgggtaaaccaaacgtaaaaaattccgaaacgtaacggtaaacggttacccgaaggggacgtaacgaacggttcccgtaaacccgttttaaccggaaggggtaaccctaaacgaaccgtacccggacgggtaaccggttaagttttaaaccgtttaaagtacgtttacggggtaacggtcggttacggtaggaccgtaacggtccccgtaggaacgtaaccgttaccggaaacggaacccgacgggtaccttaagggtttaaccttttagtttttacggtacggtacccgttaacccgtttacgtaacgggtttacggaacggtttacgttaagtttaaccgtttaccggtactttacgtaacgtttttcggaccgttacccggttaggggtaccccgtaaccgggttaaccccgttgggttaccccgtaacccgggtttccttaaccccggtaccgg

SEQ ID NO: 261333 - DNA, 775 bp, Homo sapiens
  misc_feature: GYAE6OF02IIQQP.1.5.A05.1.454.CMB.1.raw
  modified_base (149)..(149): a, c, t, g, unknown or other
  misc_feature (149)..(149): n is a, c, g, or t
  modified_base (539)..(539): a, c, t, g, unknown or other
  misc_feature (539)..(539): n is a, c, g, or t
tcagacgagtgcgtcacgaccggtgctcgatttagatagatagacaggggacccaaacaaccacatccctcctcagaagcccccagagcacaacgccccaccatgactggacctgggaggactccttctttttggtggcagcagccacnggtgcccactcccaggtccagcttgtgctagtcgtggggctggaggtagaagaagccgtggggcctcaggtaggtaacggtttccgtgacgaaggtcttaccgaaggatacctacccttacacgtaggtatcgacttaatactagttggggtgacgccgaccggtaccccccggaacgtaaaggtccgttggacggttgggacgtggggtagtgggtatacgaaacgtctggacaagtacggtaacaaactaaaaattcaacaagtaaacgttccgagggtacgacgaacgtacctaaccgtttaaccgacgggtactaacgacgtacccggacgtaaggtactttaacgttaagtagttaggtagtacgttggagtcgtacgtacccgnggaacggtactaacggaaacgtacggaccggtacgttcggtttaaagttttcggtttttacgtcgtaacccgttacgttccggtttaaacggggttcggttaaggtacctttaaggtttaccttaccggtcgttaaaccgttggttttaccgacccggtttcgggtacgggttacccgggttaaccgggtaacccggttaccggttcccggtaaccggttcccttaccggtacccg

SEQ ID NO: 261334 - DNA, 182 bp, Homo sapiens
  misc_feature: GYAE6OF02JSZ3H.1.5.A05.1.454.CMB.1.raw
  modified_base (178)..(182): a, c, t, g, unknown or other
  misc_feature (178)..(182): n is a, c, g, or t
tcagacgagtgcgtcacgaccggtgctcgatttagatagatagacagggcaccaagggcccatcggtcttcccctggcaccctcctccaagagcacctctggggcacagcggccctgggctgcctggtcaaggactacttcctcgtactgcgctgagcgggctggcaaggcgtcatgnnnnn

SEQ ID NO: 261335 - DNA, 759 bp, Homo sapiens
  misc_feature: GYAE6OF02GNEXK.1.5.A05.1.454.CMB.1.raw
  modified_base (293)..(293): a, c, t, g, unknown or other
  misc_feature (293)..(293): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggtcttacgaggactacgaccttcactaggtatgctatacagttgggtgcgccgacggacccccgganaaaggtcttggagtcggagtgggatggactacgaacgcgtaggactaagtacggtaaacaaacgtaaaaaacttcgaacgtaacggtaaacgttaccgaagggacaacggtacgttaacccgtaaccgttttaaccgaacgggtaacacgtacgtaccggacgtaagtaacttttaaccgttaagtacgtagggtacgtcgtagacgacgtacggtcccgttagaacgtaacgtaccggaaacgtaccggaaccgttagttacggttaaagttttggttttttaccggacggttacccgtaccttaggttaacgggttagggtaaacgttcgtaagttttaccgttaccgttacgttaaccgtttaaagtttccggtaaccgttccgggtacggggtaaccccggttaaccgggggttaacccgttcgggttacccgaacccggtttccctacccggttaaccccg

SEQ ID NO: 261336 - DNA, 821 bp, Homo sapiens
  misc_feature: GYAE6OF02HSJCE.1.5.A05.1.454.CMB.1.raw
  modified_base (287)..(287): a, c, t, g, unknown or other
  misc_feature (287)..(287): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttgaggatacaccttcaactaggtatgtctatacattgggtgcgccacggcccccgganaaaggcttcggagtggagtgggatgggatcgaacgcgtggactaagtacggttaaacaaacgtaaaaaacttcgaaccgtaaaggtaaccgtttaccccgaaaggggactaacggtaacggtttacccgtaaacccgttttaaacccggaaggggaaaccctaaccgtaaaccgtttacccgggaaccggtaaaggggttaaacttttaacccgtttaaagttaacgttaacggggttaacgtaccgtttagggaaacgtaccgacgggtccctttagggaaacggtaccgttaacccggaaaggaacccgtaacgggtacctacgggtttaaacttttaagtttttcggtaccgtaccgggtacctttaccgggttaggttacggggtaacgtttactaagttttaacgttaccgtactttacgtaaccttttacggaacccgtttccggttaccggggggtacccgtaacggggttaaacccccggtttgggttaaccccgtacccggtttacccgttaccccgttaccggg

SEQ ID NO: 261337 - DNA, 775 bp, Homo sapiens
  misc_feature: GYAE6OF02FU4HV.1.5.A05.1.454.CMB.1.raw
  modified_base (579)..(579): a, c, t, g, unknown or other
  misc_feature (579)..(579): n is a, c, g, or t
tcagacgagtgcgtcacgaccggtgctcgatttagatagatagacaggggaccaaaaaaccacacccctccttgggagaatcccctagatcacagctcctcaccatggacgggacctggagcattccttttcttggtggcagcagcaacaggtgcccactcccaggttcacctgggtgcagtctggagctgagctgcaagaagccgtggggcctgagtgagttcggtctccgtgctagtgtcttcgttacggttactagtttcctttacctaccgttacggttacttagtaagtttaggttagtaaggtaccggaaccggggtcccccgggaaggggaccgggggttcttagggtaggttcggaagttacgggggtagtcgggtactccgtaaccgggtaccccgttaaacggaaaaaccttaaaaacgggaagtaaggttaacgtagggtaaaggtaacgggtaaacggtttaccggaaggggtacgaacgggttacgtacgtaacgtacctaacgttaacccgaaccgggaccggtaaacctaacggtaaccttacccggaaacggtacggtaaccnccgttacccggtactaacggtaacggaacggttacgggaacggtcctaccgtagaaccgtagttccgacggtaaccaaccgaccggtattaccggttacttagtcgaccgacggagtacgtagtttacgcctaagtcgttacggtccgtcgtacgtactacggctggtcggtcggcctacgggttccggaacccgg

SEQ ID NO: 261338 - DNA, 843 bp, Homo sapiens
  misc_feature: GYAE6OF02FQMX6.1.5.A05.1.454.CMB.1.raw
  modified_base (226)..(226): a, c, t, g, unknown or other
  misc_feature (226)..(226): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactccccaggtccagcttgtgcagtcgtggggctgaggtgaagaagccgtggggcctcagtgaaggtttccngcaggcttcgaggatactaccttcactaggtatgctatactagttgggtcgccgaccgacggccccccggaagaaagggtcttggaaggtgggagtaggggagttggtaactaccgaacggtcgtagggtacctaaacggtacgggttaaaactaaaaccgtaaaaaaactttccgaaaaccgtaaacggttaaaccggtttaccgaacgggggaactaacggaacggttaccgttaacccgttttaaccggaaacggggaaccttaacgtaaccgttcccgggacggtaacggttaacgtttacttttaacgtaacgttggggtaacgtcggtaggaggtacgacggtaccggttacgaagtacggtaccggtaaaggacccgtacgggttacgtttacggtttaacgttttaggtttttacgggttaccgtaccgtttaaccggtttacgtttaacggttcggggtaagtttaccgtttaagttttaaccgttacggttacctttaacgtttaacggtttaacgttaacccggttcccgggttaccggggttacccggtaacccgggtaaccccgttccgggttaccccgcccgtttaccgtccccgttacccgg

SEQ ID NO: 261339 - DNA, 734 bp, Homo sapiens
  misc_feature: GYAE6OF02F6P43.1.5.A05.1.454.CMB.1.raw
  modified_base (605)..(605): a, c, t, g, unknown or other
  misc_feature (605)..(605): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagccgtggggcctcagtgtaaggtttcctgacaaggcttacaggataccaccttcacttaggtatcgctatacagttggggtgcgccgacggcccccggacgaaacggcttaggagtggagtgggatgggactcgaacgcgtcggacaagtacggtaaaccaaacgtaaaaaattccaacgaagtaaacgttacccgagggaccaaggacgtacctaaccgttttaaccgaacgggtacaccgacttaccggacgtaacgggtaacttttaaccgtaagttacggtaggagtaccgtagacggcgaacgtccgtaaggacgacgtaccggaacgaaccgtacggtaccttagttaacttttacgttttaggcgttaccgaaccctttgttaaacgggttaggtacggttnttaaactttacgttaccgggttacttacgtttaaacgttttacggtacccgttcccggtaaccggggtacccgtaacgggggttacccttacgggtacccgtacccgttacccgttcccgtaaccccgg

SEQ ID NO: 261340 - DNA, 1048 bp, Homo sapiens
  misc_feature: GYAE6OF02H2HJG.1.5.A05.1.454.CMB.1.raw
  modified_base (133)..(133): a, c, t, g, unknown or other
  misc_feature (133)..(133): n is a, c, g, or t
tcagacgagtgcgtcacgaccggtgctcgatttagatagatagacaggggacccaacaaccacatccctcctcagaacgccccagagcacaacgccccaccatggactggacctggaggatccttcttttggnggcagcagccacgaggtcgcccactcccaggtccagcttgtgctagtcgtggggcttggaggtgaaggaacgccgtggggcctcgaggttgtaacgggttttcccagggacaagggtccttacgaacgggtacttaaccctacccgttttacgaaccgttaggggttaacttcggtaccttaagttaaccgttaggtttacgggggttaccggacccgggtaccccgtaaccccggggtaccccccccgggaaaccgtaaaaacggggttccgtttacgggtaacggttacgggtaacggttacggggtaaggttacggggtaacctacccggtaaccggtaccgtaacggggtaacccgtaaacgttaccggggttaaaaaccaaaaaccgttaaaaaaacgtttaccccaaaaggtaaacggttaaaaccggtttacccgggaacggggttaaccgtaacgggttaaccggttttaacccggttaaaccccgtttttaaacccgggaacgggggtaaacccttaaacccgtaacccgggttacccggtaacccggggttaaacgggttaaacctttttaaccggtttaacgtttaaccggttaacgggtaaacccgggtttccggttaaaccggggttaaccggaacccggttaacccggggaacccggtttacgggtaaaaccggggtttaacccgttaacccggaaaccggaacccggttacggggtaaccgttagggttttaacgttttacgtttttacgggtaccgtaaccggtttaaccgtaccggtttaacggtacgggtttacggactttaagtttacgttaccggtacctttacgtaacgtttacgtacgtaccggtacgggtaccaccgggtacctacggtaccgaccgttcctaccgtacccg

SEQ ID NO: 261341 - DNA, 757 bp, Homo sapiens
  misc_feature: GYAE6OF02IL2J8.1.5.A05.1.454.CMB.1.raw
  modified_base (139)..(139): a, c, t, g, unknown or other
  misc_feature (139)..(139): n is a, c, g, or t
  modified_base (217)..(217): a, c, t, g, unknown or other
  misc_feature (217)..(217): n is a, c, g, or t
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
  modified_base (253)..(253): a, c, t, g, unknown or other
  misc_feature (253)..(253): n is a, c, g, or t
  modified_base (283)..(283): a, c, t, g, unknown or other
  misc_feature (283)..(283): n is a, c, g, or t
tcagacgagtgcgtcacgaccggtgctcgatttagatagatagacgaggggacccaacaaccacatccctcctcagaacgcccccagagcacaaccgccccaccatggactggaccgtggaggactccttctttttggnggcagcagccacgaggtgcccactcccgaggtccagtcttgtcgcagtcgtgggctgaggtgaagagccgtgggcctnagtggtaggtttccngacgaggtcttnaggataccncttcacgtaggtatgctatactagttgggngccgaccgacggaccccccgggacgaaacggtcgttacgaaggttcgggacggtggggtaggttacgggtacgtacccgaaccgggtcgttacgggactaaagttacggtaaaacctaaaacgtaaaaaacgttaccgaaacgtaaacggtaaccggtttaccggaagggtaccgaaggtacgttaaccgttaacccgtttaccggaacgggaacctaacctacggtacccgacgggtaacggttaactttaactttaacgtttaggtacgggtaagtcgttaagtacgacgacgtaccgtagacgtaactacccggaagaaccgtacgtgtacgtttattttagttttcgtacggtccgtacgttacgttaggttcggtacgttactagtttacgtactacgttacttaagtttacgcgttaccgtacgggtacctacgggtacccgtaggtcccgttactccgtccgtaccg

SEQ ID NO: 261342 - DNA, 723 bp, Homo sapiens
  misc_feature: GYAE6OF02HV019.1.5.A05.1.454.CMB.1.raw
  modified_base (228)..(228): a, c, t, g, unknown or other
  misc_feature (228)..(228): n is a, c, g, or t
  modified_base (526)..(526): a, c, t, g, unknown or other
  misc_feature (526)..(526): n is a, c, g, or t
  modified_base (611)..(611): a, c, t, g, unknown or other
  misc_feature (611)..(611): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtcgcccactccaggtccagctgtgcagtcgtgggctggaggtagaaggagccgtggggcctcgaggtacgtaaggtttccngacgaacggtcttacgaggtataccgtaccttacacgtaggtactgtactatactaggttcgggtcgcgtaccgaccgggaccccccggaagtaaacgggtccgttaggacggtgggtaacgtgggtacgtacgggacttacggaaccgtcgtacggacctaagtacggtaaactaaaactaaaaagttccgaacgtaagaaccgttacggacggacgagtacctacgtaaccgttaacgacgggtacctacgacgtccgagacgttactttaatacgtagtacggtcgagtcggtanacggtacgtccgagtaacgacgtacgaaacgtcgaacgtgtcgtttagttaacgttttcgacgttaccgtaccgttacgttacgnggttacgacttaagtttacaccgttcgttaattacgttaccgtccgtaacggttaccggggacgtaaccggtacccgttggttcccgtaaccgtttccgacccgttaaccgg

SEQ ID NO: 261343 - DNA, 776 bp, Homo sapiens
  misc_feature: GYAE6OF02JB3A3.1.5.A05.1.454.CMB.1.raw
  modified_base (134)..(134): a, c, t, g, unknown or other
  misc_feature (134)..(134): n is a, c, g, or t
  modified_base (325)..(325): a, c, t, g, unknown or other
  misc_feature (325)..(325): n is a, c, g, or t
  modified_base (590)..(590): a, c, t, g, unknown or other
  misc_feature (590)..(590): n is a, c, g, or t
  modified_base (653)..(653): a, c, t, g, unknown or other
  misc_feature (653)..(653): n is a, c, g, or t
  modified_base (688)..(688): a, c, t, g, unknown or other
  misc_feature (688)..(688): n is a, c, g, or t
tcagacgagtgcgtcacgaccggtgctcgatttagatagatagacaggggacccaacaaccacatccctcctcagaacgccccagagcacaacgccccaccatggactggacctggaggatccttctttttggnggcagcacgccacgaggtcgccctactcccaggtccacgtgttgtcgctacgtcgtgggggctagggaggtagaaagtaggtcccgttggggccctagtaggtcggtaacggttttccaggacgtaacgtcttacggaaggtactaccgtccgttacacggtaggtactcgcttatactaggttcgggtcnccggtaccgaccgggtaccccccggaagtaaccggtcgttaggtaggtcggtaggttacgggatagggaccttaccgaacggtaccggtaggaactaacggttacgtaaacgaaacttaaaacttaccgaacgtaagtaaccgttaccggaaggtacacggtaaccgtaccgtaaccgttacggaacggtaaccaacctaccggtaccggaacctacgggttaactaaccgtttaagtaaggcgtaccggtaactggaaaccggngtaacgtaccggtagaacgttacgaaccgaacgaccgtagtctaagttattggttcgtaccgngtacctagttccgtagttacgttactgtttaaccngtttacgtacgttacttcgtacgggttaccggcggtaaccgttacggggtacccttcgggttaccctaccgtttccgacgtaccccgg

SEQ ID NO: 261344 - DNA, 856 bp, Homo sapiens
  misc_feature: GYAE6OF02GBSLP.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcgagtgaaggtttcctgcaaggcttcaggatacaccttcactaggtatgctatacattgggtgcgccacggcccccggaacaaacggcttgaggtggagtgggatggacgtacaaaccgcgttcggacaagttacgggtaaacaaccgtaaaaaaatttccgaaccgtaaaggtaaacgttacccgaaggggtacaaggtacgttacgtaacccgtttaaccgaacggggtaaccaaccgtactacccggtaccggaagggttaactttaaccgtttaacgttaaggttacggggtaacggtaccgtttagggaaccgggtacgtaacgggtcccccgttagggtaaccgggtaaacggtttacccgggaaaccggtaaaccggtacccggggtacgtttaacggttttaacgttttaaggttttttttacggtacgggttaccccgttaacccgtttacccggtttaaggttaacggggttaacggttacgtttaacgttttaacggttttaaccgaccgttttacgttaaacgtttttccggttaacccgttaccccgggtttaccggggtacccggttaaccggggttaacccccggtttacgggttaccccgtaaccccgggtttcccgtaccccgtttaccccgg

SEQ ID NO: 261345 - DNA, 772 bp, Homo sapiens
  misc_feature: GYAE6OF02IDP8P.1.5.A05.1.454.CMB.1.raw
  modified_base (224)..(224): a, c, t, g, unknown or other
  misc_feature (224)..(224): n is a, c, g, or t
  modified_base (237)..(237): a, c, t, g, unknown or other
  misc_feature (237)..(237): n is a, c, g, or t
  modified_base (330)..(330): a, c, t, g, unknown or other
  misc_feature (330)..(330): n is a, c, g, or t
  modified_base (398)..(398): a, c, t, g, unknown or other
  misc_feature (398)..(398): n is a, c, g, or t
tcagacgagtgcgtcacgaccggtgctcgatttagatagatagacaggggacccaacaaccacatccctcctcagaacgcccccagagcacaaccgccccaccatggactggacctggaggatccttctttttggtgcagcagccacaggtcgcccactcccaggtccagtcttggtgcagtctggggctgaggtgaagagcgtgggcctcagtgaaggttccngtcgaaggtcttnaggataccacttcacgtaggtatgtctatacagttggtcgcgaccgacggacccccggaacgaacgtcttaggaggtcgagtgggagtagganacgaacggtcgacggtaacagtacgtaaaccaaaacgtaaaaactcgaaagtacgtaacgttaccggnggaacacgtaacgtaccttaaacccgttaacgaacgggaacctacggtacccgtaaccggacggttaaacggttaacttttaacgtaacgtttaaaggtacgggtaaacgtcgtaggaaccgacggtaacgtaccccgggtaggaaacggtacccgtaaccgggtaaacggaaccgtaaccgtcgtttaaggtttaaacgtttttagtttttaccgggacgtacccgtttaccgtacgttaccggggttaggaggttaccgtaattttaacggttacccgtaactttacgttaagttaccggtcttaaccggggtacggaaccggttcgggtaaacccgttggtaaacccgtcccgttacccggtctaccccgg

SEQ ID NO: 261346 - DNA, 696 bp, Homo sapiens
  misc_feature: GYAE6OF02GV418.1.5.A05.1.454.CMB.1.raw
  modified_base (138)..(138): a, c, t, g, unknown or other
  misc_feature (138)..(138): n is a, c, g, or t
  modified_base (239)..(239): a, c, t, g, unknown or other
  misc_feature (239)..(239): n is a, c, g, or t
  modified_base (538)..(538): a, c, t, g, unknown or other
  misc_feature (538)..(538): n is a, c, g, or t
tcagacgagtgcgtcacgaccggtgctcgatttagatagatagacgacggggacccaacaaccacatccctcctcagaacgcccccagagcacaaccgccccaccatggactggacctggaggatccttctttttggngcagcagccacaggtcgcccactcccgaggtccagtcttgtgcagtcgtggggctggaggtgaagacgccgtggggcctgtaggtaggtaacggttttccngacgaaggtctcgaggactacctccttacacgttaggtatcgactatactagttgggtgcgccgacggcccccggacgaaacggtcgttagtaggtcggagtgggagtggtacacgtaacgcgtggactaacgtaggaaactaaactaaaaattaccgaaacgtaagtaacgttaccgaaggtagacgtaacgtactaacctttaacggagaacacactccggagtacgtattaattagtagtaggtacgtacgtagagtcgacgtccgtagacgtactaccggaagtaccgacggttntaaggttatttacgtttaggacgttcgtaaccgttgttacgggaggttacgtcttaagttacgttaccgtactttaacgtaacttttacgacgttcccgggtcggtaaccggtaccggttaccgtcggttacccgaccggtttcctcccgtaacccgg

SEQ ID NO: 261347 - DNA, 783 bp, Homo sapiens
  misc_feature: GYAE6OF02HQ3LV.1.5.A05.1.454.CMB.1.raw
tcagacgagtgcgtcacgaccggtgctcgatttagatagatagacaggggacccaacaaccacatccctcctcagaagcccccagagcacaaccgccccaccatggactggacctggaggactccttctttttggtggcagcagccacaggtcgcccactcccaggtccaggtcttgtgctacgttccgtgggggtctaggaggtagaagaacgccgtcggggcctacgtagttaggtaacgggtttcctggacaacggtcctttcgaaggtactaacctaccttcaacgtggtactgtactactacgtagttcgggtcgccggaccgaccgggacccccggtaaacgaaacggtcgttaggacggtagggtacgtgggtagttacggacgtaccgacggtcgtaggactaagtacggtaaaccaaactaaaacttcaacgtaagtaacgttaccggacggacagtacgtaccttaaccgttaaccgacggtaaccacgtacgtacccggaggtaacggtaactttaacttaacgtaggttaaccggtaaggtcgttaaggacgtacggtactaccggttagaacggtaaccgtacccgaaaggtacccgacggttccgtagtttaactttaggttttaccgacggtaccgtaacgttcgtagggttaggtacgttattaagttacgttaccgacgttttacgaacgtttccgtaacgttcccggtcgggaaccgttaacccgggaccctttcggtacccgtaacccgttcgtacccctacgg

SEQ ID NO: 261348 - DNA, 302 bp, Homo sapiens
  misc_feature: GYAE6OF02HM3RU.1.5.A05.1.454.CMB.1.raw
  modified_base (268)..(302): a, c, t, g, unknown or other
  misc_feature (268)..(302): n is a, c, g, or t
tcagacgagtgcgtcacgaccggtgctcgatttagatagatagacgaggggcagttccagatttcaactgctcatcagcagcctgcagtctgaagtattttgctagtttattactgtcagcagtataataactggcctcgacgttcggccaagggaccaagggtggaaatcgaaacgaactgtggctgcacatctgtcttcatccttcccgctactctgagacgtgtccgtctcgtggaggtcggcgtaggcaaagggcggctaatgnnnnnnnnnnnnnnnnnnnnnnnnnnnnnnnnnnn

SEQ ID NO: 261349 - DNA, 642 bp, Homo sapiens
  misc_feature: GYAE6OF02JTR27.1.5.A05.1.454.CMB.1.raw
  modified_base (221)..(221): a, c, t, g, unknown or other
  misc_feature (221)..(221): n is a, c, g, or t
  modified_base (454)..(454): a, c, t, g, unknown or other
  misc_feature (454)..(454): n is a, c, g, or t
  modified_base (460)..(460): a, c, t, g, unknown or other
  misc_feature (460)..(460): n is a, c, g, or t
  modified_base (500)..(500): a, c, t, g, unknown or other
  misc_feature (500)..(500): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctgggctgaggtgaagagccgtagggcctgaggtgaacgtttccngcaaggtcttcgaaggactacaccttcgacgtaggtatgactatactagttggtgccgcgaccggccccgaagaacgcgttgagtgtagtggactggatacgacgtcgtaggacgtagtacggaactaaactaaaacgttcaacgaagtaaccgttacgaggtacaacgtacgtaccgtaccgttaaccgaggacacgacgtcgacgtagtactaacgtagtacgtaggactntacggngacgtataccgagtacgaacgtaccggaagacggttacgntttacgttaacgtttcgttttacggcttaccgtacccgttaggttaggtcgggtaacttacgtacgttaacttcgtaccttagtaccgttagtacgtccgtacggtacgacggttacctcggtacctccggtcctactacgg

SEQ ID NO: 261350 - DNA, 698 bp, Homo sapiens
  misc_feature: GYAE6OF02H2GSP.1.5.A05.1.454.CMB.1.raw
  modified_base (223)..(223): a, c, t, g, unknown or other
  misc_feature (223)..(223): n is a, c, g, or t
  modified_base (249)..(249): a, c, t, g, unknown or other
  misc_feature (249)..(249): n is a, c, g, or t
  modified_base (350)..(350): a, c, t, g, unknown or other
  misc_feature (350)..(350): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctggaggtgaagagcctggggcctcagtgaaggtttttcngcaagggcttcgaggactacaccttnacgtaggtatgactatacatttgggtagcgtccacggcccccgaataaacggcttgagtggactgggatggatcgaacgctggacaagtaggtaaactaanaaaaacttcgaacaaggtaacgttaccgaggggtcaaggacgtactaccctttaaccgacgggtaaccaacgtacgttcccggacgtaacggtacttttaacttagtaacgtagggtaacgtcgtacggtagaccgtacggtccttaggacgtaacgtacggaaacgtaccgtaccgggtactacggttatttaacgtttttcggtacgtaccgttaaccttcggttagtacgggtaagtctaagtttaccgttacgaccttacgttaaacgtttcgtaccgttaccggtacggggacccgtacgggtaacccgttcggtacctacccggttccgtccccgttaaccg

SEQ ID NO: 261351 - DNA, 892 bp, Homo sapiens
  misc_feature: GYAE6OF02GC7YX.1.5.A05.1.454.CMB.1.raw
  modified_base (219)..(219): a, c, t, g, unknown or other
  misc_feature (219)..(219): n is a, c, g, or t
  modified_base (228)..(228): a, c, t, g, unknown or other
  misc_feature (228)..(228): n is a, c, g, or t
  modified_base (266)..(266): a, c, t, g, unknown or other
  misc_feature (266)..(266): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaggttccngcaaggctnaggataccaccttcactaggtatgctatacattgggtncgccacggcccccggacgaaacggtcttgagtggatggggagtaggatcgaacggcgttacggacaagtacggtaaaccaaacgtaaaaaacgttaccaacgtaagtaaacggtttacccgaaggggaccgaaggtaacgtaccgtaaacccttttaccggaaacgggtaaccaccgtaacgtacccgggacggtaacggggttaacttttaacgttaaacgttaacggttaacgggtaacggtacgttaacggaacgggtaccgtaaccggtacccggtaacggaacgggttaacgtaaccccgggtaaacgggtaaccgtaaccgggtacctttagggtttaacgttttaacgtttttttacgggttacggtaccccggttaaccggttttacgttaaacggggtttacggggtaacggtttaaccgttaacgttttaaccgggtttaaccgttaccgttaaccggtttaaacgttttaaccgggttaaccccggtttttaaccccgggggtaaccgggggttaaccccgggttaacccgggggttaaccccccgggttttaaccggggttaaccccggtttaaccccggtttaaccccggtttacccccggttaacccccggg

SEQ ID NO: 261352 - DNA, 615 bp, Homo sapiens
  misc_feature: GYAE6OF02GGIOY.1.5.A05.1.454.CMB.1.raw
  modified_base (112)..(112): a, c, t, g, unknown or other
  misc_feature (112)..(112): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (308)..(308): a, c, t, g, unknown or other
  misc_feature (308)..(308): n is a, c, g, or t
  modified_base (326)..(326): a, c, t, g, unknown or other
  misc_feature (326)..(326): n is a, c, g, or t
tcagacgagtgcgtcacgaccggtgctcgatttagatagatagacaggggcagttccagatttcaactgctcatcagcagcctgcagtctgaagattttgcagtttattacngtcagcagtataatactggcctcgacgttcggccaagggaccaaggtgaaatcgaaacgactgtggctgcacatctgtcttcgatccttccgctatctgtactcgtactcgcgtctacggacggccgggtctacgggaccgaaacggggtccgacgtaagtaaggctcgctgtnacgtgaccgngacgacgtacgngtcgagcgacgacgtagngtgacgtcgtcgtacgtacgcgtactagtacgacgtcgagacgtacgtacgtcgtagagtacgacgtacgtacgtactacgtacgacgtaccgtactactaaccgtacgtacgtacgtacgtacgtacgtacgtcgtacgtacgtacgtacgtacgtacgtacgtacgtaccgtacgtaccgtccgtacgtaaggtaccgtagtagtacgtacgtacgacgtacggtacgtaacggtacgtacgttacgtagtacgtaccgtacggtccggtaccggtacgtacgtacg

SEQ ID NO: 261353 - DNA, 738 bp, Homo sapiens
  misc_feature: GYAE6OF02JTVPC.1.5.A05.1.454.CMB.1.raw
  modified_base (146)..(146): a, c, t, g, unknown or other
  misc_feature (146)..(146): n is a, c, g, or t
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (254)..(254): a, c, t, g, unknown or other
  misc_feature (254)..(254): n is a, c, g, or t
tcagacgagtgcgtcacgaccggtgctcgatttagatagatagacaggggacccaacaaccacatccctcctcagaagccccagagcacaacgccccaccatggactggacctggaggatccttctttttggtggcagcagccacnggtgccactcccaggtccagcttgtgcgagtcgtgggctggaggtgaagagccgtgggcctgngtgtaagtttcngcagcttcgaggactaccaccttcactaggtancgtactatctagttggtgccgtaccgaccggccccgtaagaacggtctaggacgtacggtggtacggtagtcggtactacgaacgtccgtggtaaccgtaagtacggtaaaacgtaactaaaaacgttcgaacgtaacgttaacgtaccggaagggtaacgtaacgtacccgttacgttaacccgtttaccgaacgggtaaaccacggtaccgacccggtatacgggaactttaacgtacgaagtaggtacgtacgtggtaacacgtacgtaccggtggtaaccgacgttaacccggacgacggtaccgaccttagtttaacgttttagtttcgttaccgaccgttaccgtacggtttacggtacggtacgtaccgttaagttcccgtacgttaccgttattaacgtttccggactttcccgggacgggttaccggtaacggttcggtcccggttaacccggtccttaccgttacctacccggg

SEQ ID NO: 261354 - DNA, 942 bp, Homo sapiens
  misc_feature: GYAE6OF02FSC5J.1.5.A05.1.454.CMB.1.raw
  modified_base (260)..(260): a, c, t, g, unknown or other
  misc_feature (260)..(260): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtctggggctgatgtgaagaagcctggggcctcgagtgtaaggtttcctgcgaaggcttacaggatacaccttctactagtatnactatactagttgggtgcgtccacgggtaccccccggacgaaacggtcgttacggaggttaggtacggtaggggagttgggtacgtacggaaaccggtcgtacgggacctaaaggttaacgggtaaacctaaaccgtaaaaaaaacgtttaccaaacgaacggttaaacggtttacccgaacgggggtacaacggtacgttaaccgttaaccccgtttaaccgtaacggggaacctaaccgtaacgttaccccggacggtaaacgggtaccttttaaacgttttaaacgttaacgttaggggaacgttaccggtacgggtaaccggttacccggaaggtacccccggtaggtaaacgggtaaacccgtttacccggggaaaacgaacccgggtaacccggttaccgggtttaaggtttaaaattttaccggtttttttaagggtccgggtttaccggttaacccttttacggggttaaagtttaccggggttaacgtttaaacccgtagttttttaacccgaacgggttttaaccctttaacccggtttaacgttttttaacgaccccggttttttaccccggggtaccgggtaaacccgggttaacccgggggttaaaccccggtttaccccccggggttttaaacggttccccccggtttaccgttttaacccccccggg

SEQ ID NO: 261355 - DNA, 729 bp, Homo sapiens
  misc_feature: GYAE6OF02HY941.1.5.A05.1.454.CMB.1.raw
  modified_base (212)..(212): a, c, t, g, unknown or other
  misc_feature (212)..(212): n is a, c, g, or t
  modified_base (229)..(229): a, c, t, g, unknown or other
  misc_feature (229)..(229): n is a, c, g, or t
  modified_base (566)..(566): a, c, t, g, unknown or other
  misc_feature (566)..(566): n is a, c, g, or t
tcagacgagtgcgtcacgaccggtgctcgatttagatagatagacaggggacccaacaaccacatccctcctcagaagcccccagagcacaacgccccacatggactggacctggaggatccttctttttggtggcagcagccacaggtgcccactcccgaggtccagcttgtgcagtcgtggggctggaggtgaagacgccgtggggcctnaggtgtaacggtttccngacgaaggtcttacgaggtaataccaccttacacgttaggtactgtacttatacgtagttcgggtgcggacccgaccgggacccccggtaagtaaacgggtcgttacggaggtaggagtaggggattagggactacggaaccgtacgtcggtacgtaagttaacggaaaacctaaactaaaaaacgttcaaacgtaagttaacgtaccggacgggacacgacgtaccgtaaccgttaacgaggaccacgtacgtcccgaagtacggtaattaacttagtacgttagggactcgtaggacgctaacggtccgtagaacgtacgtaaccgaagtaccgnggtactgttaactttgtttcgacgtaccgttaccgttagttacgggtcggtaggtacctttaagtacgtaccgttactacgttaacggtttacgtccgtaacccgggttagggcccttaaccgggtacccgttcggtaacccgttcgtcccttccgaacccgg

SEQ ID NO: 261356 - DNA, 788 bp, Homo sapiens
  misc_feature: GYAE6OF02GW04C.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtcgtggggctggaggtgaagagccgtggggcctcagtgaaggtttcctgcaaggtcttcgaggtactaccaccttcacgtagtatgctatacattgggtgcgccacggcccccggaacgtaaacggcttgagtgggtatggggagtggtatacgaacgcgtggacaaagtggtaaactaaactaaaaaacgttccaaacgaacgtaaaccggttaccgaacggggtactaacggtaacgtaccgtaaacccgttttaaccggaaacgggggtaccctaaaccgactacccggggtaccgtaaacggggttaactttaaacgtttaacgtaaggtttaggggtaacgttccgttaagggaacgtccgtaacggtcccgttaggaacggtacgtaccccgggaaaagaccgaaccggtactttaggttaactttacggttttttcggtaccgtccgttaaccgtttcgttaggggtttacgggtaggtttaccttaagtttaagtttaccggtcctttaacggttaaacgttttccgaaccgtttcccggtacggggtacccgtaacgggttaccccgttaggtccccgtaaccccgttcgtcccttacccgg

SEQ ID NO: 261357 - DNA, 696 bp, Homo sapiens
  misc_feature: GYAE6OF02FJS9M.1.5.A05.1.454.CMB.1.raw
  modified_base (308)..(308): a, c, t, g, unknown or other
  misc_feature (308)..(308): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctgggctgaggtgaagagcctggggcctcagtgaaggtttcctgcgaaggcttcaggactacacctttacactaggtatcgctatacattggtgcgccacggccccggacaaacggctgatggagtggganggatcaacgctggcaatggtaaacacaaaaattcaacagaacgttcagggtcaagagtcacctttacgacgggaacacataccgacgtacggatttaacttatagttggacgtcgtagagtacgacgtcccgtaggacgtaacgtacccggaaaggaacccgtacgggcctttagttaacgttttatttttaggtcgtaaccgttaacccgttacgtttaagggttacgggtaacggttactaacgttttaattaccggtaccgtaaccgtttaaattttaaccgggtaccgtttacccggttaaccgggggtacccgttaaaccggggggtaaccccttaccgggggtaccccttaaccccggttacccgttacccgtttaacccgg

SEQ ID NO: 261358 - DNA, 821 bp, Homo sapiens
  misc_feature: GYAE6OF02IHZM4.1.5.A05.1.454.CMB.1.raw
tcagacgagtgcgtcacgaccggtgctcgatttagatagatagacaggggacccaacaaccacatccctcctcagaacgcccccagagcacaacgccccaccatggactggacctggaggatccttctttttggtggcagcagccacaggtgcccactcccaggtccagtcttgtgcagtcgtggggctggaggtagaagaagccgtggggcctcgagtggtaacggtttcctgacaaggtcttcgaggataccaccttcacgttaggtactgacttatacgtagttgggtcgccgaccgaccggacccccggaagaaacggtcgttggaggttggacgtagggatacgggataccgaacggtccgtaggactaagtaaggtaaaaccaaaactaaaaaacttcaacgtaaggtaacgttaccgaagggaccgtaaggaacgtttacctaacccgtttaaaccggacgggtaacctaacgaacgtacccggaacggtaaggtaacttttaacgttaataaggtacgggtaaggtacctaggaacggcgtacggttcccgtaaggtaaccgtaaccggtaaccggaaaacgggtacccgtaaccggggtattaacggttttaaacgttttacgttttttaccgggaccgttacccgttaacccggttagtttaaacgggttcggggttaaacgttactttaacgtttaacgttaccgttacttaaccgttaaggttttacccgacggtttacccgggtacgggtaacccggaaccggtttacccgtagggttacccttaccccggttccgtacccgtaccgg

SEQ ID NO: 261359 - DNA, 785 bp, Homo sapiens
  misc_feature: GYAE6OF02JZOHY.1.5.A05.1.454.CMB.1.raw
  modified_base (132)..(132): a, c, t, g, unknown or other
  misc_feature (132)..(132): n is a, c, g, or t
  modified_base (229)..(229): a, c, t, g, unknown or other
  misc_feature (229)..(229): n is a, c, g, or t
tcagacgagtgcgtcacgaccggtgctcgatttagatagatagacaggggacccaacaaccacatccctcctcagaagcccccagagcacaaccgccccaccatggactggacctggagatcctcttttggnggcagcagccacaggtcgcccactcccaggtccacgcttgtgcagtcgtggggctgaggtgaacgaagccgtggggcctcgagtgtaacggtttccngcaggtcttcgaggatacctaccttcactaggtatcgactatacgtagttgggtcgcgacccgaccggtccccccggaagaaacgggtcttaggacggtttaggagtggggtagtaggtacgtaccgaacgtcggtacgggacgtaaacgttaacgggtaaaacctaaaactaaaaacgtttacaaacggtaaaccggaaacggtttcccggaaggggaaccttaggtaaccgtttacccgtacccgtttaaccgggaacgggaaccctaaccgcgtaaccccggagtaacggtttatttaaaccttagtaaacggttgacggtacgttaacgacgtaccgtacggtcggtacgtaagttacgtaacccggaagtaccgacggtacgttaggtttaactttagggttttcgacggttaccctaacggttgggttagttcgggttaaacgttctaagtttaccgttacctaggttttaccttaggttacgtacccgtacccgggtaggtacccgtaaccggtcctaccgggaccgtttacccgtccgtcccgtaacc

SEQ ID NO: 261360 - DNA, 732 bp, Homo sapiens
  misc_feature: GYAE6OF02IMXFY.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctggaggtgaagaagcctggggcctcagtgaaggtttcctgcaaggcttcaggatacaccttcactaggtatgctatacattgggtgcgccacggcccccggacaaaggcttagagtggatgggatggatcaaccgctcggcaaatggtaaacaaacaaaaaaattcaacgaagaacggttaccgaagggacaaggacgtacaaccgttttaacccgaaggggaaccaacgaacgttacccggacgggtaagggtaacttttaacgttaattaacgtaggtagaccgttaggaacggaccgtaaggacccgtaggaaagacgttacccggaaaggtacctaaccgggtaccttagttaagtttacttttttaggtacgtcccgtaacccgttcgttaaggttacgggtaacggttacctaagtttaacgtttaccgtacgtttacgtaaacggtttttacgacccgttaccgggtttacggggaacccgtaaccgggggtaaccccgttagggttaccccgtaaccccggttccgtaccccttacccgg

SEQ ID NO: 261361 - DNA, 741 bp, Homo sapiens
  misc_feature: GYAE6OF02GHW6A.1.5.A05.1.454.CMB.1.raw
  modified_base (227)..(227): a, c, t, g, unknown or other
  misc_feature (227)..(227): n is a, c, g, or t
  modified_base (658)..(658): a, c, t, g, unknown or other
  misc_feature (658)..(658): n is a, c, g, or t
  modified_base (675)..(675): a, c, t, g, unknown or other
  misc_feature (675)..(675): n is a, c, g, or t
tcagacgagtgcgtcacgaccggtgctcgatttagatagatagacaggggacccaacaaccacatccctcctcagaacgcccccagagcacaaccgccccacatggactggacctggagatcctcttttggtggcagcagccacaggtgcccactcccaggtccagcttgtgcagtcgtgggctgaggtagaagagccgtcggggcctcgaggtgtaacggtttccngacaaggtcttacgaggtactacctaccttcacgtaggtatcgacttaatacgtagtttggtacgaccgccgtaaccgggacccccccggaataaaaggtccgttacggtaggtggtaacgtggggtagtagggacctccgaaacgcgtaggacgtaagtacggtaaactaaacgtaaaaaacttccgaagtaaagtaacgttcccgaggacgaagtacgtaccctacggttaaccgacgggaactaacgactaccggacggtaacgttaacgtttaacttaaggttaacgtagggtacgtacgtacgtacgaaccgtacggtccgttaacgaacggttaacccgtacgggaaacgtaaccggaaccgtacgttaggtttaacttttgttttacggtacgttaccgttaccgtacgttagtaggtacggtnttaacgtacgttacctntaaccgtattacgtacgttccgcggtaccggaccggttacgtcggtacctacgttcctaccgtccg

SEQ ID NO: 261362 - DNA, 782 bp, Homo sapiens
  misc_feature: GYAE6OF02JKG9Z.1.5.A05.1.454.CMB.1.raw
  modified_base (132)..(132): a, c, t, g, unknown or other
  misc_feature (132)..(132): n is a, c, g, or t
  modified_base (225)..(225): a, c, t, g, unknown or other
  misc_feature (225)..(225): n is a, c, g, or t
  modified_base (286)..(286): a, c, t, g, unknown or other
  misc_feature (286)..(286): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggnggcagcagccacaggtgcccactcccaggtccagcttgtgcagtcgtggggctggaggtgaagacgccgtgggcctcgagtcgaaggtttccngcgaaggtcttcgaaggactaccaccttcacgtaaggtatcgactaatactagttcgggtnacgccacggcccccggacgaaaggtcttagagtaggagtgggatacggactaccgaacggtcgtcggactaacgttacggtaaccaaaccgtaaaaaagttccgaacgtaaggtaacggttaccgtaaggggacctaaggtaaccgttacgtaacccggttttaccgaacggggtaacctaacgtaaccgtacccggacggtaacggtacttttaacccgttaagttacgtaccgggtaagtccgtacggtaacgtaccgtaaccggtcccgttaggaaccgtacgttacccggaaacggaccggtaccgtaccgtaggttacgtttaagttttacgacgtaccgtaaccgttcggttaacggttcggacggtttactaacgtttagttacccgtactacgtttaaacgtttacggacccgtttaccggtaccggggtacccgaaccggggtaaccccttcgggttaccctacccggttccgttaccgtaacccgg

SEQ ID NO: 261363 - DNA, 521 bp, Homo sapiens
  misc_feature: GYAE6OF02G36RH.1.5.A05.1.454.CMB.1.raw
  modified_base (214)..(214): a, c, t, g, unknown or other
  misc_feature (214)..(214): n is a, c, g, or t
  modified_base (260)..(260): a, c, t, g, unknown or other
  misc_feature (260)..(260): n is a, c, g, or t
  modified_base (272)..(272): a, c, t, g, unknown or other
  misc_feature (272)..(272): n is a, c, g, or t
  modified_base (277)..(277): a, c, t, g, unknown or other
  misc_feature (277)..(277): n is a, c, g, or t
  modified_base (282)..(282): a, c, t, g, unknown or other
  misc_feature (282)..(282): n is a, c, g, or t
  modified_base (287)..(287): a, c, t, g, unknown or other
  misc_feature (287)..(287): n is a, c, g, or t
  modified_base (315)..(315): a, c, t, g, unknown or other
  misc_feature (315)..(315): n is a, c, g, or t
  modified_base (319)..(319): a, c, t, g, unknown or other
  misc_feature (319)..(319): n is a, c, g, or t
  modified_base (322)..(322): a, c, t, g, unknown or other
  misc_feature (322)..(322): n is a, c, g, or t
  modified_base (325)..(325): a, c, t, g, unknown or other
  misc_feature (325)..(325): n is a, c, g, or t
  modified_base (328)..(328): a, c, t, g, unknown or other
  misc_feature (328)..(328): n is a, c, g, or t
  modified_base (333)..(333): a, c, t, g, unknown or other
  misc_feature (333)..(333): n is a, c, g, or t
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
  modified_base (371)..(371): a, c, t, g, unknown or other
  misc_feature (371)..(371): n is a, c, g, or t
tcagacgagtgcgtcacgaccggtgctcgatttagatagatagacaggggcagttccagatttcaactgctcatcagcagcctgcagtctgaagattttgctagtttattactgtcagcagtataatacgtggcctccgacgttcggaccaagggaccaaggtgaaatcaaacgactgtgctgcacctatctgtcttcatccttcccacctctntatacatcgctgacggcgggctcggactaacggcgcctaattaggnctagcacgcttngcatntgaanctagnttcaaggctttagctgtcctgctgccgngtantgntcngtnacgtnatcgatctagcngacgnacgtntgaaccttcggtctcngtagtgtacacgtgtacgtactacgtcgacgtcgtctacgtacgtcgtacgtacgtacgtcgtactacgtactcgtacgtacgtacgtacgtacgtcggtcgtacgtactacgtcgtagtacgtacgtacgtcgtacgtacgtacgtacg

SEQ ID NO: 261364 - DNA, 643 bp, Homo sapiens
  misc_feature: GYAE6OF02ICIKA.1.5.A05.1.454.CMB.1.raw
  modified_base (546)..(546): a, c, t, g, unknown or other
  misc_feature (546)..(546): n is a, c, g, or t
tcagacgagtgcgtcacgaccggtgctcgatttagatagatagacaggggacccaacaaccacatccctcctcagaagcccccagagcacaaccgccccaccatggactggacctggaggatcctctttttggtggcagcagccacaggtgcccactcccaggtccagcttgtgcagtcgtggggctgaggtgaagacgccgtggggcctcgagtgaagtactttcctagacgaacggtctttacgaaggactacctacccttcacgttagtatgacttatactagttgggtgcgccgaccggcccccggaacaaacggtcttggagtggagtggggatggactacgaacgcgtggactaagtacggtaaacaaacgtaaaaagttacaacaagtaacgttacgagggcagagttactaaccgtttacgacggtacacacgtccgacgagtattacgtatagtgacgtcgtagtacggcacgtccgtagagacgtaccgaagtacgacgcgttagtagtttattttgtacgcgttaccgttgttgnggtacgttctagttacgttacgtctagttacgtttcgtaccgttccggtgggaccgttccggtacccggttcgtacccggtaccgttccgtaccccg

SEQ ID NO: 261365 - DNA, 780 bp, Homo sapiens
  misc_feature: GYAE6OF02GFZW0.1.5.A05.1.454.CMB.1.raw
  modified_base (222)..(222): a, c, t, g, unknown or other
  misc_feature (222)..(222): n is a, c, g, or t
  modified_base (300)..(300): a, c, t, g, unknown or other
  misc_feature (300)..(300): n is a, c, g, or t
tcagacgagtgcgtcacgaccggtgctcgatttagatagatagacaggggacccaacaaccacatccctcctcagaagcccccagagcacaacgccccaccatggactggacctggatgatcctctttttggtggcagcagccacaggtgcccactcccaggtccagcttgtgcagtctggggctgaggtgaagagccgtgggcctgagtgtaaggtttccngcgaaggtcttcaggtaataccaccttcaacgttaggtatgtactatactagttgggtagcgccgacggcccccgganaaacggcttaggagtggagtgggagtggactacgaacggcgtaggcaagttacggtaaacaaacgtaaaaaactttccaaacgtaggtaaacgttaccggaacgggactaagggtaacgtaccgttaacccgtttaaaccgacgggtaaccaaccgtacgtaacccggacggtaacggttaacgttttaaaccgtttaacgttaagttaacgggtacgtacgttagggaacgtaccgacggtcgtaacggtaacgtaaccgtacccggtaaaggaaccgtaaccgggtacgtttacggttaactttacggttttttcgtaggtacccgttacccgttaagttaccgggtacggttaacgtacttaacggtttacttaccgtaccgttactttaaggtttaccggaccgtttaccgggttacgggaacccgttaaccggggtaaccccgttagggtacccgtacccgttcccgttaccccg

SEQ ID NO: 261366 - DNA, 787 bp, Homo sapiens
  misc_feature: GYAE6OF02HFZOY.1.5.A05.1.454.CMB.1.raw
  modified_base (628)..(628): a, c, t, g, unknown or other
  misc_feature (628)..(628): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtcgtggggctgaggtgaagaacgccgtggggcctcgagtgtaacggtttcctgacgtaaggtcttacgaggaataccgtacctttcaacgtaggtatagtactaacttaactagttgggtagccggtaccgacggaccccccggaacgaaaacggtccgttaggtaggttagggtacgtaggggtacgtgggtaagtacgaaacggtccgttaggacgtaaacgtagggtaaacaaaacgttaaaaaacttacgtaaacgaacgtaaacggttaccgaacggggtaacgaacggtacgttaacgtaacccgttttaaccggaaacgggtactaaaccgtaacgtaccccgaaggtaacgggtaaatttacgttaaagttaagttaggacgtacgtagtacgacgtagcgttacgaagtacgtaacgaagacgacgtagtacgttaagtttnttttaggtcgtacgttaccgttacgtagttacgggtacgttaacgttacgttaacgttacgttcgttaaccgttaactttacgtacgtaccggttacgggaccgttaaccgggttaacccgacggtttaccggtacccggttacgtcccgttaacccgg

SEQ ID NO: 261367 - DNA, 597 bp, Homo sapiens
  misc_feature: GYAE6OF02ITJCU.1.5.A05.1.454.CMB.1.raw
  modified_base (172)..(172): a, c, t, g, unknown or other
  misc_feature (172)..(172): n is a, c, g, or t
  modified_base (331)..(331): a, c, t, g, unknown or other
  misc_feature (331)..(331): n is a, c, g, or t
  modified_base (345)..(345): a, c, t, g, unknown or other
  misc_feature (345)..(345): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttntgcagtctggggctggaggtgaagaagcctggggcctcagtgaaggtttcctgcaaggcttcaggatacaccttcactaggtatgactatacattgggtgcgccaggcccccggacaaagcttgagtggagtgggatggatcaacgctgcaatggtaanaacaaaaattcaanagaagttacaggcagagtactactttacagggacacataccgcgagattactaatactggagctagagcaggtcctaggacgtaataccggaagaccaccgggtactcgttattagtttttcgtgtacggccttctacggttagggtagttacgtagtttacttacgtcttacgtaatttacgaccgtttaccgtcggggtacctaacggggtaacccgttacggtaccgtaacccgttcccgtacctaccg

SEQ ID NO: 261368 - DNA, 727 bp, Homo sapiens
  misc_feature: GYAE6OF02GT4M5.1.5.A05.1.454.CMB.1.raw
  modified_base (225)..(225): a, c, t, g, unknown or other
  misc_feature (225)..(225): n is a, c, g, or t
  modified_base (289)..(289): a, c, t, g, unknown or other
  misc_feature (289)..(289): n is a, c, g, or t
tcagacgagtgcgtcacgaccggtgctcgatttagatagatagacaggggacccaacaaccacatccctcctcagaagcccccagagcacaacgccccaccatggactggacctggagatcctcttttggtggcagcagccacaggtgcccactcccaggtccagcttgtgcagtctggggctgtaggtgaagacgccgtggggacctcgagtcgaagtttccgngcgtaacggcttcgaggtattaaccaccttcacgttaggtactgtactataccaggttgggtcncgcccgtacggacccccgtaagaacggtcttaggagtcggaagtgggtatggacgtacgaacgtcgtacggacaacgttacggtaaacaaacgttaaaactctaacgaacggtaacgtaccggacggtacacggtataccctaacgttacgaacggactacacggtaccgtcgaacggttactttacgtaacgttactagggtaccgaggttacgtacgaccgtacggtacgttacgagtaccggtaaccgtaaggtacccgtacgtattaaccgtttatttcggtttaggttaccgaccgttcgtaggtttacggttacggcgttaactatttacccgacgttacttacgtcgttttacacccgggtaccggttccgggaaccgtaaccgggttaccccgtggttaaccccgtccgggttaccccttacccgaccgg

SEQ ID NO: 261369 - DNA, 875 bp, Homo sapiens
  misc_feature: GYAE6OF02HGQQK.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtcgtgggctgaggtgaagagcctggggcctcgagtgtaacggtttcctgacgaaggtcttacgaggtataccaccttcgactaggtatgctatacagttgggtgcgccacggcccccggaacgaaacggtcttaggacgttggacgtaggggtagtacggtagtaccgaaacgtcgtacgggtacgtaacgtaagggttaaaccaaaacgtaaaaaaacttacccgtaaacgtaacggaaaaccgttttaccccggaagggggaacccgtaaggttaaacggttaaccccgtaaaccccggttttttaaacccggaaccgggggggtaacccttaaaccgtaacgttaacccccgggtacggggtaaacggggttaaccctttttaaaacgttttaaacggttaacgtttaccggggaacggttaccggttacgaacgggtacgtaacggggtaccccgtacgggaacgtaaccgggtttaacccgaaacgggtaaccgaccggggtaccgttacggtttaattttacggttttttcgggtaccggttaccggtaaccgttcgttaacgggttacggggttaattacccggtaacgttttaagttcccgttaccttaggttaaacttttcgtacccgtaccggttacgggtcccgaacgggtaccgttacccggtacccgtcgtttcccgacgttacccg

SEQ ID NO: 261370 - DNA, 772 bp, Homo sapiens
  misc_feature: GYAE6OF02GIBFG.1.5.A05.1.454.CMB.1.raw
tcagacgagtgcgtcacgaccggtgctcgatttagatagatagacaggggacccaacaaccacatccctcctcagaacgcccccagagcacaacgccccaccatggactggacctggaggatcctctttttggtggcagcagccacaggtgcccactcccaggtccagcttgtgcagtcgtggggctggagtgaagaacgccgtgggcctgagtagtaacggtttcctgacgaacggtcttacgaggaactaccgtacccttacaacgttaggtactgactatacgtaggttgggtcgccgacccgaccgggaccccccggaacgaacggtccttaggaggtcggagtacggggagtcgacgtacgaaccgcgtaggacgtaagttacgtaaactaaactaaaaacttcgaacgaaggtaacgttaccgaagggacacggtacgttactaaccgtttaacgaacgggtaaccaacgtaccgtaccggacggtaacgttaacttttaacgttaacgttaggtacgggtacgtccgtagaacacggacgtcccgtagaacgtacggtaccgaaacgtccggaacggttaccgttagtttaacgttttcgttttagtccggttaccgtcccgtttaagttacgggtaacgggttagttaacttaacgtttaacgttaccgtactttagtaacgtttccgtaacgtcccgtttagggtaccccgtaacgggttacccgttccggttaccggtacccgtttcccgacccgttacccg

SEQ ID NO: 261371 - DNA, 819 bp, Homo sapiens
  misc_feature: GYAE6OF02G2QEX.1.5.A05.1.454.CMB.1.raw
  modified_base (170)..(170): a, c, t, g, unknown or other
  misc_feature (170)..(170): n is a, c, g, or t
  modified_base (216)..(216): a, c, t, g, unknown or other
  misc_feature (216)..(216): n is a, c, g, or t
  modified_base (732)..(732): a, c, t, g, unknown or other
  misc_feature (732)..(732): n is a, c, g, or t
  modified_base (765)..(765): a, c, t, g, unknown or other
  misc_feature (765)..(765): n is a, c, g, or t
tcagacgagtgcgtcacgaccggtgctcgatttagatagatagacaggggacccaacaaccacatccctctcagaagcccccagagcacaacgccccaccatggactggacctggaggatcctcttttggtcggcagcagccacaggtgccactcccaggtccagctgtncagtctggggctgaggtgaagacgctgggcctcagtgaggtttccngcaaggcttacaggactaacgacctttcacgttaggtatacgtcgtaattacgtaacttggggttacgaccggacccgtaacgggtacccccccggaaccgtaaaacgggtccgttacgggacggttacggggtagtttacggggaacgttagggtaacgttccgaaaccggcggttacgggaccgtaaacgttcgggttaaaacctaaaccgtaaaaaaactttaccggaaaccgtaacggtaaaccggttttaacccgggaacggggtaccgtaacgtaaccggtttacctaaccccggttttaaccgaaccggggttaaccgaaacccgtaacggttaccccggacgggtaaacggtaacccgttttaacgtttaaacgtacgttagggtaacgccgtaggtaacgcgaacgtacgtcggaacgtacgtaccgaacgtaccgaacggtacttacgttacgttacgttttagtcgtaccgttaacctcgttagggttcgaggttactaacgttnttacgtaccgtacttaagttccgtatttcccgngggtaacctaccgggtaaccttcgggtaccgtacccgttacgttacctacccgg

SEQ ID NO: 261372 - DNA, 641 bp, Homo sapiens
  misc_feature: GYAE6OF02HWF0U.1.5.A05.1.454.CMB.1.raw
  modified_base (256)..(256): a, c, t, g, unknown or other
  misc_feature (256)..(256): n is a, c, g, or t
  modified_base (470)..(470): a, c, t, g, unknown or other
  misc_feature (470)..(470): n is a, c, g, or t
  modified_base (536)..(536): a, c, t, g, unknown or other
  misc_feature (536)..(536): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagtcttgtgcagtctgggctgaggtgaagagccgtggggcctcgagtgaaggttttcctgacgtaaggccttcagggactactacccttanactaaggttatcgtctattactagttgggtgcgccgacgggtcccccggaagaaacggcttggacgtggacgtgggatggtagtcgaagcgtggctaagtaggtaacaaacgtaaaaattcaacagtacgtacgaggcagactcgtaaccttaccgaggtacacacgacgacgagtacttatagtagtaggagtcgtagacacgactccgaganacgtacgaacgacgtcgactgtatttacgttttagacgtcggttacctagttgtacggtacggttnttaagttacttacgtacctttacgtaacgttttcgtaccgtcccgggtagggtacccgaccggggtaaccgttcgggtaacccgtcgtttacccgtcccgtaccg

SEQ ID NO: 261373 - DNA, 676 bp, Homo sapiens
  misc_feature: GYAE6OF02JUJRR.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagccgtgggcctcagtgtaaggtttcctgcgaaggcttacgaggtataccaccttacacgtaggtatgctatacagttgggtgcgccgacggcccccggacgaacggacgttgaggtgggagtgggatggagtacgacgtcgtggacgtaagtaggtaaacaacgtaaaaacttacgaacgtaaggtaacgttaccgagggtacgagtacggtacctaaccgtttaccgtagggaacctaacgacgtacccggacgtacggtaacgtttaactttaatagtaggtacgtacgtacggagtaccacggtaccgtaggagtacgtacgacgaccgacggtactagttattagttttgtacggtacgtaaccttacgttagtacggtgtacttagttacgtactacttacgtaagtttacgtacgttcggtaccgggtccgtaacggttacggtaccggttaccgtaccgttcctacccgtaccg

SEQ ID NO: 261374 - DNA, 714 bp, Homo sapiens
  misc_feature: GYAE6OF02GAXSX.1.5.A05.1.454.CMB.1.raw
  modified_base (275)..(275): a, c, t, g, unknown or other
  misc_feature (275)..(275): n is a, c, g, or t
  modified_base (293)..(293): a, c, t, g, unknown or other
  misc_feature (293)..(293): n is a, c, g, or t
tcagacgagtgcgtcacgaccggtgctcgatttagatagatagacaggggacccaacaaccacatccctcctcagaagcccccagagcacaaccgccccaccatggactggacctggaggatccttctttttggtggcagcagccacaggtgcccactcccaggtccagcttgtgcagtctgggctgaggtgaagaagccgtgggcctcagtgaaggtttcctgcaggcttcgaggactacaccttcacgtaggtatgcctatactagttgggtncgccgacggcccccgaanaaaggcttagagtgagtgggagtcgataccgaacgcgtaggctaataggtaaacaaacgtaaaaacttcgaacgtagaaacggtttccgaaggggacctaaggtaactacccgtaacccgttttaaccgaacgggtaacctaaccgtacggttacccgacggtaagggttaacctttaaccgtttaaagtaacggtagggtaacgtacggttacggaagacccgtaacgtaccccgtaggaacgttaacggtacccggaaacgaaccgtacgggtactttacggttaattttacgttttaggacgtaccgttaccttaccggttagttcggtaaggtcaagtttactacgtacttactaagttttacggacctaccgtacggtaccgacggtaccgtcgtaccgtaccgtcctacgtaccg

SEQ ID NO: 261375 - DNA, 672 bp, Homo sapiens
  misc_feature: GYAE6OF02FYUM1.1.5.A05.1.454.CMB.1.raw
  modified_base (133)..(133): a, c, t, g, unknown or other
  misc_feature (133)..(133): n is a, c, g, or t
  modified_base (145)..(145): a, c, t, g, unknown or other
  misc_feature (145)..(145): n is a, c, g, or t
  modified_base (221)..(221): a, c, t, g, unknown or other
  misc_feature (221)..(221): n is a, c, g, or t
  modified_base (610)..(610): a, c, t, g, unknown or other
  misc_feature (610)..(610): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggnggcagcagccanaggtgcccactcccaggtccagcttgtgcagtctggggctgaggtgaagagcctggggcctcagtgaaggtttccngcgaaggcttcaggactacaccttcacgtagtatcgctatacattgggtgcgccgaacggcccccggaacaaacgggtctggaggtggtagtgggagtggagtcgaacgcgtggcaaacgtaggtaactaaacgaaaaaaacgttcaaactaagtaacggtaccgaagggtacgagtaagtacctaccgtttaaccgaacgggtaactaacaacgtccggacgtaaggacttttaacgttaagtcgttaaggtagtcgtaggtacgacgtaacgtcccgtagtacgaaccgtacgtaaacgaacacgggtacctagttaacttagttttgtacgtcgtaccgtgtaggtagtacggttagtagtttaacgttacgactacgtaatttanaccgtacgtacgggaccgttaacgggacccgtaccggtacctaccgttccgtacgttaccgg

SEQ ID NO: 261376 - DNA, 767 bp, Homo sapiens
  misc_feature: GYAE6OF02IUKPA.1.5.A05.1.454.CMB.1.raw
  modified_base (244)..(244): a, c, t, g, unknown or other
  misc_feature (244)..(244): n is a, c, g, or t
  modified_base (357)..(357): a, c, t, g, unknown or other
  misc_feature (357)..(357): n is a, c, g, or t
tcagacgagtgcgtcacgaccggtgctcgatttagatagatagacaggggacccaacaaccacatccctcctcagaagcccccagagcacaacgccccaccatggactggacctggaggactccttcgttttttgggtggcagcagccacaggtcgcccactcccaggtccagtcttgtcgcagtcgtggggtctggaggtagaagaacgccgtggggcctcgagttcggtaacggttttcccnggacgtaaggtcctttacgaagggtaacttaccctaccgtttccaacgttaagggttactcgtacttaacttaactagtttggggtccgcggcccgaccgggaccccccgganaaacggtcgttaggacggttggagtggggagtaggtacgtcgaacgcgtagtacaagtaacgtaaacaaactaaaactcaacgagtaacgttacgaggacagtacgtacctaacgttacacgggtaaccacgtacgtaccggacggtaaggttactttaacgttagtagtacggtaacgtcgtagtagtaccgacggtaccgtaggaacggtactaacccggtaacgccgtaacggtcttaaggtttactttaggttttcgacggtacgttaccttagtcgggttagtacggttaactagttacgttacgtaccttacttacgtttaccgaccgttaccgggtacccgggtaaccggaaccggggttacccgtacggttacccggtaacccttccggttccctaacccgg

SEQ ID NO: 261377 - DNA, 336 bp, Homo sapiens
  misc_feature: GYAE6OF02FU86J.1.5.A05.1.454.CMB.1.raw
  modified_base (195)..(195): a, c, t, g, unknown or other
  misc_feature (195)..(195): n is a, c, g, or t
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
  modified_base (267)..(336): a, c, t, g, unknown or other
  misc_feature (267)..(336): n is a, c, g, or t
tcagacgagtgcgtcacgaccggtgctcgatttagatagatagacagggggcagttccagatttcaactgctcatcagcagcctgcagtctgaagattttgcagttttattactgtcagcagtataataactggcctccgagttcggccaagggaccaaggtggaaatcaaacgactgtgctgcacatctgtctnatctcccgcatctgacgtntctgatcgngacggcggctggcaaggtcgccaagttaganctancngatcgannnnnnnnnnnnnnnnnnnnnnnnnnnnnnnnnnnnnnnnnnnnnnnnnnnnnnnnnnnnnnnnnnnnnn

SEQ ID NO: 261378 - DNA, 183 bp, Homo sapiens
  misc_feature: GYAE6OF02F2R8N.1.5.A05.1.454.CMB.1.raw
  modified_base (180)..(183): a, c, t, g, unknown or other
  misc_feature (180)..(183): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttccgagtgcgtctctgagcgggctggcaaggcgcatagnnnn

SEQ ID NO: 261379 - DNA, 1048 bp, Homo sapiens
  misc_feature: GYAE6OF02F7F00.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagtcttgtcgcagtcgtggggctggaggtgaagaagccgtggggcctcgacgtggtaacgggtttcctgaccgaaggtcttacgaacggtacttaccgaacctttcaacgttaggtatcgtcgttatacgtaagtttgggtacggtccgaccggaccggggtacccccggaaccggtaaacgggtacgttacggtagggttacggtacggtaggggtaacggttacggtaacgtaccgaaacgtcgtacggtacgtaaacgttaagggttaaacgaaaactaaaaaacgttaaccgtaacgtaacgtaaacggttacccggaacgggaccggtaaggtaacggttaccgtaaccgtttaaccggaaacggtaaccgaaccgtaaccgtaccggtaccgaaacgggttaactttaaccgttaacgttaaccgttagggtaacggtaccggttacgacggttaccgtaacgggacccggtttaacgggaaaccgggttaacccgttaacccggggtaaaagggtaaaccccgggtaaaccggggttttaaaccggtttaccgggtttaaaccgttttttaaggggttttttaaccgggtttacccggtaaacccggggttttaacccccggtttaaaccgggttttaaacccgggggttaccgggggttaaaaccgggttttaaaccggttttaaacgttttaaccccgttttaaccggtttaacccgtttaacccggttttaaaacggttttcccggtttaaaccccgggtttaccccggggttaacggggtaaaccccggggttaaccccggggtaaacccgggttttacccgggttaaccccggtaccccggtttaccccggttaacccccgtttaaccccgg

SEQ ID NO: 261380 - DNA, 200 bp, Homo sapiens
  misc_feature: GYAE6OF02JEBZ4.1.5.A05.1.454.CMB.1.raw
  modified_base (180)..(200): a, c, t, g, unknown or other
  misc_feature (180)..(200): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttcctctctcgactctgagcgggctggcaaggcgcatagnnnnnnnnnnnnnnnnnnnnn

SEQ ID NO: 261381 - DNA, 852 bp, Homo sapiens
  misc_feature: GYAE6OF02HL6OV.1.5.A05.1.454.CMB.1.raw
  modified_base (286)..(286): a, c, t, g, unknown or other
  misc_feature (286)..(286): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattggtgcgccacggcccccggaanaaacggcttggagttggagtgggatggatacgaacggcttaggcaagtcggtaaacaaaccgtaaaaaacttacgaacaaggtaaacgttaccgtaggggacgtaggaacgttaccgtaacccgtttttaaccgaacggggtaacctaacgtaacgttacccggtacggtaacggtaacgtttttaaccgttaagtttaacgtacgggttaacgggtcgttaacgggaacgtaccgtacggacccgttaacggacggttaaaccgtacccgggaaaacgtaacccggaacccggggtaacctttaggtttaaacgtttaacgtttttttacggttacgggttacccgttaaccccgttacggttttaacgggtaacggggtttacggtttaaccgttaaacgtttttacgttaacccgttccgtttaacgtttaaaacgtttttaccgggttaaaccccgtttccgggtttacccggggggtacccgtaaccgggggttaacccccggtttaacggggtttacccccgttaaccccgggtttaccccttaccccgtttaaccccgg

SEQ ID NO: 261382 - DNA, 676 bp, Homo sapiens
  misc_feature: GYAE6OF02JT758.1.5.A05.1.454.CMB.1.raw
  modified_base (234)..(234): a, c, t, g, unknown or other
  misc_feature (234)..(234): n is a, c, g, or t
  modified_base (297)..(297): a, c, t, g, unknown or other
  misc_feature (297)..(297): n is a, c, g, or t
  modified_base (415)..(415): a, c, t, g, unknown or other
  misc_feature (415)..(415): n is a, c, g, or t
  modified_base (521)..(521): a, c, t, g, unknown or other
  misc_feature (521)..(521): n is a, c, g, or t
  modified_base (554)..(554): a, c, t, g, unknown or other
  misc_feature (554)..(554): n is a, c, g, or t
  modified_base (562)..(562): a, c, t, g, unknown or other
  misc_feature (562)..(562): n is a, c, g, or t
  modified_base (569)..(569): a, c, t, g, unknown or other
  misc_feature (569)..(569): n is a, c, g, or t
  modified_base (582)..(582): a, c, t, g, unknown or other
  misc_feature (582)..(582): n is a, c, g, or t
tcagacgagtgcgtcacgaccggtgctcgatttagatagatagacaggggaccgaacaaccacatcctcctccagagccccagagcacgaacgccccacatcggactggacctggacgtatccgtcgtttttggcggcagcacggccacgaggtcgcccacgtcccgaggtccagcttgcggcagtctggggactgaggtgaacgagtccgtcgggctcaggtgacggtttccnggacaaggccttcgacggacttaaccccgttcgaactacggtatagtcagtaccagttcgggnccgtacgcccggtccccggaataacggcgttggaggtcggtaacgtcgggatggtacacgaccgtacgtggaacagttacggaacaaccgtaagtccagaacgtacgttccgaagggntacggtacgttaacctaccgtttacccggaaggtaccacgtaaccggtcccgaacggtaagttaccgttaaccgttagtaccgtagaacggtctagacgtacggtnaccgtgacttcgacaagcgagtcaggttacttnttacggcncgttacngtcgtgtaccggntacttagtccgacgtttacgtacggtttacacggtaaccggtcggttaaaccggcggtacgtcgggtaaccccgtacggttccttacggacccg

SEQ ID NO: 261383 - DNA, 652 bp, Homo sapiens
  misc_feature: GYAE6OF02I95YE.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggagatcctctttttggtggcagcagccacaggtgcccactcccaggtccagcttgtgcagtctgggctgaggtgaagagcctggggcctcagtgaaggtttcctgcaaggcttcaggataccaccttcacgtaggtatgactatacattgggtgcgccgacggcccccggacgaaaggcttgagtaggagtgggagtggagtacgacgctggcaatggtaacagaaaaacttcaacagtaacgttaccgagggacagtacgtactaccgtttaccgaggtaccaactactccgacggaagtacttacgtttaactagtacggagcgtagacgacgtaagcctaggtacgtacgtaccgaaaggtaccacggtactcggttaatttagttttcggtcgtaccgtaccttacgttaggtacgtaggttactagtttacgttacgtacgttacgttaaagtttacgtaccgttacggttaccgggacgttacccgggtacccttagggtaccgtacccggttacccttccgttaacccgg

SEQ ID NO: 261384 - DNA, 683 bp, Homo sapiens
  misc_feature: GYAE6OF02I5U7J.1.5.A05.1.454.CMB.1.raw
  modified_base (207)..(207): a, c, t, g, unknown or other
  misc_feature (207)..(207): n is a, c, g, or t
  modified_base (219)..(219): a, c, t, g, unknown or other
  misc_feature (219)..(219): n is a, c, g, or t
  modified_base (226)..(226): a, c, t, g, unknown or other
  misc_feature (226)..(226): n is a, c, g, or t
  modified_base (487)..(487): a, c, t, g, unknown or other
  misc_feature (487)..(487): n is a, c, g, or t
tcagacgagtgcgtcacgaccggtgctcgatttagatagatagacaggggacccaacaaccacatccctcctcagaagccccagagcacaacgccccaccatggactggacctggagatcctcttttggtggctagcagccacaggtgcccactcccaggtccagcttgtgcgagtctggggctgaggtgaagagccgtgggcctanagtgaagttccngcagctnagatcacttcactagtatcgatatacagttgggtcgcgccgacggtcccccggaagaaacggcttaggagtggacgtcggggatggataccgaacgcgtggacaaaggtcggtaaacctaaacaaaaacgttcaacgtacgtaaaggttaccggaaggacgtaacgacgtaccgttaaccgttacgagggtaaccactacgtaccggacgaaggtactttacttaacgtagtcgggactcgtaggacgtacgacgtaccgnggtaaccgaagtacccggaacggtaccgaacccgggtattaaccggttaagttttacgttttaggacgtttacgaaccctttggtagttagggtacgttacgatttaacctcgtacttacgtagtttaaccgtcggtaccggttggggaaccgtacgggtacccgttcggtaccttaccggttccctcggtaaccg

SEQ ID NO: 261385 - DNA, 819 bp, Homo sapiens
  misc_feature: GYAE6OF02IQAD7.1.5.A05.1.454.CMB.1.raw
  modified_base (221)..(221): a, c, t, g, unknown or other
  misc_feature (221)..(221): n is a, c, g, or t
tcagacgagtgcgtcacgaccggtgctcgatttagatagatagacaggggacccaacaaccacatccctcctcagaagcccccagagcacaacgccccaccatggactggacctggagatcctctttttggtggcagcagccacaggtgcccactcccaggtccagcttgtgcagtctggggctgaggtagaagagcctgggcctcagtgaacggtttccngacaaggcttcgaggactacacctttcaacgtaggtatcgacttatactagttgggtgccgaccgacggcccccggaataaaggtcttaggacggttaggagtagggagtaggactacgaacggccgttaggacgtaaagtacggaaaacctaaaactaaaaaagtttccaaacggaacgtaaacgttaccccggaagggtacgaacggtaacgttaccgtaacccgttttaaccgaacggggaccaacctaccggttacccggacggtaacgggttaaccgtttaacgtttaactaaacggttagggaacttaccggtacggtaacggacctacgggtaccccgttagggaacgtaaccggtaacccggaaacggtaacccggaaccgggttcgttaaggtttaactttaacggtttttttcggaccgttaccggtacccgttacggttaacgggttacgggttacggttaacgtacgtttaacggtttaccgtaccgtttacgttaacgtttaccggtaccgtttccgggacggggtaacccgtacccggggttaacctaccgggttaccctaccccggttacctcccgttaccgg

SEQ ID NO: 261386 - DNA, 749 bp, Homo sapiens
  misc_feature: GYAE6OF02IR921.1.5.A05.1.454.CMB.1.raw
  modified_base (146)..(146): a, c, t, g, unknown or other
  misc_feature (146)..(146): n is a, c, g, or t
  modified_base (323)..(323): a, c, t, g, unknown or other
  misc_feature (323)..(323): n is a, c, g, or t
  modified_base (418)..(418): a, c, t, g, unknown or other
  misc_feature (418)..(418): n is a, c, g, or t
tcagacgagtgcgtcacgaccggtgctcgattttagatagatagacaggggacccaacaaccacatccctcctcagaacgcccccagagcacaacgccccaccatggactggacctggagatccttctttttggtgcagcagccanacggtgcccactcccaggtccagcttgtgacagtcgtggggctgaggtgaagaagccgtggggccctgaggttagtaacggttttcctgcgaaggtcttcaggacttacctaccctttcaacttacggtattcgactattacagtttagggtcgacggcccgaccggcccccggaanaacggtctaggagtaggagtaggacgtaggataccgagctaggctaagttacgaactaaacaaaattcgaactaaggtaacgttacggagtaacncgacgttacctaacgtttaccgaaggtacacgacggtaccgtacgtacggtaacttttacgttaacgttaacgtggacgtcgttgtaaggaccttaaggccgttacgtaacggtaccgttaccggaacgaaccggtcgtaaggtttaccggttatttcggtttttacggtacggttccttacggttaacgttagggttacgggtagttacgtaactttagttacctaccggtttacgtaacggtttttacgaaccggtttccgggtaccgggtaacccggtaccgggttaacccggttccgttacccgtacccggtccttacccgtaccgg

SEQ ID NO: 261387 - DNA, 917 bp, Homo sapiens
  misc_feature: GYAE6OF02JIIU5.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagccgtggggcctcagtgtaacggtttcctgacgaaggtcttacgaggactacacttcactaggtatgctatacacttgggtcgcgtccaggccccccggagaaaggcttggagtcggagtcgggatggactcgaacgcgtaggacagtacgtaaacactaaaaacgttcacgaacgtaagtaccgaggggcacggtacgtaccgtaacccgtttacgaacgggaacttaccgacgtacccgtacgggaacggtacgtttaaccttaagttacggtacgggtaacggtaccgttacggtaacggtaccgtaacggtaccccggtttaaaggaccgttaaaccggttaaccgggaaaccggttaaacccgttacccggggttaaccgttttaacggttttaaacgttttaacggttttttttacccgggtaacgggttaccccggtttaaacccggtttaaccggttttacgggttaaaccgggggtttacggtttaaaacccggttttaaccgggtttttaaaacccgggttttaccccggtttaacccggtttaacccgttttaaaccggggttttttaccggtaaaccggtttccccggggttaacccggggggttaacccccggttttaacccggggggtaaccccccgggtttttaaaccggggtaccccggtttaaacccccgggttttccccggttacccccgtttaaaccccggggg

SEQ ID NO: 261388 - DNA, 706 bp, Homo sapiens
  misc_feature: GYAE6OF02JQMQX.1.5.A05.1.454.CMB.1.raw
  modified_base (136)..(136): a, c, t, g, unknown or other
  misc_feature (136)..(136): n is a, c, g, or t
  modified_base (235)..(235): a, c, t, g, unknown or other
  misc_feature (235)..(235): n is a, c, g, or t
  modified_base (248)..(248): a, c, t, g, unknown or other
  misc_feature (248)..(248): n is a, c, g, or t
  modified_base (271)..(271): a, c, t, g, unknown or other
  misc_feature (271)..(271): n is a, c, g, or t
  modified_base (563)..(563): a, c, t, g, unknown or other
  misc_feature (563)..(563): n is a, c, g, or t
tcagacgagtgcgtcacgaccggtgctcgatttagatagatagacaggggacccaacaaccacatccctcctcagaagccccacgagcacaacgccccaccatggactggacctggaggatcctcttttggtggcngcagccacaggtgcccactcccaggtccagtcttgtgtcagtcgtgggctgaggtgaagagccgtgggcctcgaggtgacggttcctgactaaggcttnaggatacaccttnacgtagtatgctatacagttggngcgcgtacggacccccggacgaacggtcttgacgtaggagtacgggataggactcgaacgtccgtgggctaaagtacgtaaactaaactaaaagttccaagacgtaacgttaccggaggactaggtactacccgtacgtttaaccgacgggactaaccacgtacccggagaacggttacttaacgttaagtacggtaggtacggtacgttacggaacgacgtacgtccgtagggacgtaacgttaccgaaacggtaccgtacgtccttaaggttcgttttaagttccggttnacccggttaccgttagttcggtcgggtaaagttcctttaaccgttaggtttacccacgttagtacgtttacccggtaacgtaccggggtacgttcccgaaaccgggttccgtaaccgttcccggccggttactacccttcggg

SEQ ID NO: 261389 - DNA, 267 bp, Homo sapiens
  misc_feature: GYAE6OF02IKSIU.1.5.A05.1.454.CMB.1.raw
  modified_base (247)..(247): a, c, t, g, unknown or other
  misc_feature (247)..(247): n is a, c, g, or t
  modified_base (252)..(267): a, c, t, g, unknown or other
  misc_feature (252)..(267): n is a, c, g, or t
tcagacgagtgcgtcacgaccggtgctcgatttagatagatagacaggggccagttccagatttcaactgctcatcagcagccctgcagtctgaagattttgcagtttattactgtcagcagtataataactggcctccgacgttcggccaagggaccaaggtggaaatcaaacgactgtgctgcacatctgtctcatcttcccgctatctgactcgtactgcgctgagcggctggactaaggccgnatagnnnnnnnnnnnnnnnn

SEQ ID NO: 261390 - DNA, 898 bp, Homo sapiens
  misc_feature: GYAE6OF02FZ6QE.1.5.A05.1.454.CMB.1.raw
  modified_base (221)..(221): a, c, t, g, unknown or other
  misc_feature (221)..(221): n is a, c, g, or t
  modified_base (245)..(245): a, c, t, g, unknown or other
  misc_feature (245)..(245): n is a, c, g, or t
tcagacgagtgcgtcacgaccggtgctcgatttagatagatagacaggggacccaacaaccacatccctcctcagaagcccccagagcacaacgccccaccatggactggacctggaggatccttcttttggtggcagcagccacaggtgcccactcccaggtccagcttgtgcagtcgtggggctggaggtgaagagcgtggggcctgagtgagtttccngcaggtcttcaggtatactccttnacgttaggtatgactatactagttgggtgccgtccgacggacccccggaacgtaaacggtcgtttaggacggttggtaaggtaggggtagtcgggtaactaccgaaccggtcgtagggtaacgaaggttaacggggtaaaacctaaaaccgtaaaaaaacgtttacgaaaccggtaaacggtaacggtttacccggaaggggaccgtaacgggtaaacgtttacccgttaaaccccggtttttaaccgaaacgggggtaaccctaaacgtaccggttaccccgggaccgggttaacggttaacgtttttaaccgtttaagttacggttacgggtacggttacgtacgggtaaacggttacggaaccggttacgggtaacgtaaacgggttaccgtaaaacccgggtaaccgggaaccgttacccgggtaacgtttaggttttaaacgttttaggttttttacgggtcgtaacccggttaccctttaagggttacgggttccggttaaacggtttacgttaacgtttttacgttacccgttacgttacgtttaacggttccggttacccgttaccggggttaacgggggtaacccttccggggtaacccggtttcggtaaccccgttaccccgggttacctcccgggtttaccg

SEQ ID NO: 261391 - DNA, 731 bp, Homo sapiens
  misc_feature: GYAE6OF02G8N3I.1.5.A05.1.454.CMB.1.raw
  modified_base (135)..(135): a, c, t, g, unknown or other
  misc_feature (135)..(135): n is a, c, g, or t
  modified_base (176)..(176): a, c, t, g, unknown or other
  misc_feature (176)..(176): n is a, c, g, or t
  modified_base (228)..(228): a, c, t, g, unknown or other
  misc_feature (228)..(228): n is a, c, g, or t
tcagacgagtgcgtcacgaccggtgctcgatttagatagatagacaggggacccaacaaccacatccctcctcagaacgcccccagagcacaacgccccaccatggactggacctggaggatccttctttttggngcagcagccacgaggtcgcccactcccgaggtccatcttgngcagtcgtgggctgaggtgaagagccgtgggcctcgagtgtaacggtttccngagaacggtcttacggagactaccacttcagtacggtatcgactactactacgttgggtacgccgccgacggccccgaagaacggtcgtagaggtcggtagtacgggtatacggaagtaccgaacgccggttaggacgtaacgtacggtaaaactaaaaccgttaaaactacgaacgtaacggtaacgttacgacgggacagtacgtactaacgtacgacggaacacatcgacgtagtacttaacttagtacgtgacgtacgagtcggactacggtacgtagttagaacggtaaccgtaacgaaccggaacgtacgttaacggtttaatttacgtttaggtaccgtacgttaacccgttacgttacggggtaaggtacgttacgtttaacgttaggttaccctaacgtttacctaaacggtttccgttaaccggttcggtaccgggttaccgaaccggttacccggttaccgaccggttaaccttcccggtacccgtaacccg

SEQ ID NO: 261392 - DNA, 725 bp, Homo sapiens
  misc_feature: GYAE6OF02HXKNH.1.5.A05.1.454.CMB.1.raw
  modified_base (133)..(133): a, c, t, g, unknown or other
  misc_feature (133)..(133): n is a, c, g, or t
  modified_base (226)..(226): a, c, t, g, unknown or other
  misc_feature (226)..(226): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggnggcagcagccacaggtgcccactcccaggtccagcttgtgcagtctggggctgaggtagaagacgccgtgggcctgagtgtaacggttttccngacgaacggtcttacgaggactaccaccttcacgttaggtatgtactatactagttggtgccgccgacggcccccggaagaaacggtcgtgagtggtagtgggatggactacgaacgtcgtggacaagttacggtaaacaaactaaaaatcaacgaagtaacgttcgaacgggctagtacgtacctaccgtttaaccggacgaccacgtacgtcccggacggaggtactttaacgttatacggtagggtacgcgtaggacgtacgacgtccgttagaagtaacctacggaaacgtaccgaccggtagtttacgttattttaagttttgccggttaccttaccggttacggttaggttacgggtacgttacgtttaagttaccttacggttacttaacgttaacgttttacggacccggtttacccgggtaaccgggtccccgtaaacgggggtaccccttagggtaccccgtacccgtttcccgtaccccgttacccgg

SEQ ID NO: 261393 - DNA, 858 bp, Homo sapiens
  misc_feature: GYAE6OF02ILTXJ.1.5.A05.1.454.CMB.1.raw
tcagacgagtgcgtcacgaccggtgctcgatttagatagatagacaggggacccaacaaccacatccctcctcagagccccagagcacaacgccccaccatggactggacctggaggatccttcttttggtggcagcagccacgaggtcgcccactcccaggtccagtcttgtgcagtctggggctggaggtgaagagcccgtgggcctgagtagaggtttcctgacgaaggtcttcgaaggtataccaccttcaacgttaggtatagtcttaatactagttcgggtgccgccaccggacccccggaagtaaacggtcgttgaggtaggtaacggtggagtagggaactcgaacgtcgtaggccgtaaagtacggtaaacaaacgtaaaaacttacgacgtaaagtaaacggttcccgaaggggactaacggtaacgtttaccctaaacctttaaccggaacggggtaactaacccgtaacggtaccccggaggtaaaggttaacgtttaacccgttaagttaacggtaaacgggtacgtacggttacggaaacggtacggtaaccggtaccggttaacggtaaggtaaaccggttacccgggaaaacgtaacccgggtaaccgggttaaccgtttaaagggttaacgtttttaaccgggtttttttataccgggtacccgttaacccgtttaaccgggttaggttaccgggttacggtaacgtttaagttttacggttaacccgttactttacgtaaacggttttactaacccggttccgggtttaccgggaacccgggtaccgggtaaacccggttcccggtttaccggaacccctttcccggttacttaccccgg

SEQ ID NO: 261394 - DNA, 961 bp, Homo sapiens
  misc_feature: GYAE6OF02HRWUN.1.5.A05.1.454.CMB.1.raw
tcagacgagtgcgtcacgaccggtgctcgatttagatagatagacaggggacccaacaaccacatccctcctcagaacgcccccagagcacaacgccccaccatggactggacctggaggatccttctttttggtggcagcagccacaggtgcccacctcccgaggtcccagccttgtgcagtcgtggggctgaggtaggaaaggaacgtccgtcgggggtcctacgtaggttaggtaaacggttttccgtgtacgtaaacgggtccttacgaaggtaactaaccgttaccccttacgaccgttaagggttacgtaggtacctttaagtaccgttaggtttacgggtacggaaccggtaccccgaacccggggacccccgggaaaaccgtaaaacggggtccgtttacggtaacgggttacggtaacggtggggggaattcggggtaaacgttacccgaaacgtcggttaacggtaacgtaaaacgtaacgggttaaaaacccgtaaaaacgttaaaaaaacgttacgaaacgttaaaacggtaaacggtttaccggaaaggggtaactaaacgggtaaccgtttaacccgtaaacccgttttaaccggaacgggaaaccgtaacctaaacggttcccggaaacggtaacgttaaagttttaactaacgttaaggtacggttaacgtacgtaaggacgtacgaaccggtacgtaaccgtaacggtaacggtaacccgaaaggtacccggtaaacgggtcctttaaaggttaacgtttaaggttttaccgtagtaaaccggttacccggtatttaacgggtacgggtaagtaacgttaatttaaccggttacccgtacgttaaccgttaaacgtttaggtacccttaacgggtaccccgggtaacggttaaccgggtacccgttaccggtaacccggtaccgttacccgtaacccgtaccgg

SEQ ID NO: 261395 - DNA, 833 bp, Homo sapiens
  misc_feature: GYAE6OF02I7SGS.1.5.A05.1.454.CMB.1.raw
  modified_base (295)..(295): a, c, t, g, unknown or other
  misc_feature (295)..(295): n is a, c, g, or t
  modified_base (729)..(729): a, c, t, g, unknown or other
  misc_feature (729)..(729): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgtaaggtttcctgctaaggcttcgaggatacaccttacactaggtactgactatacgattgggtgtcgaccacggacccccgganaaaacggtctacgaggtacggagtgggagtagggtactacaacggtcgtacggacgttaaaagtacgggttaaaacaaaacttaaaaaaaacgtttcgaaaacgtaacgttaaaacggtttcccgaaaggggtaccgaaggttaacccgttaaccgttaaaccgtttaaaccccggtaaagggaaacctaacgtaacgttaaccccggtaacggtaacgggttaaactttaaaccggttaaacgtttaattacggggtacgtaacggttcgggaagtacggtaccgtaccgttaggaaaccggttacgttaaacccggaaacggaacgtaccggtaactaggtttaacgttttaaaggtttttcgttacgggtaccttaaccgtttcggtaaacggtttccggtaaagggttacttaactttaagtttacccgngttttaacctaaacgtttcgttaactccgggttaccgggttaaccggacggggttaaccccgtggggttttaccccaacccggttccgttaccgttaaccccgg

SEQ ID NO: 261396 - DNA, 809 bp, Homo sapiens
  misc_feature: GYAE6OF02HNT3I.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccgactcccaggtccagtcttgtgcagtcgtggggctggaggtgaagaagcctggggcctcagtaggtaacggttttcctgacaaggtccttacaggataccaccttcactaggtatgctatactattgggtgcgtccacggcccccggagaaacggcttggagtggagtgggattggactcgaaacgcgtggactaaagtacggtaaactaaacaaaaaaacgttccaaacgaaacgtaaacgtttacccggaagggacgaaaggaaccggtttactaaccccgttttaaacgaaacgggggaacctaaaccgtaaccggtacccggtaacgggaacggttaaagtttaacccgtttaaacgtaacggtttaacgggaaaccgggttacggtagtaacggtaccggtaaccgtacccgggttaacggaaacggttaacggttaccccgggaaaacgggaccggtaaacccgggtcggtttaacggttttaactttaggttttttacggacggtacccgtaccgtttaccgtaaagggttcgggttaacgtacgttaagtttacgttacctacgttacgttaacgtttacgaccgttaccgggtcggtaccggtaccgggtaaccgtaccggttcggtacccgttcgtacccgtaccg

SEQ ID NO: 261397 - DNA, 871 bp, Homo sapiens
  misc_feature: GYAE6OF02JH2DX.1.5.A05.1.454.CMB.1.raw
  modified_base (94)..(94): a, c, t, g, unknown or other
  misc_feature (94)..(94): n is a, c, g, or t
tcagacgagtgcgtcacgaccggtgctcgatttagatagatagacaggggacccaacaaccacatccctcctcagaagcccccagagcacaacnccccacatggactggacctggaggatcctctttttggtggctagcagccacaggtcgcccactcccaggtccagcttgtgcagtgtgggctgaggtgaagacgccgtggggcctcgaggtggtaggtttcctgacaagggtcttcgaggactaccacctttcgactaggtatgtactagtacgtagttggggtgtccgaccgaccgggtacccccggaacgtaaacggtccgttaggaacggttagggagttacggggagttacggggacttaccggaaccgtcgtgggtaacaaaggttacggttaaaacaaaacgttaaaaagttaccgaaacgtaacggttaaacggtaccggaacggggtacgtaacggttaacgggtacccttaaacccgtttaaccgggaacgggtaacccgtaaacccgtccgttaaccccgggagggtaaacggttaacttttaacttaacgttaaggtacgggtaacgtaccgtaggtaaccggtaccgaaggttacccgtagggtaaccgttaccgtaaaccgggttaacggaacccgttacgggttacgtttaacgtttaaggttttacgttttttacgggacgttaaccccggttaccgtttaaccgggttagggttaacgggttaccgttaagtaccgttttaaacgtccgtacttaaccgtttaagtttaccgtaccgggtttaccggacggggtacccgtaaccggggtccgttaccgggtacccttaccgttcccggttaaccttacccgg

SEQ ID NO: 261398 - DNA, 701 bp, Homo sapiens
  misc_feature: GYAE6OF02GYX67.1.5.A05.1.454.CMB.1.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (232)..(232): a, c, t, g, unknown or other
  misc_feature (232)..(232): n is a, c, g, or t
  modified_base (701)..(701): a, c, t, g, unknown or other
  misc_feature (701)..(701): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtcgtgggctgagtgagagctgggctnagtgagtttcngcagcttcagatacacctnacgtagtatgactatacagttgggtgcgtccgacggcccccggtaacgaaacggtcgttacggaggtcggaaggtggggtaacgttgggaactaccgtaacggtccgttagggacctaaaaggtacggttaaaaccaaaacgtaaaaaaacttacgaaaccgtaaggtaaacggttacccgaagggtacacggtaacgtacctaacccgtttaacacgggaactaactaacgtacccggagtaaggtaactttaacgtttactaggtacggagtacgtagaagcaacgtcgagtaagacttacgaacgtaacgacggtacctagtttaacttaggttttacggtcgtaaccggttaccttacggtaagggttcgggtaacggtattaacgttacgttacgtactcgtttaaagttccgaactcggtacgggtacgtaacggtaccgttgaccgtaccgtctacccggtn

SEQ ID NO: 261399 - DNA, 744 bp, Homo sapiens
  misc_feature: GYAE6OF02FMUJ2.1.5.A05.1.454.CMB.1.raw
  modified_base (222)..(222): a, c, t, g, unknown or other
  misc_feature (222)..(222): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctgggctgaggtgaagaagccgtgggcctcagtgtaacggtttccngcgaaggtcttcaggatacaccttcacgtaggtatgctatacagttgggtgcgtccgacgggcccccgacgaaaggtcttgaggtggagtaggggatggactacgaacggcgtagacgaagttaggaaacgaactaaaaaagtaccaacaaaggtaacgttacgaagggacgtaggtaagtcctaacctttaccggacgggacacgaccgtaccgacggtaaggtaagtttacgttaatacggtagggtactcgttacgaagtaccgacggtacccgtaaggaacgttaaccgtccgggaaaacgtacgtaaccgggactttacggtttaagttttagttttttacgggacgttaccgttacccgttacggttacgggttagggtaacggttacttaacgtttaacgtttacccgtaccgttaacgttaaacgtttacgtaccttacccgggttaacgggtacccggttaccgggtaaccccgtttgggaaccccgtacccggttacccttaccgtacccgg

SEQ ID NO: 261400 - DNA, 746 bp, Homo sapiens
  misc_feature: GYAE6OF02HIE7Z.1.5.A05.1.454.CMB.1.raw
  modified_base (237)..(237): a, c, t, g, unknown or other
  misc_feature (237)..(237): n is a, c, g, or t
  modified_base (733)..(733): a, c, t, g, unknown or other
  misc_feature (733)..(733): n is a, c, g, or t
tcagacgagtgcgtcacgaccggtgctcgatttagatagatagacaggggacccaacaaccacatccctcctcagaacgcccccagagcacaacgccccaccatggactggacctggaggatccttctttttggtggcagcagccacaggtcgcccactcccaggtccagtcttgtgcagtcgtggggctggaggtagaagaagccgtggggcctcgaggtagtaacgggttttccnggacgaacgggtcttacgaggtaactaccgtaccttcacgtaggttatacgtacttatacgtagtttggggtcgaccggaccgtaccgggccccccggaagaaaacggtccgttaggacggtgggtagtggggaatgggtaataccgaacggtcgtagggactaagtaacgggtaaaacaactaaaaaacttcaacgaacgtaacgttacgaggggactagacgtactacctttaacgaggaccacacgtccgagacgtactttaacgtagtaagtgggacgtcgtaggacgtacgacacggtcgaacgttagtaccgaaagttacccgaggtaccgtagtttaagtttcgttttacgtggtacctaccgttacttacgggttacggacgttacttacgtttacggtactaccgttagttaacgtttcggtaccttaccgggccggggtaccttaacggggttaccccgttacggggtaccctacccggtttaccnccggtttaccccg

SEQ ID NO: 261401 - DNA, 819 bp, Homo sapiens
  misc_feature: GYAE6OF02ITQ2F.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtcgtggggctggaggtagaagagccgtggggcctcgaggtgaacggtttcctgcaaggtcttacgaaggtactaccaccttacactaggttatcgtactataactagttgggtgtccggaccgaccgggaccccccggaaagaaaacggtcgttacggaggtgggacgttaggggattcgggaagttaccgaacggccgtagggacgtaacgttacggtaaaacctaaactaaaaaacgtacaaccgaagtaaacggttaccgacggggaacgaagtaacgttaccttaaaccgtttaaccggaacggggtaacctaaccgtaacgttacccggacggtaaggttaacgtttaactttaaagtaaggttacgggaaacggtcgtacggtaacgaccggtaacgtacccggtaacggaacgttaaccggtaaccggtaaacgaaccgtaacgggttcgttaacggtttagtttaaggttttttacggtacggtaacccgtacccggtttagttaaacgggttgggtaacggttacttaagtttacgttaccgtagtttacgtaagtttaccgaacccgttcggtacggggtacccgtaaccgggtacccgttacgggtaccctaccgtcccgttacccgaccgg

SEQ ID NO: 261402 - DNA, 898 bp, Homo sapiens
  misc_feature: GYAE6OF02FQ8KW.1.5.A05.1.454.CMB.1.raw
  modified_base (287)..(287): a, c, t, g, unknown or other
  misc_feature (287)..(287): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagaagcctggggcctcagtgaaggtttcctgcaaggcttcgaggatacaccttcactaggtatgactatacattgggtgcgccacggcccccgganaaacggcttgagtggatggggatggatcgaacgctgggactaagtagggtaaacaacaaaaaaagtttccaacgtaaggaaacgtttaccccgaagggggacctaaacgggtaacggtacccttaaaccccgtttttaaaccccggaacggggggtaaacctaaacccgtaacgttaccccgggacggtaaagggtaaccttttaacgttaacgtttaagtcggggtaagtcgttaggaacggaccgtaaacgggtcccgttacgggtaaggtaaccggttaacccggaaacggtaacccgaacccgggggtaccgtttacgggttttaaacgtttttaacggtttttttttacgggtagggtttccccgtaaaacccggttttacgggtttaacgggtttgggggttaaaacccgggtttaccgtttaaacgtttttaaaccggttttaaccgaccccgttttaacggtttaaaacgttttttaccgggtaacccccttttacccggggtttaacccgggggggacccggtttaaacgggggtaacccccccgtttgggggttttaaccccccgtccccggggtttaccccttaccccgttacccccggg

SEQ ID NO: 261403 - DNA, 725 bp, Homo sapiens
  misc_feature: GYAE6OF02ILML1.1.5.A05.1.454.CMB.1.raw
  modified_base (291)..(291): a, c, t, g, unknown or other
  misc_feature (291)..(291): n is a, c, g, or t
tcagacgagtgcgtcacgaccggtgctcgatttagatagatagacaggggacccaacaaccacatccctcctcagaagcccccagagcacaacgccccaccatggactggacctggatgatcctctttttggtggcagcagccacaggtgcccactcccaggtccagcttgtgcagtctggggctgaggtgaagagccgtggggcctcagtgaaggttcctgcgaaggcttagaggatacaccttcactaggtatgctatacagttgggtgcgccgacggacccccggaanaaacggcttggtagtggagtgggatggatacgaacgcgtggcaaagtacggtaaacaaactaaaaattacgaacgtaacgtaacgttaccgaagggacaagacgtacctaaccgtttaaccgaacgggtaacaaccgtaacgtacccggtacggaacggttaagtttacgtttaaacgtagtaagggtacgtaccgtgggaacgcgtaacggtaccgttaggaacgtaaccggttaaccggaaacgaccgtaacgggtaccttacggttaattttacgtttttcggtacgtacgtaccgttactaggtacggtacgttacgttatttacgtacggtccttaacgttaacgtttacggtaccgttacccgggtagggtacccgggtacgggttaacccggttaccggtaccgttaccccggttacccttacccgg

SEQ ID NO: 261404 - DNA, 668 bp, Homo sapiens
  misc_feature: GYAE6OF02ITKSL.1.5.A05.1.454.CMB.1.raw
  modified_base (328)..(328): a, c, t, g, unknown or other
  misc_feature (328)..(328): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctgggctgaggtgaagagccgtgggcctcgagtgaaggtttcctgcgaaggtccttcgaaggactacgaccttacgactaggtactgactatacagttggtcgcgccaggtccccccgagaaacggtcgttacgagtcggagtgggatgganacgtaacgcgtggactaagtacggtaaacaacgtaaaaacttacgaacagtaacgttaccgaacgggacaggagtacgtaaccgtttaccgaaggtaccacacgtccgacgacgtatttaccgttataagtacgggagtacgtgtaacgcacggtacccgtaggacacgtacgaacgacgtaccgtacgttacgttaagtttagtttttacggtcgtaaccgtacccgttagttacgtgggttacgtactaagtttactacgttactaacgtaagttccgaccgttcggtaccgggaccgtaacggttacccgtaggtccctaccggttcctccgtaccg

SEQ ID NO: 261405 - DNA, 724 bp, Homo sapiens
  misc_feature: GYAE6OF02JKG4M.1.5.A05.1.454.CMB.1.raw
  modified_base (221)..(221): a, c, t, g, unknown or other
  misc_feature (221)..(221): n is a, c, g, or t
  modified_base (285)..(285): a, c, t, g, unknown or other
  misc_feature (285)..(285): n is a, c, g, or t
  modified_base (317)..(317): a, c, t, g, unknown or other
  misc_feature (317)..(317): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttccngcaaggcttcaggatacaccttcactaggtatgctatacattgggtgcgccacggcccccgganaaacggcttgagtggatgggatggatcaacgntggcaagtggaacacaaaaatcaacagaacgttaccgagggcagtacgtactacctttaaccgagggaactaccgacgtccggacggtacggtaactttaaccgtttaagtaagttacgggacgtacgttacggaacgtacgaacggtcctagggtaacgtaccgttacccggaaacgtaacccgaaccggggtccttacgggtttaactttaacgttttttttagggaccggttaccgtaaccccgtttacggttaacgggttacgggggtaaacggtttcgtaaagttttaaccgtttacccggttacttaccgttaacgtttttacgacccggttcccgttacgggggtaccctacggggtaaccccgttggttaccccgtaccgttacccgtcccgttacccg

SEQ ID NO: 261406 - DNA, 706 bp, Homo sapiens
  misc_feature: GYAE6OF02HSMLU.1.5.A05.1.454.CMB.1.raw
  modified_base (192)..(192): a, c, t, g, unknown or other
  misc_feature (192)..(192): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagcccacaggtgcccactcccaggtccagcttgtgcagtctggggctgaggtnaagagccgtgggcctcagtgaaggttttcctgcaaggtccttcgaggtataccaccttcacgtaggtatgactatacagttggtcgcgccgacggcccccggacgaaacggtcttaggagtggagtcgggagtaggactaccgaacgtccgtaggactaaagtaggtaaaccaaacgtaaaaaacttacgaacgtaacgtaaacggtttacccgaacggggactaaggtacgttacctaacccgttttaacgacgggtaacctacgaccgtaccggacgtacggtaactttacgttaagtagtacggagtcgtgacgtcacgtcgtagaacggtacgtaccggaaacgacgtaacgtacgttacggttaatttgttttacggacgtacgtaaccgttcgtagttgggtacgtctaagtttacgtacgttacgtaaccgttagtttaccgtaccgttcggtacgggtacccgtacggtacccgtccggttaccctaccggttccctccgtacccg

SEQ ID NO: 261407 - DNA, 687 bp, Homo sapiens
  misc_feature: GYAE6OF02FJE8P.1.5.A05.1.454.CMB.1.raw
  modified_base (205)..(205): a, c, t, g, unknown or other
  misc_feature (205)..(205): n is a, c, g, or t
  modified_base (219)..(219): a, c, t, g, unknown or other
  misc_feature (219)..(219): n is a, c, g, or t
  modified_base (514)..(514): a, c, t, g, unknown or other
  misc_feature (514)..(514): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctggggctgaggtgaagagcctgggcctnagtgaaggtttccngcaaggcttcgaggtataccacctttacacgtaggtaatgactatacagttgggtgcgccacggcccccggacgaaaggtcttaggagtaggactgggactggatcaacgtcgtgggactaagtcggtaaacaactaaaaaacttcgaacgtaagaacgttacgaacgggacaacggagtccgtaacctttacgaacggtaccaactacgtaccgacggtaaggtactttaactttaagtacgtaggtacgtagtaggactacgacgcgtgaagactacggaacgaccgacggtntacggttattagttttaggactacggaccttcgttaacggggtacggttaggtaccttaagtttacgtttaacgccgtttaacgtaacgttttcggaccccgtttacgtaccgggggtacccaacggggtacccgttaccggttaccgtaccccgttccttacccgtacccgg

SEQ ID NO: 261408 - DNA, 842 bp, Homo sapiens
  misc_feature: GYAE6OF02HCBEE.1.5.A05.1.454.CMB.1.raw
  modified_base (132)..(132): a, c, t, g, unknown or other
  misc_feature (132)..(132): n is a, c, g, or t
  modified_base (246)..(246): a, c, t, g, unknown or other
  misc_feature (246)..(246): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggnggcagcagccacaggtgcccactcccaggtccagcttgtgcagtcgtggggctgaggtgaagagcctggggcctcaggtgtaggtttcctgcaaggcttagaggatacaccttnacgtagtatgactatactagttggtgcgccgacggacccccgagaacggcgttagagtggagtgggatggactacgaacggcgtgggactaacggtaggtaaacaaacgtaaaaaattccgaaacgtaacggtaaacgttccggaacgggactacggtaaccgtttacccgtaaaccgtttacggaacgggtaacctaacccgtaacggttacccgggacgggtaacggttaaacgttttaccgttaagttaaggttaccgggtaacggtaccgttagggaacgtacgtaaccgggtaccgtaggaacggttaaccggtaaccggaaacgtaaccggtaccggtacgttttacggtttaagttttacggtttttaccggtacgttacccggttaaccgttttacggtacggggttacgggttaacggtttaccttaaggttttaaccgtttaccgtaacggtttaccgtttaaacggttttcccggttaaccggttcccggggttaccggggtaaccccggttaacccgggggtttaaccccggttcgggtttaacccccgttaacccgggtttcccttaccccggttaaccccgg

SEQ ID NO: 261409 - DNA, 256 bp, Homo sapiens
  misc_feature: GYAE6OF02FQPL6.1.5.A05.1.454.CMB.1.raw
  modified_base (251)..(256): a, c, t, g, unknown or other
  misc_feature (251)..(256): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgaactgtggctgcaccatctgtcttcatcttcccgcatctgatcgtactgcgctgaggcgggctggcaaggcgcatagnnnnnn

SEQ ID NO: 261410 - DNA, 858 bp, Homo sapiens
  misc_feature: GYAE6OF02GBYL2.1.5.A05.1.454.CMB.1.raw
  modified_base (230)..(230): a, c, t, g, unknown or other
  misc_feature (230)..(230): n is a, c, g, or t
tcagacgagtgcgtcacgaccggtgctcgatttagatagatagacaggggacccaacaaccacatccctcctcagaagcccccagagcacaaccgccccaccatggactggacctggatgatcctctttttggtggcagcagccacgaggtcgcccactcccaggtccagtcttgtgacagtcgtggggctggaggtgaagagccgtgggcctgagtagtaaggtttccngacgaaggtcttcgagactaccaccttcaactaggtatcgactaatacagttgggtacgccgtaccgaccgggaccccccggtaacgaaacgggtcgttaggaaggtagggtaggtaggggaagttggggaactaccgtaacggcgtacgggactaaagttacgggtaaaaccaaactaaaaaacttccgaaacgtaacgtaacggttaccgaagggtaccgaaggtaacgttacctaaccgtttaaccggaacggtacaactacgtccgaaggtacggtactttaacttaagtagtaggaacgtcgtaggacgacgtacgtaccgtaggtaacgtaccgtaaccggtaaacggacccggtaccggttaacgtttagttttaaagtttttacggttttttagggtaccgtttacccggtttaacccggtttaccggtttaagggttacgggggttaaacgtttaaccgtttaagttttttacccggtaaccgtttaccgtttaaaccggtttaacggttttacccggtaaacccggtttcccggggttacggggaacccccgggtttaaccgggttaaacccccggttccgggtttaaccccgttaccccggtttcccgtacccccgg

SEQ ID NO: 261411 - DNA, 981 bp, Homo sapiens
  misc_feature: GYAE6OF02G00CL.1.5.A05.1.454.CMB.1.raw
  modified_base (132)..(132): a, c, t, g, unknown or other
  misc_feature (132)..(132): n is a, c, g, or t
tcagacgagtgcgtcacgaccggtgctcgatttagatagatagacaggggacccaacaaccacatccctcctcagaagccccagagcacaacgccccaccatggactggacctggaggatcctctttttggnggcagcagccacaggtcgcccactcccaggtccagcttgtgcagtcgtggggctgaggtgaagagccgtgggcctcgagtgaggtttcctgctaaggcttacgaggtactacaccttcacgttaggtatgactatactagttgggtgcgccgacgggaccccccgggaacgaaacggtcgttaggagttacgggagttacggggagttgggaacgttaccgaaacggtcggttacgggactaaaggttacgggtaaaaccaaaccgtaaaaaacgttaccgaaacgtaacggtaaacggtttaccggaacggggacgtaacggtaacggtacccgttaacccgttttaaccggaacggggtaaccaaccggtacgtacccgggtacgggaacgggttacctttaaacgtttaacgttaacggttaaggggtacgtaccgttaggaagtacccgtaacggtcccgttaggaacggtaaccttaccgggaaaccgggtaccgtaaccgggtaccgtttaaagggtttactttttaaacgggttttttttccgggtaccgggttaacccgggtttaaccccggtttttaaccgggggtttaacggggtttaacggggggtttaaccgggtttaaacccgtttaaacgggtttttaaaccggttttaccgttaaccgtttttaacccggttttaaaacggtttttacccgggttaacccggtttacccgggggtttaacccgggggggttaaccccgtttaaaccccgggggggttaaaccccgttttacccgggggttacccccgtttaaaccccgggttttccccggtttaaccccggtttaacccccggg

SEQ ID NO: 261412 - DNA, 724 bp, Homo sapiens
  misc_feature: GYAE6OF02J0VET.1.5.A05.1.454.CMB.1.raw
  modified_base (189)..(189): a, c, t, g, unknown or other
  misc_feature (189)..(189): n is a, c, g, or t
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
  modified_base (619)..(619): a, c, t, g, unknown or other
  misc_feature (619)..(619): n is a, c, g, or t
tcagacgagtgcgtcacgaccggtgctcgatttagatagatagacaggggacccaacaaccacatccctcctcagaagcccccacgagcacaacgccccaccatggactggacctggaggatcctcttttggttggcagcagccacaggtgcccactcccaggtccagcttgtgcagtcgtggggctgnggtgagagcctgggcctcgagtgtaaggtttcctggcaggcttactggataccaccgttcacgtaggtatcgtactatacagttcgggtntccggaccncggaccccccggacgtaaaaccgggctttacgggaggttagggtacggtaggggtacgtagggttaactcgtaaccggtaacgttgggacctaagttacgggtaaaacctaaaccgtaaaaaaacttccgaaacgtaaggtaaaccggtttaacgacggggacctaaacgaacggtttaccgttaaccctttaacgaacggggaactaacgtaacgtaccggtaccgaagggtaccgtttaaccgttagttaagtggaacgtcggtacgtagacgtaacggcgtcgaaggacgtacgaggaaccgaggacgtacgttattaagtttttcgngtacgtacctggttacgttcggtacgtcgttaattacgtgtacttagtaattaccggtagtccgtacggccggtacgaccggtcgtccgaccggttcctacctcg

SEQ ID NO: 261413 - DNA, 190 bp, Homo sapiens
  misc_feature: GYAE6OF02HHEOW.1.5.A05.1.454.CMB.1.raw
  modified_base (180)..(190): a, c, t, g, unknown or other
  misc_feature (180)..(190): n is a, c, g, or t
tcagacgagtgcgtcacgaccggtgctcgatttagatagatagacagggcaccaagggcccatcggtcttccccctggcaccctcctccaagagcacctctgggggcacagcggccctgggctgcctggtcaaggactacttcctcgtactgcgctgagcgggctggcaaggcgcatagnnnnnnnnnnn

SEQ ID NO: 261414 - DNA, 859 bp, Homo sapiens
  misc_feature: GYAE6OF02GD0IW.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgctagtcgtggggctggagggtgaaggaagccgtcggggccctctaggtaggtaacggtttcctgacgaacggtcttacgaggacttacctaacctttccgaacttaacgggttattcggttaccttaacgttaaccgtagtttacgggggtaccggtaccggtaccccggaacccggggaaccccccccgggaacggtaaaacgggtccgtttaggggaacggttagggtaacggtaggggtaacgtaggttaacgaccgtaaaccggtcgtacgggaactaaaggttaacggtaaaaccgtaaaaaccgtaaaaagttaaccgaaacgaaacggttaaaccgttaaccggaacggggtacaaacggtacgtacccgttaacccgttaaacgggaccggtaacgaacccgttaacgtacccggtacggaacggttaacgtttaaccgtttaacgtagtacgggtaatcggtagaacacggtactacggtacgtaaggaaccgttaccgaacggacgtaccggtacttagtttacgtttagttggtccgtaccgtttaaccgtcgttagggtacgttaacgtagtttaacgttcttaacgcctttaagtacgtttaccgtaacgtaccgggttacggtacccgtacgggttaccctcggtacccctacccgttctacccgtacccgg

SEQ ID NO: 261415 - DNA, 826 bp, Homo sapiens
  misc_feature: GYAE6OF02G7HV5.1.5.A05.1.454.CMB.1.raw
tcagacgagtgcgtcacgaccggtgctcgatttagatagatagacaggggacccaacaaccacatccctcctcagaacgcccccagagcacaacgccccaccatggactggacctggaggatcctcttttggtggcagcagccacaggtgcccactcccaggtccagcttgtgcagtctggggctgaggtgaagaagccgtggggcctcgagtggaagtttcctgcgaaggcttcgaggactaccgaccttacacgtaggtatagactatactagttgggtcgccggccgaccgggacccccggaacgaaacggtcgttaggaggtggtagtggggagtgggacgtacgaaccggtcgtacgggactaaagtacggtaaaccaaacgtaaaaaacttacaacgaacggtaacgttaccggaagggtaccgtaggtaacgttaccttaacccgttttaaccgaaacggggtaacaaccgtaccggtaccggtaccgggtaacggttaacctttaacgtttaacgttaacggttaggaacggttaaccgttacggaacggaccgtaccggtacccgtaggaaccggttaacgtaacccggttaaaggaaccgtaaccgggtacttaacggtttacgtttaacggtttttggttacgacccgtttaacccgttacggttcgggttaacgggtacggttacttaacgtttacgttaaccgtcctttacggtaacgttttcggaaccggttacccgggttacggggaacccgtaacggggttaaccccgtacgggttacccgtaccccggtttaccgtccccgtaacccgg

SEQ ID NO: 261416 - DNA, 685 bp, Homo sapiens
  misc_feature: GYAE6OF02JZAZH.1.5.A05.1.454.CMB.1.raw
  modified_base (193)..(193): a, c, t, g, unknown or other
  misc_feature (193)..(193): n is a, c, g, or t
  modified_base (205)..(205): a, c, t, g, unknown or other
  misc_feature (205)..(205): n is a, c, g, or t
  modified_base (225)..(225): a, c, t, g, unknown or other
  misc_feature (225)..(225): n is a, c, g, or t
  modified_base (233)..(233): a, c, t, g, unknown or other
  misc_feature (233)..(233): n is a, c, g, or t
  modified_base (597)..(597): a, c, t, g, unknown or other
  misc_feature (597)..(597): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgagtgaanagctggggcctngtgaggtttccgcaggcttnaggatacncttcactaggtatgactatacagttggtgcgaccacggccccggacaaaggtctcgagtcggagtgggactggactacgacgctcggactaagtaggaaactaacgtaaaaaacttcgaacgtaaggtaaacggttcccgaaggggacgagtacggtaccgtaaccgttttacgaacggtacgaacctacgtacgacggtagtagttaacttagtaacgtggtacgacgtaggaccgtcgaggtaccgttgaacggttaccttaccggaaacgtaccaacggtacgtaggtttaaccttagtttttacgggccgtaacgttcccttaacggtacgttaggtacgttccgtaattaccggttacncgtttactaacggtttaagtccgttaaccggtgggtacccgtaacgggtaaccttcgggttaacccaccgtttaccgtcgtaacccgg

SEQ ID NO: 261417 - DNA, 736 bp, Homo sapiens
  misc_feature: GYAE6OF02G4U36.1.5.A05.1.454.CMB.1.raw
  modified_base (133)..(133): a, c, t, g, unknown or other
  misc_feature (133)..(133): n is a, c, g, or t
  modified_base (262)..(262): a, c, t, g, unknown or other
  misc_feature (262)..(262): n is a, c, g, or t
  modified_base (273)..(273): a, c, t, g, unknown or other
  misc_feature (273)..(273): n is a, c, g, or t
  modified_base (291)..(291): a, c, t, g, unknown or other
  misc_feature (291)..(291): n is a, c, g, or t
  modified_base (555)..(555): a, c, t, g, unknown or other
  misc_feature (555)..(555): n is a, c, g, or t
tcagacgagtgcgtcacgaccggtgctcgatttagatagatagacaggggacccaacaaccacatccctcctcagaacgcccccagagcacaacgccccacatggactggacctggagatccttctttttggnggcagtcagccacgaggtcgcccactcccgaggtccagcttgtcgcagtcgtgggctggacggtgaaggacgtccgtgggcctagagtaggtacgtttcagactaagtcttacgagtactacaccttanacgtagtacgntctagtacgtagtggacnccggaccgaccgggaccccgaagtaacggtcgttaggaggtacgaggtcggatacggacgtacgaccggtacggacgtaacgtaacgtaacggtaaactaaaacgttaaaacgtacgaacgtaacgtaacgtaccgggaagtaccgaagtaaccggttaccgtaacccgtttaaccggaacgtaacccgaacgttaccgtaccggtaacggttaacggttaccttaaggttaacggtaaggtacggaactcggtacgtaacggngtaaccgtacggagacgtaacgaccgtaagaccgtaacgttactacgttaagtttacgttacggttcaccgtacgtcgttaggtacgtacgtacgttaagttccgtacgtacttacgtacggtttacgaccggttacgacgggtaccgtacgaaccggttcgaccgtaccttcgacgtccg

SEQ ID NO: 261418 - DNA, 772 bp, Homo sapiens
  misc_feature: GYAE6OF02JH8FG.1.5.A05.1.454.CMB.1.raw
  modified_base (137)..(137): a, c, t, g, unknown or other
  misc_feature (137)..(137): n is a, c, g, or t
  modified_base (150)..(150): a, c, t, g, unknown or other
  misc_feature (150)..(150): n is a, c, g, or t
  modified_base (156)..(156): a, c, t, g, unknown or other
  misc_feature (156)..(156): n is a, c, g, or t
  modified_base (224)..(224): a, c, t, g, unknown or other
  misc_feature (224)..(224): n is a, c, g, or t
  modified_base (240)..(240): a, c, t, g, unknown or other
  misc_feature (240)..(240): n is a, c, g, or t
  modified_base (261)..(261): a, c, t, g, unknown or other
  misc_feature (261)..(261): n is a, c, g, or t
  modified_base (275)..(275): a, c, t, g, unknown or other
  misc_feature (275)..(275): n is a, c, g, or t
  modified_base (362)..(362): a, c, t, g, unknown or other
  misc_feature (362)..(362): n is a, c, g, or t
tcagacgagtgcgtcacgaccggtgctcgatttagatagatagacaggggacccaacaaccacatccctcctcagaacgcccccagagcacaaccgccccaccatggactggacctggaggatccttcgtttttggnggcagcagcccanaggtcncccacctcccacggtccagtcttgtgactgtcgtggggctaggaggtagaaggacgccgtgggcctgnggtagtacggtttccngacgaggtctagagtactacnccttcacgtagtantactatacgtagttggcgaccgccgaccgggccccgaagaaggtctagaggtacggtagtacgggagtaggactacggacgtacggnggtaacgtaagtacggaaacctaaataaaactacgaacgaacgttaaccggtacggaggaacgtacgtaccgtaaccgtaaccgttacgaaccggactaacgtaccggtaccgcgggtaacttacgttaacgttatacgtacgggtacctagttacacggtacttaccggacgtacggtacggtaacccgtaacggaagtacccggtacgttacgtttagttacgttttacgtttacggccgttaacttccggacggttagtacgggtagttaaccttaggttaacgtaccgttcggttaaactttaccgggtttaccaccggggtttcccgggaccgggttaacccgggtaacggtttaacccgggtccgttaccccggtaccggtttacccgtcccctaaccccgggg

SEQ ID NO: 261419 - DNA, 680 bp, Homo sapiens
  misc_feature: GYAE6OF02G06SE.1.5.A05.1.454.CMB.1.raw
  modified_base (220)..(220): a, c, t, g, unknown or other
  misc_feature (220)..(220): n is a, c, g, or t
  modified_base (284)..(284): a, c, t, g, unknown or other
  misc_feature (284)..(284): n is a, c, g, or t
  modified_base (561)..(561): a, c, t, g, unknown or other
  misc_feature (561)..(561): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaggtttccngcaaggcttcaggatacaccttcactaggtatgctatacattgggtgcgccacggtcccccganaaaggtcttgagtggatgggatggatcgaacgctggacaatggtaaacaaactaaaaaattcaacgaagtaaacgttcccgaaggggacaggactaccgtaaccgttttaccgaaggggtaccaactacgtcccggacggtaacggtaactttacgttaatagtagggactcgtagacgcaacgtcctagacgtaactaccggaagacgtacggtcctagtttacttagtttttgtacgtaccgttaaccgttcgttacgggttagggaacggtttntaacgttttagtttaccggaactttaccgttaaagttttccgtaccgttccggttacggggacccgtaccggggttaaccccgttggtaccccgtaccgtttcccgtcccgttaacccg

SEQ ID NO: 261420 - DNA, 256 bp, Homo sapiens
  misc_feature: GYAE6OF02GTIC1.1.5.A05.1.454.CMB.1.raw
  modified_base (249)..(256): a, c, t, g, unknown or other
  misc_feature (249)..(256): n is a, c, g, or t
tcagacgagtgcgtcacgaccggtgctcgatttagatagatagacaggggcagttccagatttcaactgctcatcagcagcctgcagtctgaagattttgcagtttattactgtcagcagtataataactggcctccgacgttcggccaagggaccaaggtggaaatcaaacgactgtggctgcacatctgtcttcatccttcccgcatctgatcgtactgcgctgagcgggctggcaaggcgcatagnnnnnnnn

SEQ ID NO: 261421 - DNA, 983 bp, Homo sapiens
  misc_feature: GYAE6OF02FQ9JP.1.5.A05.1.454.CMB.1.raw
  modified_base (262)..(262): a, c, t, g, unknown or other
  misc_feature (262)..(262): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctggaggtagaagagcctggggcctcagtgtacggtttctgcaaggtcttcaggatactaccttcaactaggtatcgtntatacagttgggtgccgccgacggtacccccggaactaaacgggtcttacggtaggtacgggtaaggtcggggtagtacggtaacgtaccgtaaccggtacggtagggaccgtaacggttacgggtaaaacctaaaaccgttaaaaaacgttacgtaaaaccgaacgggttaaacggtttacccggaaggggtaccgtaaggacgtaccctaaccgtttaaccgacgggtaacctaacgaaccgtacccggtaacggtaagggttacctttaacggtttaagttacgggtacggtaacgttaccgtagggtaaccggtacggaccggtacccggttaacgtaaacgggttaaccgtaaccgggtaacgtaaccgggtaccgggttaacgttttaccggtttaacgtttttaacggttttttacggttacgggtttacccgtttaacccggttttaccgggtttaacgggggttacgggttaaaccgggtttacgtttaaacgggttttaaaccccggttttaacggttacccgtttaaccgggttttaaaaccggttttaacccggtttaacccgggttaacccccccgggggtttaaacgggggttacccccggggtttaaacccggggggttttaaacccccggggtttccgggggttttaaccccccgggtttaaccccgggtttacccccggtttaacccccgggttttacccccgg

SEQ ID NO: 261422 - DNA, 665 bp, Homo sapiens
  misc_feature: GYAE6OF02GZ3ZL.1.5.A05.1.454.CMB.1.raw
  modified_base (135)..(135): a, c, t, g, unknown or other
  misc_feature (135)..(135): n is a, c, g, or t
  modified_base (142)..(142): a, c, t, g, unknown or other
  misc_feature (142)..(142): n is a, c, g, or t
  modified_base (179)..(179): a, c, t, g, unknown or other
  misc_feature (179)..(179): n is a, c, g, or t
  modified_base (239)..(239): a, c, t, g, unknown or other
  misc_feature (239)..(239): n is a, c, g, or t
  modified_base (265)..(265): a, c, t, g, unknown or other
  misc_feature (265)..(265): n is a, c, g, or t
  modified_base (279)..(279): a, c, t, g, unknown or other
  misc_feature (279)..(279): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
  modified_base (452)..(452): a, c, t, g, unknown or other
  misc_feature (452)..(452): n is a, c, g, or t
  modified_base (482)..(482): a, c, t, g, unknown or other
  misc_feature (482)..(482): n is a, c, g, or t
tcagacgagtgcgtcacgaccggtgctcgatttagatagatagacaggggacccaacaaccacatccctcctcagaacgccccagagcacaaccgccccaccatggactggacctggaggatccttgtttttggnggcagcncgccacgaggtcgcccactcccgaggtccagcttggngcctagtcgtggggctaggaggtgaagacgcccgtggggcctcgagtgtaacggtttccnggacgaagtcttacgaaggtactacnccttcacgttagtntcgactatactagttggtctcgccgaccgggacccccgacgaaaggtcttggtacggtgagttcgggatcggacgaccgtaacggcgtacggactaagtacggtaacaaacgtaaaactacgaacagtaacgtcgaagcgagcgtactaccgttacgacgaacncganccggngacgtactacgtacgtagtgacgagtacgngcgacgacgtagaacgcgtaaccgaagaccggctacggtttataacgtttctttaggtccgtacctacgttacggtagttccggaattacgtacttaacgtacgtcgttaacgttactacggtacggtccgtacgggtacggtaaccggtaccgttgtaccccgtcggttccctaccgtaccg

SEQ ID NO: 261423 - DNA, 198 bp, Homo sapiens
  misc_feature: GYAE6OF02I10EP.1.5.A05.1.454.CMB.1.raw
  modified_base (184)..(198): a, c, t, g, unknown or other
  misc_feature (184)..(198): n is a, c, g, or t
tcagacgagtgcgtcacgaccggtgctcgatttagatagatagacagggcaccaagggcccatcggtcttccccctggcaccctcctccaagagcacctcgtgggggcacagcggccctgggctgcctggtcaaggactacttccagtactctatctgagcgggctgggacaaggcgacatagnnnnnnnnnnnnnnn

SEQ ID NO: 261424 - DNA, 786 bp, Homo sapiens
  misc_feature: GYAE6OF02I3XHP.1.5.A05.1.454.CMB.1.raw
  modified_base (126)..(126): a, c, t, g, unknown or other
  misc_feature (126)..(126): n is a, c, g, or t
  modified_base (133)..(133): a, c, t, g, unknown or other
  misc_feature (133)..(133): n is a, c, g, or t
  modified_base (246)..(246): a, c, t, g, unknown or other
  misc_feature (246)..(246): n is a, c, g, or t
  modified_base (409)..(409): a, c, t, g, unknown or other
  misc_feature (409)..(409): n is a, c, g, or t
tcagacgagtgcgtcacgaccggtgctcgatttagatagatagacaggggacccaacaaccacatccctcctcagaacgccccagagcacaacgccccaccatggactggacctggagactccttnttttggnggcagcagccacgaggtgcccactcccgaaggtccagtcttgtcgcaggtcgtgggtctgggaggtgaagacgccggttacggggcctacgaaggttcggtaacgtttcccgnggacgaaggtccttcgaaggtaactacctaccgttacacgttaaggtactgtacttaacgtactaggttggggtcgcccggaccgtaccggtcccccgggaataaggtcgtttaacgggagttcgggaaggtacggggacttacgggaacctacggtaaccgnggttacggaccgtaaaaggttcggtaaaacctaaagtaaaaccttcgaaaacgtaacgtaccggttaaccggaggaacgtacggaacgtttaccgttaacccgtaaagggtacggaacctacgtaaccgtccggaacgtaaggtaacttttaacggtacttacggggacgtacgtacgaggacgtacacgggtaccgttggaaccggtaacctaagggaaaccctacgaccgggttagtattaacggttttgtttaaccgtcgtaaccttacggtagttacggtagtccggtttaagacttacttcgtacctaggttctacggtccgtacggtccgggtacctacgggtcccgtccgtagcccctacctcccggtaa

SEQ ID NO: 261425 - DNA, 763 bp, Homo sapiens
  misc_feature: GYAE6OF02HP4OU.1.5.A05.1.454.CMB.1.raw
tcagacgagtgcgtcacgaccggtgctcgatttagatagatagacaggggacccaacaaccacatccctcctcagaagccccagagcacaaccgccccaccatggactggacctggaggatcctcttttggtggcagcagccacaggtcgccactcccaggttccagcttcgtgcagtctaggggctggaggtagaagaacgccgtcggggtcctcaggtcgtaaggttttccctggtcaaggtcgttacagggtacttaccgaccttcgacgttaggtatggtactaacgttacctagtttggggtcgccgtccgaaccgggccccccggtaacgaaacggtcgttggacgtggagttcgggtattagggtaactaccggaacgtctaggaccaagtaaggtaaacaactaaaaaacttcgaaactaagaacgttacgacgggtacagacgtacctaccttaccgaacgaaccgactacgtcccggaagtacggtaactttacgttaacgtagttacgggatcggtagtagaccgatcccgtagtaacgtacctaccggtaacgacccggtaacggccttagtttaacttcgtttttggtaccgtccgtaaccgttcgtaacgttaggtaacgttccgttaagttacgttacccgttaccgttaacggtaacgttttaaccggtccgttaacgggttcggggtacccgttaacggggtaccctaccgggttacctaacccgggttcccttacccggtaaccc

SEQ ID NO: 261426 - DNA, 623 bp, Homo sapiens
  misc_feature: GYAE6OF02GKII2.1.5.A05.1.454.CMB.1.raw
  modified_base (287)..(287): a, c, t, g, unknown or other
  misc_feature (287)..(287): n is a, c, g, or t
  modified_base (484)..(484): a, c, t, g, unknown or other
  misc_feature (484)..(484): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagccgtggggcctcagtgaaggtttcctgcaaggcttcaggatacaccttcactaggtatgctatacattgggtgcgccacggcccccgganaaaggcttgagtggatgggatggatcaacgcgtggcaagtggtaaacaataaaaaattcaacagaagttaccgagggacagacgtacctacctttaccgaggacacactccgcgaggtacttacttatagtggagtctaggacgcgacggcctaggaacgacgtaccgaagacgacgtcgtagttatttagttttgngtccgtaaccgttgttagggttcggtaggttactaagtttacgttaccgtcttacgtaacgtttagtaccgtccggttacggggaccgtaaccggggttacccgttcggtacccgtacccgtttcccgtcccgtacccg

SEQ ID NO: 261427 - DNA, 955 bp, Homo sapiens
  misc_feature: GYAE6OF02GR7DE.1.5.A05.1.454.CMB.1.raw
tcagacgagtgcgtcacgaccggtgctcgatttagatagatagacagggggacccaacaaccacatccctcctcagaagcccccagagcacaacgccccaccatggactggacctggaggatccttctttttggtggcagcagccacaggtgcccactcccaggtccagcttgtgcagtcgtggggctgaggtagaaggagccgtggggcctcgaggttaggtaaggttttcctgacgaagggtccttacgagggtaacttaaccacctttaccaaccgttaggttaactggtaccttaattaaccgttaagtttggggtacgccgtacccggacgggaccccccggggaaacaacgggtacgttacggtaacggtaggggaaggtgggggtagttacggggaacttaccgaaccggcggtttacgggacgtaaaagttaaccggggttaaaacctaaaaacggttaaaaaaacttaccgtaaaaccgtaacggtaaacggtttacccgggaacgggtaccgtaggtaaccgtttacccgtaaacccttttaaccggaaccgggtaacgtaaccgtaaccgtaccggaccggtaacgggtttaactttaaaccgtttaagttacggttacgggtaaggtacgttaggtaacgtaccgtacggtccgtaaagggtacgaacggtaaccgaacggtaacgaaccgggttcgtttaacggttacgttttaagggttttttacggaccggttaccgtaaccgtttaccgggtttagggtcgggtttaacgtaaccgggtttaagtttttaacgtaaccggttccgttttaaacgtttaacggtttaacccggttaccggttaccccggggttaaccgggggtcccgggttaaacggggttaaccccgggttccggttaacccgttaaccccggggtttacccctttaccggtaccccgg

SEQ ID NO: 261428 - DNA, 751 bp, Homo sapiens
  misc_feature: GYAE6OF02H7U7I.1.5.A05.1.454.CMB.1.raw
  modified_base (455)..(455): a, c, t, g, unknown or other
  misc_feature (455)..(455): n is a, c, g, or t
  modified_base (474)..(474): a, c, t, g, unknown or other
  misc_feature (474)..(474): n is a, c, g, or t
  modified_base (551)..(551): a, c, t, g, unknown or other
  misc_feature (551)..(551): n is a, c, g, or t
tcagacgagtgcgtcacgaccggtgctcgatttagatagatagacaggggacccaacaaccacatccctcctcagaacgccccagagacacaacgccccaccatggactggacctggaggactcctacttttggtcggacaggacacggcccacgtaggtcgacccactaccccgaggtccaggtccttaggtcctacgtacgtctacggggtctaggaacggtagaaagaacgccgtcgggacctacgaggtacgtaacggttttccgagacgtaacggtccgttacgacggtaactacctacttccgacgtaggtacgtcggtactagtacctaggttaggcggtaccgccgaccggtaccccggaagtaacggtacttaggaggttaggaccgtaggaccgtaggactacgtacgacgtacgacgtagtaaggaacaacgttaaaacgttanaacgtacgtacgagggtanacggacgtacgtaacctacggtaacgacgtacactaacgacgagtaactacgtacgtagtacggatacgcgtaacgntccgttacgacgggtaacgactacgacgacgtagtaccgttagtactttacggtacgtcgaaccgttaaccggtgtacggttacggtacgtacgttacgtttacgtacccgtataaaccgttacgtttgtaccggtagtaacccgggtacggtaacccggttcgtacccggtcccgttaactccttaccgggtactaccg

SEQ ID NO: 261429 - DNA, 680 bp, Homo sapiens
  misc_feature: GYAE6OF02FG7AY.1.5.A05.1.454.CMB.1.raw
  modified_base (228)..(228): a, c, t, g, unknown or other
  misc_feature (228)..(228): n is a, c, g, or t
  modified_base (232)..(232): a, c, t, g, unknown or other
  misc_feature (232)..(232): n is a, c, g, or t
  modified_base (309)..(309): a, c, t, g, unknown or other
  misc_feature (309)..(309): n is a, c, g, or t
  modified_base (617)..(617): a, c, t, g, unknown or other
  misc_feature (617)..(617): n is a, c, g, or t
tcagacgagtgcgtcacgaccggtgctcgatttagatagatagacaggggacccaacaaccacatccctcctcagaagcccccagagcacgaacgccccaccatggactggacctggaggatcctcttttggtggcagcagccacaggtgcccactcccaggtccagcttgtgcagtcgtaggggctgaggtagaagaagcctggggcctcgagtggtaaggtttccncganaacgggtcttcgaggacttacacctttcgactagggtatgtctatacattgggtgccgccgacggccccccggtaanaaacggcttaggaggtacggagtcgggataggactactacgacgtaggacgtaagttaggaaactaacgtaaaaacttcgaactaggtaacgttaccgagggacaacggtacgtacccgtactttacgacggacacgtaacgtccgagtacggactttaacgtagtactaggaacgtcgtaggaacgtcgacgtacctaggtaagtacgtaccgaagaccgacggtctagtacttttacgtttaggtcgtaaccgtaccgtcgttaagcggtaggtaccttagttaccttacgcgttacttaacgttnaaccgttccggacggacgtttaaccgggacccgttacggtactacccgtacttccggtaaccc

SEQ ID NO: 261430 - DNA, 735 bp, Homo sapiens
  misc_feature: GYAE6OF02HC4VT.1.5.A05.1.454.CMB.1.raw
  modified_base (231)..(231): a, c, t, g, unknown or other
  misc_feature (231)..(231): n is a, c, g, or t
tcagacgagtgcgtcacgaccggtgctcgatttagatagatagacagggggacccaacaaccacatccctcctcagaagcccccagagcacaacgccccaccatggactggacctggaggatcctctttttggtggcagcagccacaggtgcccactcccaggtccagcttgtgcagtcgtggggctgaggtgaagaagccgtggggcctcgagtgtaacggtttccgtgnaaggtcttacgaggatacgtaccttacacttaggtatgactatactagttgggtcgcgccaccgggtacccccggaacgaaacggtccttaggacggtggtacggtggggtagtgggtataccgaaacggtcgtcggactaacggtggtaaaacctaaacgtaaaaactacaaccgtaagtaacgttacgagggacacgtagtacctaaccgtttaaccgacgggtaccaaccgtacgtcccggacgacggttagtttaaccgttagtaagttgggtacggtacgtaggacgacgtacggacctagggtaacctcgtaccgaaacgaccgtacggtcgtacgttagtttacgtttttcggacgttaccgtacccttagttacgggtggtacggttactacgtttacgttacgtcttaacgttaactttcggtaccggttacccggcggggttacgtaacccgggttaaccgtcggttaacccggtccgttaccgtccgtacccg

SEQ ID NO: 261431 - DNA, 798 bp, Homo sapiens
  misc_feature: GYAE6OF02JS5WO.1.5.A05.1.454.CMB.1.raw
  modified_base (217)..(217): a, c, t, g, unknown or other
  misc_feature (217)..(217): n is a, c, g, or t
tcagacgagtgcgtcacgaccggtgctcgatttagatagatagacaggggacccaacaaccacatccctcctcagaacgccccagagcacaacgccccaccatggactggacctggaggatcctcttttggtggcagcagccacaggtgcccactcccaggtccagcttgtgcagtcctgggctggagtgaagagctgggctcagtgtaaggttccngcgaaggtcttcgaggctacaccgttcacgtaggtaactgcgttactactagttgggttcgaccgacccgacgggtaccccccggactaaacgggtcgttacggaacggtcgggtaacgtggggacgtaggggtacgtaccgtaaccggacgttacgggaccgtaaacgttacgggtaaactaaaccgtaaaaaaacgttaccgtaacgaacggtaaacggttaaccgtaacggggtacgaaaggtacgtaccgtaaccgtttaaccgaaccggggtactaaacgtaaccggtaccgtaccgggtaaggtaaccgtttaacgttaaggtaaaccgtttagggtaacggcgtaacggacggtaacgtacgtaccggtagtaccggaacgtaccgtaacggacgtacggtgtacggttactttagtttcggcgtacgtaccggttacttacgggtagggtaacgttacctaggttacgttacccgtgttacgtaaccgtttaggtaaccttacgggttaccgggcccggtaagggttacccccgttaggttacccctaccccggttagtaccccgttacccgg

SEQ ID NO: 261432 - DNA, 740 bp, Homo sapiens
  misc_feature: GYAE6OF02JXZDJ.1.5.A05.1.454.CMB.1.raw
  modified_base (135)..(135): a, c, t, g, unknown or other
  misc_feature (135)..(135): n is a, c, g, or t
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
  modified_base (506)..(506): a, c, t, g, unknown or other
  misc_feature (506)..(506): n is a, c, g, or t
  modified_base (514)..(514): a, c, t, g, unknown or other
  misc_feature (514)..(514): n is a, c, g, or t
tcagacgagtgcgtcacgaccggtgctcgatttagatagatagacaggggacccaacaaccacatccctcctcagaacgcccccagagcacaacgccccaccatggactggacctggagatccttctttttgggnggcagtagcacaggtgcccactcccaggtcccagcttgtgcagtcgtgggctggaggtgaagagtccgtgggcctcagtggtaaggtttcctgacaggcttacgagtataaccnccttanacgttagtatgactatacagttggtcgcgccgaccggacccccggaacgagtaccgtagaggtggagtgggagtaggactaccacgcgttggataacgtacggtaaactaaacgtaaaaacgttacaacgaagaaacggttccgaagggacctaggtaccgtcctaaacccgttacgtaaggacctacgtacgacgacgtaaggtacttacttagtaacgtaggtacgtctaggacgacgtcggtaaccgnggtaactnttaccggtagaaacggtacccgaacgggttctttaagttagttttacggttttacgtacgtccggttacccgttgttacggttacgggtaagttacgttacgttttaactcggttccttaaggttaaccgttttaccgtaaccggttcccggttaacggggtacccccgttaacgggttacccgttaaccggttccctaaccccggtttaccttaaccgttccccg

SEQ ID NO: 261433 - DNA, 745 bp, Homo sapiens
  misc_feature: GYAE6OF02FQYM6.1.5.A05.1.454.CMB.1.raw
  modified_base (251)..(251): a, c, t, g, unknown or other
  misc_feature (251)..(251): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtctggggctgaggtgaagaagccgtggggcctcagtggaaggttttcctgcaaggcttacaggatactaccttnactaggtatgctatacattgggtgcgccgacggcccccggagaaaggcttgagtggagtgggatggactcgaacgctaggctaagtacggtaaacaaacaaaaaacttcaactaagaacgttaccgagggacaggacgtacgtaaccctttacgaacgggaacacgtacgtaccgacgtaacggtactttaaccgttaagtaagtagggaactcggtagacggtaccgacggtacccgtagaacgttaacgtaacccggaaacgacccgtacggtacgttacggttaaattttagttttacggtcgtaccgttaaccgttacggttaaggtacgggtaaacggttcgttaacgttaacgtttaaccgtacgtttaccttaaacgggtttaccttaaccgggttcccggttaacgggggtacccggtaacccggggttaacccggtttccgggttaacccgaaccccgggttttaccctaccccggttaaccccg

SEQ ID NO: 261434 - DNA, 753 bp, Homo sapiens
  misc_feature: GYAE6OF02JA1GP.1.5.A05.1.454.CMB.1.raw
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
  modified_base (222)..(222): a, c, t, g, unknown or other
  misc_feature (222)..(222): n is a, c, g, or t
tcagacgagtgcgtcacgaccggtgctcgatttagatagatagacaggggacccaacaaccacatccctcctcagaacgcccccagagcacaacgccccaccagtggactggacctggaggatcctcttttggtggcagcagccacgaggtcgcccactcccaggtccagcttgtgacagtcgtgggctggagtgagagcctgggcctnagngtaggttccngcaggcttacaggataccaccttcaacgtaggtatcgctatacgtagttgggtcgcgtccgaccgggaccccccggaagaacggtccgttaggagttacgggagttcgggaagttgggactacggtaacgtcgtacggtacaaacgttaggtaaacctaaacgaaaaacgtttccgaaacgaacggtaaacgttacccggagggaccgtaggtaacgttacgtaaacctttacgggaacgggttaccaacgtacgtacccggagtaaggtactttacgtataggcggtaagcgtagggtacacgtacgcgtacgtaacgtactaaccggagaaccggtaccgtgtatttaagtttcgttttacggagggttacccctaggttcgtaggtttaccgggtacggttagttaacctttacgggttaccgttacgtaacgttaaccggtttttacgaccggttccggtaccggggttaaccgacccggggtttaccctcgggtaaccgtacccggttccgtacccgttaacccgg

SEQ ID NO: 261435 - DNA, 757 bp, Homo sapiens
  misc_feature: GYAE6OF02HIRR5.1.5.A05.1.454.CMB.1.raw
  modified_base (103)..(103): a, c, t, g, unknown or other
  misc_feature (103)..(103): n is a, c, g, or t
  modified_base (187)..(187): a, c, t, g, unknown or other
  misc_feature (187)..(187): n is a, c, g, or t
tcagacgagtgcgtcacgaccggtgctcgatttagatagatagacaggggacccaacaaccacatccctcctcagaagcccccagagcacaacgccccaccanggactggacctggaggactccttcgtttttggtggcagcacgccacaggtcgcccactcccgaggtccagcttgtgctagtcgnggggctggaggtgaagagccggtcgggcctgaggtgtaacggtttccgtgacgtaaggtccttcgaaggtacttaccaccttcgacgtaggtatcgtacttaagtacgtaggtttgggtcggaccggtcccgaccggggacccccggaacgtaaacgggtcgttacggtaggtgggtaggtacgggaacgttcgggactaccgaaccggcgttacgggacgtaaagtaacggtaaaacctaaaacgtaaaacttcaaacgtaagtaaccgttacggaacgacgaagtacgttaacctaccgtttaacggacgaacctactacgacggacgaaggtattacgtataacggtggactcgtgacgacgtacgtcctaggaacgtaccggtaacgaaacgccggttaacgtcgttagttaacgttttcggttttacgcggtacccgtaacgttcggtaacggttggtagttacgttactttaccgtacgttctacgttaattaccggacttccgggacggtaaccggttaccggtaccctacggttacccgtacccgttccggtcctaaccggg

SEQ ID NO: 261436 - DNA, 649 bp, Homo sapiens
  misc_feature: GYAE6OF02HKADG.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctggggctgaggtgaagaagccgtggggcctcagtgaaggtttcctgcaaggcttcgaggatacaccttcactaggtatgctatactagttgggtgccgccgacggcccccggaacgaaaggcttggacggtggagtgggagtggatacgaacgcgtggactaagtaggtaaactaaactaaaaaattcaacgaagtaacgttaccgaggacagtacgtactaccgtttaaccgacggaacacaacgtcccgacggtacgtaattacgttaagtagtagagtcgtagagctacgcctaggacgacgtacgaagacgtacggtacgtagttaactttagttttcgtacgtaccgtacgttcgtaggttacggtagttactacgtttagttaccgtacttacgttaatttcgtaccgttccggtacgggtacccgtacgggtacccgttcggtacctacccgtcctccgtaccg

SEQ ID NO: 261437 - DNA, 838 bp, Homo sapiens
  misc_feature: GYAE6OF02I2A43.1.5.A05.1.454.CMB.1.raw
tcagacgagtgcgtcacgaccggtgctcgatttagatagatagacaggggacccaacaaccacatccctcctcagaacgcccccagagcacaacgccccaccatggactggacctggaggatcctctttttggtggcagcagccacgaggtcgcccactcccgtacggtaccagtccgttgtcgctacgtcgtggggtctggaggtgaaggacgtccgtggggtcctcgtagtaggtaacggtttcgtgacgacggtcttacgaggtactacgtaccttcgacgtagttactcgtacttatacgtaacgttggggtacgcccggtccgacccgggtacccccgaacgtaacggtccggtaggaggttacgggagtagggtagtacggacgttaaccggacgtacggtacggtaaccgtaagtaacggtaaaaccaaacgttaaaaactaccgtaaacgtaacggttaacggttaccggaaggggacctaggttaaccgtttaccgtaaccgtttaaccgggaacgtaacctacgtaacgtccggacgttaacggttactttacgtaagttacgacggtacgtacaggctacgtacgtccgtacgcgttaacgtacggaccgtaacggtccgtagttagtttacgttacggtttttacggtcgtacccggttaaacgttcggttaaggtttaacgggtaccggttttaactaagtttaccgtttacgggtactttaaccgtttaagggttacccggttacggttcccggggtaacggtaccccgggtaaccggttacccgtaaccggttcccgttaaccgttcccgttacccgtacccg

SEQ ID NO: 261438 - DNA, 856 bp, Homo sapiens
  misc_feature: GYAE6OF02F03U2.1.5.A05.1.454.CMB.1.raw
tcagacgagtgcgtcacgaccggtgctcgatttagatagatagacagggggacccaacaaccacatccctcctcagaagcccccagagcacaaccgccccaccatggactggacctggaggatcctcttttggtggcagcagccacaggtgcccactcccaggtcccagccttgtgccagtcgtggggctgaggtgaagaggccgtgggcctcgaagttgtaacggtttcctggacgaacggtcttacgaaggtacttaccgtaccttcaacgttaggtatcgtactaatactagttgggtcgcgaccgaccgggacccccggaacgaacggtcgtcggtaggtacggaggtgggtacgtgggactacgaacgcggtaggtacgtaagttaacggtaaactaaacgtaaaactacgaaacgtacggtaaacggttaccggagggtacgtaacggaccgtttaacccgtaaccgttttaacccggaaacggggtaacctaacccgtaaccgtacccgggtaaccgtaaacgggtaactttaaacgtttaagtacgggtaggtaaccgtcggttaaggacggtaccggtacgtaccggaagttacgaccgtaacggtaaccgacggtacgggtactttaggttaaaccgtttttaggtttacggtacccggttaccgttaccgtttacgttaggggttacggttaaacggttaaccgttacgttttaacttaccgggttaccttaacggttttaacgttccgggttaacccgttaccgggaccgggttaacccgggtaccggttaacccgggttccggttaccccggtaccctttacccgggtaccttaacccccggg

SEQ ID NO: 261439 - DNA, 786 bp, Homo sapiens
  misc_feature: GYAE6OF02G6G3T.1.5.A05.1.454.CMB.1.raw
tcagacgagtgcgtcacgaccggtgctcgatttagatagatagacaggggaccaacaaccacatccctcctcagaagccccagagcacaacgccccaccatggactggaccgtggaggatcctctttttggtggcagcagccacaggtgcccactccaggtccagcttgtgcagtctgggctgaggtgaagacgcgtggggcctcgagtagtaaggtttcctgacgaaggtcttacgaggactaaccaccttttacaccgttaaggtatcggtaccttaatacgtaagtttcggggtacgtccggtaccgaccgggtccccccggaaagtaaaacgggtccgtttggaagggttacggaaggtcgggtaattcgggaacttacggaaacgtccgttagggaccgttaaaagtacgggtaaaacaaacgttaaaaaacttacaaaccgtaagaaacggtttacgaacggggtagaacggtacgtttacaaccgtttaaccgaggaaccgtacacgtaccgaccgggtagtagtttaacgttaattaaggtggaacgttcgaacgttaggacgtacggtcttaggaacgtacgtacgaaacgacggtacgtatacttaagtttacgttttgtaccgcggtttaacctccgttagggccggttagttacgtaattttaacggtacgtacttacgttaacgttacgtttaccgtccgggttaccggaacccggtaacgggtttacccgtacggtttcccgaacccggttttccgtacccgtttaacccgg

SEQ ID NO: 261440 - DNA, 812 bp, Homo sapiens
  misc_feature: GYAE6OF02I76G3.1.5.A05.1.454.CMB.1.raw
  modified_base (225)..(225): a, c, t, g, unknown or other
  misc_feature (225)..(225): n is a, c, g, or t
tcagacgagtgcgtcacgaccggtgctcgatttagatagatagacaggggacccaacaaccacatccctcctcagaacgcccccagagcacaacgccccaccatggactggacctggaggatccttcttttggtggcagcagccacaggtgcccactcccaggtccagcttgtgcagtctggggctgaggtgaagacgccgtggggcctcaggtgtaagtttccngacgaggtcttcgaggactaccaccttacacgttaggtatgctatactagttgggtacgcggccgacggcccccgaagaaacggtcgttaggacgtgggagtagggacgttcgggataccggtacgtcgtacgggacaaagttacgggtaaacctaaacgtaaaaacttacgaaaccgtaaaggtaaaccggtttacccggaagggaccgtaacggtacgtaccctaaccgttttaaccggaaggaccgtaacgtacgtacccggtacggtaacggtacttttaacttaagtacggttaggacggtacgtacggagtaccgtacggaccgttaaggaacggtacttaccgggtaaacgacccggttaccggtaaccgttaggtttaagttttaccgggtttttcgtacggttaacccggtttaacctttaccgggttaaggggttacgggtaacgtttccgttaacgttttacgttaccgtttaccgtacgtttaaaccggttttcgtacccgggttaccggtaccggggtaccgtaacgggttacccggtaccggtaccccgtccggttacccttccgtaacccgg

SEQ ID NO: 261441 - DNA, 696 bp, Homo sapiens
  misc_feature: GYAE6OF02GC6AN.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatccttctttttgggtggcagcagccacaggtgcccactcccaggtccagcttgtgcagtcgtggggctggaggtgaagaagccgtggggcctcgagtgtaacggtttccgtgacgaaggtcttcgaggactacaccttcacgtaggtatgactatacgagttgggtgccgccgaccggacccccggaacgaaacggtcgttcggaggttacgggtaggtggggtagtcgggactacgaaccggtcggtaggtacgtaagtaacggtaaacaaactaaaaaacgtcaaacgaagtaacgttaccgagggacacgtacgtaccgtaaccgttaaccgaaggtaccaacgtacgtccgagacgtactttaacttataggtacggtagtcgtagtacgactcgacgtagagtactacgaacgacgtacgtacttagttactttacgtttagcgtaccgttaccgttagtagggtacgtacggttactaagtttactacgtacttacgttagttacgttacgtccgggtacgggccgtacccgggtaccgttccggtaacccgtccgtcctaccgtacccg

SEQ ID NO: 261442 - DNA, 932 bp, Homo sapiens
  misc_feature: GYAE6OF02JFF4P.1.5.A05.1.454.CMB.1.raw
  modified_base (132)..(132): a, c, t, g, unknown or other
  misc_feature (132)..(132): n is a, c, g, or t
  modified_base (149)..(149): a, c, t, g, unknown or other
  misc_feature (149)..(149): n is a, c, g, or t
tcagacgagtgcgtcacgaccggtgctcgatttagatagatagacaggggacccaacaaccacatccctcctcagaacgcccccagagcacaacgccccaccatggactggacctggagatcctcttttggnggcagcagccacaggtncccactcccaggtccagccttgtgcagtccgtggggctggagtacgaagacgtcctggggcctcgagtacgtaagggtttcccaggacctaaaggtccttacgaaggtaactaccgtaccctttacgaacgtaaggtactcggtacttaactaacgtaacggtttcggggtacggtacccggacccgtaaccgggtacccccccggtaaacgtaaaacgggttacccttaagggtaacgggttaccggggtaaagttaaccggggggtaacttacggggtaaccgttaccggtaaaaccggtcgttacgggaacccttaaaggttacgttaaaaaccgtaaaacgtaaaaaacgttacgaaccgtaaaggtaaccgttaccggtaacgggtaactaacggaaccgttaacgtaaacccgttttaaccggaacggggtaaccgtaaaccgtaacgtacccggtaacggtaacggtaaactttaacgtaaacgtaacggtacgggtaagtcctaacgggtacgcgaacgttaccagggtaactacgtaaccgaacgtaccgacggtaccgtaggtttaacgttaccggttttggaaaccgttaccgtaaaccttacgggttaacggaacgggttaaacgttaccggttaaactttaccgggtaaccctttacggtaaccgttaaacgttaccgggttacttaacccggggttcgggaaaccggttaccgggttaacccgttccggtaacccgttaaccccggtttaccgtacccggttaaccccg

SEQ ID NO: 261443 - DNA, 760 bp, Homo sapiens
  misc_feature: GYAE6OF02JFJ9F.1.5.A05.1.454.CMB.1.raw
  modified_base (210)..(210): a, c, t, g, unknown or other
  misc_feature (210)..(210): n is a, c, g, or t
  modified_base (270)..(270): a, c, t, g, unknown or other
  misc_feature (270)..(270): n is a, c, g, or t
  modified_base (278)..(278): a, c, t, g, unknown or other
  misc_feature (278)..(278): n is a, c, g, or t
  modified_base (313)..(313): a, c, t, g, unknown or other
  misc_feature (313)..(313): n is a, c, g, or t
tcagacgagtgcgtcacgaccggtgctcgatttagatagatagacaggggacccaacaaccacatccctcctcagaagcccccagagcacaacgccccaccatggactggacctggaggatccttctttttggtggcagcagccacaggtgcccactcccaggtccagcttgtgcagtctggggctggaggtgaagagccgtggggcctnaggtgtaggtttcctggacaaggtcttcgaggataccacttcagttaggtatgctatacngttgggtnccgccgaccggacccccggaacgaacggtctaggnggttaggtaggtgggagtggtataccgaccgaccgtcggataacgttaacggtaaacgtaaactaaaaacttaccgaacgtaacggtaaccgttaccggaaggggactaggtaacgtaccttaaccgtttaaccgacgggtaacacctacgtccggacgtacggttactttacttagtaggtcggtaagtctaggactcgaagtcgtagactacgtacggacgtaacgtcgtactttacgttacgttttagtttaccgtacggttaccaccgtttacgttaacggggttcgggtacggttaaccgtttaacgttttaaccgtttaccggttcgttaaccgttttaacggtttaacggttccccgttgggttaaccggggtaccccggtaaaccggggttacccgttccgggttacccgttacccccgtcgtttacccccgtacccgg

SEQ ID NO: 261444 - DNA, 773 bp, Homo sapiens
  misc_feature: GYAE6OF02IQLDX.1.5.A05.1.454.CMB.1.raw
  modified_base (233)..(233): a, c, t, g, unknown or other
  misc_feature (233)..(233): n is a, c, g, or t
tcagacgagtgcgtcacgaccggtgctcgatttagatagatagacaggggacccaacaaccacatccctcctcagaacgcccccagagcacaacgccccaccatggactggacctggagatccttctttttggtggcaggcagccacaggtgcccactcccgaggtccagcttgtgctagtcgtgggactggaggtagaagacgccgtggggcctgagtagtaacggtttccngcaggtcttgagtatacctaccttcgaacgttaggtatgacttatacgtagttcgggtgccgaccgaccggaccccccggaagtaacggtctttaggacggttagggacgttgggatcggggtatacgacgtcgtacggactaagtaacggttaaaacaaacttaaaatccgaacgtaagtaaccgttaccggaggcctaaggtacgtaccgttaacccgttacggaacggacctacgtacgtcccggtacggtaagttaactttacgtaagttacggtacgacgtcggtagtacggactaccggtccgtaaggaaccggttacgtaaccgaaacgtccggtaaccggttagttaccggttaattttaggttttaccggacgtaccgttcccgttaagttacggttacgggttaacggtctttaacgggtttactaccggttactttacggttaactttaccgggtacgttaaccgggtccggggtaacccgaaccgggttccttccgggtacccttacccggttcctacccggttaccg

SEQ ID NO: 261445 - DNA, 795 bp, Homo sapiens
  misc_feature: GYAE6OF02FY0LR.1.5.A05.1.454.CMB.1.raw
  modified_base (143)..(143): a, c, t, g, unknown or other
  misc_feature (143)..(143): n is a, c, g, or t
  modified_base (248)..(248): a, c, t, g, unknown or other
  misc_feature (248)..(248): n is a, c, g, or t
  modified_base (724)..(724): a, c, t, g, unknown or other
  misc_feature (724)..(724): n is a, c, g, or t
tcagacgagtgcgtcacgaccggtgctcgatttagatagatagacaggggacccaacaaccacatccctcctcagaagcccccagagcacaacgccccaccatggactggacctggaggatctcttttggtggcagcagccanaggtgcccactcccaggtccagcttgtgcagtctggggctgaggtgaagtaagccgtggggccttcgagtcggtaaggtttcctgacgtaaggcttacgaggtanacctacttcacgttaggattcgctaagtactattgggtcgccggtccacggaccccccggaagtaaaacgtacgttcggaacggttggaacggttaggggtagtagggtaacgttaccgaaacggtcgtacgggtacaaacgttagggttaaaaccaaactaaaaaacgttcaaacggtaacgtaacggttacccgaaggggacgacggtaacggtcccgttaaacctttaccggaaagggtaccaccgtaacgttcccggaacgtaacggttaagttaacctttaagaacggttggaaacgggtccgtagacggtactaccggtacgtagaaggttaacacggttaaacgaaccggtcccgtactttaaggttaacgttttagtttccggtaggtacccgttaaccgtaggtttaaccgggtagtacgggtttaccttaagtttaccgtttacgacgttagtttaaaccggtttntacccggttcgggtacggtacccggtacgggttacccgttacggttacccgtaccgttaccgtaccctccg

SEQ ID NO: 261446 - DNA, 736 bp, Homo sapiens
  misc_feature: GYAE6OF02GWS7P.1.5.A05.1.454.CMB.1.raw
  modified_base (250)..(250): a, c, t, g, unknown or other
  misc_feature (250)..(250): n is a, c, g, or t
  modified_base (295)..(295): a, c, t, g, unknown or other
  misc_feature (295)..(295): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtcgtggggctgaggtgaagaagccgtggggcctcgagtggaaggtttcctgcaaggtcttcaggatacaccttnactaggtatgctatacagttgggtcgcgccgacggcccccggaanaaaggcttggagtggagtggagtggatcgaacggctggactaagtacggtaaaccaaaacgtaaaaaacttcaaacgaacggtaaacgtttccccggaaggggtaccaaggtacgttaccttaacccgttttaaccggaacggggtaaccaaccacgtacccggtacggaaggtactttaactttaagttaatcgggtaagcgtaggacgtacgagtacctggacggtacgtaccgaaacggacgaccggtcttagttaagttttacgtttttggaccgttcggtaaccgttcgttaacgggttacggtacggtttacctaagttttacgttaccgtccgtttaacgttaacgtttccggtaaccttccggggtacgggtacccgggtaaccgggtacccgttccgggtaccctaccccggttaccgttccccgtaaccgg

SEQ ID NO: 261447 - DNA, 661 bp, Homo sapiens
  misc_feature: GYAE6OF02GCO9H.1.5.A05.1.454.CMB.1.raw
  modified_base (302)..(302): a, c, t, g, unknown or other
  misc_feature (302)..(302): n is a, c, g, or t
  modified_base (334)..(334): a, c, t, g, unknown or other
  misc_feature (334)..(334): n is a, c, g, or t
  modified_base (370)..(370): a, c, t, g, unknown or other
  misc_feature (370)..(370): n is a, c, g, or t
  modified_base (385)..(385): a, c, t, g, unknown or other
  misc_feature (385)..(385): n is a, c, g, or t
tcagacgagtgcgtcacgaccggtgctcgatttagatagatagacaggggacccaacaaccacatccctcctcagaagcccccagagcacaacgccccaccatggactggacctggaggatccctcttttggtggcagcagccacaggtgcccactcccaggtccagcttgtgcagtctggggctgaggtgaagaagcctggggcctcgagtgtaaggtttcctgcaaggtcttacgaggactaccaccttacacgtaggtatgactatacagttgggtcgcgccgaccggtcccccggaanaaacggtccttaggagtggagtgggagtgganacgaacgcgtcggacagtagtaacaacaaaatacanagtacgtacgacggnagtagtactaccgttacgaggtacactacgccgagacgtattactatagtggacgtgtaggagacgacgaccgtagacgtataaccggaagtaccgtaacggtctagttacgtttagttttcgaggttaccgacttacgttacggtacggtagtaccgttaagttacgtttaccgtctaacgttaacgtttacggaccgtttccggaaccggggtacccggtaaccgggttacccggtacgggtacccctacccggtttaccgtcccgttacccgg

SEQ ID NO: 261448 - DNA, 730 bp, Homo sapiens
  misc_feature: GYAE6OF02IQ51N.1.5.A05.1.454.CMB.1.raw
  modified_base (210)..(210): a, c, t, g, unknown or other
  misc_feature (210)..(210): n is a, c, g, or t
  modified_base (225)..(225): a, c, t, g, unknown or other
  misc_feature (225)..(225): n is a, c, g, or t
  modified_base (277)..(277): a, c, t, g, unknown or other
  misc_feature (277)..(277): n is a, c, g, or t
  modified_base (295)..(295): a, c, t, g, unknown or other
  misc_feature (295)..(295): n is a, c, g, or t
tcagacgagtgcgtcacgaccggtgctcgatttagatagatagacagggggacccaacaaccacatccctcctcagaagcccccagagcacaacgccccaaccatggactggacctggatgatcctctttttggtggcagcagccacaggtgcccactcccaggtccagcttgtgcagtctggggctgaggtgaagagccgtggggcctnagtgaacggtttccngcaaggcttcgaggactacctacctcacgtaggtatgctatactagttgggngcgccgacggccccgaanaaaggcttggagtggagtggggatggactcgaacgtcgtaggacaagtacggtaaactaaactaaaaacttcgaacgtaacgtaacggtaccgaacgggctaaggaacgttcctaaccgtttaaccgaacgggtaccaacgtacgtacccggaggtaacggtaatttaaccgtttaagtagtacgggaagtcgtagggacaccgagtacccgtaggaacgtaccgtaaccggaagtaaccggtacggtacttacgtttaagttttaacgtttttacggacggtaccgttaaccggttacgttagggtacggttaacggttaccttaagtttaccgttacggtaccttaacgttaagttttaccggacccgttccgggtacgggtacccgttaacgggacccgtttacgggtacccgttacccggtcctaccccgg

SEQ ID NO: 261449 - DNA, 768 bp, Homo sapiens
  misc_feature: GYAE6OF02INY10.1.5.A05.1.454.CMB.1.raw
  modified_base (293)..(293): a, c, t, g, unknown or other
  misc_feature (293)..(293): n is a, c, g, or t
  modified_base (315)..(315): a, c, t, g, unknown or other
  misc_feature (315)..(315): n is a, c, g, or t
tcagacgagtgcgtcacgaccggtgctcgatttagatagatagacaggggacccaacaaccacatccctcctcagaagcccccagagcacaacgccccaccatggactggaccctggaggatcctctttttggtggcagcagccacaggtgcccactcccaggtccagcttgtgcagtcgtggggctgaggtgaaagagcctggggcctcagtgaaggtttcctgcaaggcttcaggataccaccttacactagtatgactatacagttggtgcgtccacggacccccggaanaaggtcttggagtggagtgggngtggatacgaacgctggacagtacggtaaactaactaaaaagttcaacaagtaacgttaccgaagggtcaagtacgtacaccgtttaacgaggaacctacgacgtacccgacggtacggtaactttacctttaagtacggtagggtacgtaccgtaggtacggacgacgtaccgtaggaacgggtaccttaaacccgggaagtaaccggacggtacctagggttaaacgttttagttttttacggtacgacccgtttaaccgttacgtttacgggtacgggttaaacggttaaccgttatttaccgggttaaccgtcgtttaacccggtttaaagtttttacccggtaacccggtttcccggggttaaccgggggtaccccgtttaacccggggtaaaccccgttttcgggtaccccggtttaaccccgtttcccggtaacccttacccccgg

SEQ ID NO: 261450 - DNA, 817 bp, Homo sapiens
  misc_feature: GYAE6OF02GQG2B.1.5.A05.1.454.CMB.1.raw
  modified_base (643)..(643): a, c, t, g, unknown or other
  misc_feature (643)..(643): n is a, c, g, or t
  modified_base (674)..(674): a, c, t, g, unknown or other
  misc_feature (674)..(674): n is a, c, g, or t
tcagacgagtgcgtcacgaccggtgctcgatttagatagatagacagggggacccaacaaccacatccctcctcagaagcccccagagcacaacgccccaccatggacctggacctggaggatcccttcgttttggtcggtcagcagccacgaggtcgcccgactcccaggtccagcgttagtgcagtcgtggggctggaggtgaagacgtcccgtggggccctacgaggtagtaacggtttcccgtaggaccgtaacggtccgttcgtacggaacttaaccgtacccttacgtaacgttacgggtacgttcggtacctaacgttaaccgtagtttacggggtacgaccgtacccgtaccggggacccccccggtaacggtaaaacgggtcccgttagggtaacggtacgggtaacggtagggggtaacgttacggaagtacccgtaaaccggtcgttacgggtacgtaaacggttacggtaaaactaaaccgttaaaaacgtacgttaaacgaacggtaacgtttaccgggaacgggactacggtacgttaccgtaaccgtttaccgggaacggactaccgaacgtccgtacgggaacgttaacttaactttacgtacgtacggtacgtcgtacgacgtacncgtaccgtagagtacgacgaacgacgacgtntagttattagttacgtacgtcgttactcggtaagttacggacgttactacgttacgtacttccgtaacgtttagtaccggtacgtacggttaccgggacgtacggttaccccgagttaacccgtccggttcctacggtacccg

SEQ ID NO: 261451 - DNA, 764 bp, Homo sapiens
  misc_feature: GYAE6OF02FH27T.1.5.A05.1.454.CMB.1.raw
  modified_base (221)..(221): a, c, t, g, unknown or other
  misc_feature (221)..(221): n is a, c, g, or t
  modified_base (260)..(260): a, c, t, g, unknown or other
  misc_feature (260)..(260): n is a, c, g, or t
tcagacgagtgcgtcacgaccggtgctcgatttagatagatagacaggggacccaacaaccacatccctcctcagaagccccagagcacaacgccccaccatggactggacctggaggatccttctttttggtggcagcagccacaggtgcccactcccaggtccagcttgtgcagtctggggctgaggtgaagagccgtggggcctcgagtgagtttccngacaggcttacaggatactacttcactaggtatgtctanactagttgggtacgcgccgacggccccccggaagaaacgggtccttggaggtggacgtggggactagggtactaccgaaacggtcgtcggacgtaacgttagggtaaaacctaaacgtaaaaaaacttcgaaacgtaacggtaacgttaccggaaggggtactaaggtaacgttacctaacccgttttaaccggaacggggtaacctaacgtacgtacccggacgaaacgggttacctttaacgttactaggtacgggtagacgttaggacgtacgacgtaccgtaggtaacggtactaaccggtaacggaccgtacccgggtctttaacggttagttttacgtttggtacgtaccggtaccgtttacgttagggtcggtaacggttcttaaacgtttactttaccggtactaacggtttaacttcggtacccgttaccggtcggggtaacccgacgggtacccgttcgggttaccctacccggttaccttccccgttaacccg

SEQ ID NO: 261452 - DNA, 684 bp, Homo sapiens
  misc_feature: GYAE6OF02F9D8P.1.5.A05.1.454.CMB.1.raw
  modified_base (135)..(135): a, c, t, g, unknown or other
  misc_feature (135)..(135): n is a, c, g, or t
  modified_base (175)..(175): a, c, t, g, unknown or other
  misc_feature (175)..(175): n is a, c, g, or t
  modified_base (227)..(227): a, c, t, g, unknown or other
  misc_feature (227)..(227): n is a, c, g, or t
  modified_base (465)..(465): a, c, t, g, unknown or other
  misc_feature (465)..(465): n is a, c, g, or t
  modified_base (675)..(675): a, c, t, g, unknown or other
  misc_feature (675)..(675): n is a, c, g, or t
tcagacgagtgcgtcacgaccggtgctcgatttagatagatagacagggggacccaacaaccacgatccctcctcagaacgccccagagcacaacgccccaccagtggactggacctggaggatcctcttttggnggcagcagccacaggtcgcccactcccaggtccagcttgngcagtcgtgggctgaggtgaagacgccgtagggcctgagtgtaaggtttccngacaaggccttcgaggataccaccttcgaactagggtatgctatacagttggtgcgtaccgacggcccccgaagaacgtcgtgacggtagacgtggagtcggagaccaacggtgtacggactaagtacgtaaacaaactaaaaacttcgaacgtaggtaacgttccgaagggacaacggtacgtactaacccgtttacgaaggtaaccacaaccgtccgagaacgtagtaaccgttanacgttagactagtagagtaccgagccgtaggtacaacggtacgtaaacgacggccggttacgtagtttacgttaacggtttttgaccgttccgtaccgttaggttcggtagtaaccgttacgtagtttacgttacgtcgttaactaacggtttagaccgttcccggtagggtaacccgtacggtaacccgtggttacccgtaccgttacncccggtacg

SEQ ID NO: 261453 - DNA, 739 bp, Homo sapiens
  misc_feature: GYAE6OF02ILIUZ.1.5.A05.1.454.CMB.1.raw
  modified_base (245)..(245): a, c, t, g, unknown or other
  misc_feature (245)..(245): n is a, c, g, or t
  modified_base (664)..(664): a, c, t, g, unknown or other
  misc_feature (664)..(664): n is a, c, g, or t
tcagacgagtgcgtcacgaccggtgctcgatttagatagatagacaggggacccaacaaccacatccctcctcagaacgcccccagagcacaaaccgccccaccatggactggacctggaggactccttctttttggtggcagcagccacaggtcgcccactcccgaggtccagtcttgtgctagtcgtggggctgggaggtagaaggaacgccgtggggcctagagttacggtaaggtttccgngacgtacggtcttacgaaggtactacctaccttcgaacgttaggtatgacttaatacctagttgggtacgcggacccgacccggggacccccggaagtaaacggtcttaggacggttgggacggtaggggagttcgggaacgtaccgtaacggcgtacggactaaacggttaacggtaaaacctaaaacgtaaaaaacttccgaaacgaaagtaaacggttcccgaagggcgaacgtagtaccctaaccgttaaccgacgggtaaccaaccgtaccgtccggtaacggaaggttaactttaaccgttaagtaggtaggtacggtacgtgacgtacgacgtacgtagacggtacgtaccggaacgacggcgttaccgtagttagttacgtttgaccgtcgtacgtgtagtcgtagtactnttacgtctcttacgtagttcctacgttccggtcggaacccgacggtacccgtggttacccacgttccacgtaccg

SEQ ID NO: 261454 - DNA, 700 bp, Homo sapiens
  misc_feature: GYAE6OF02G6IG8.1.5.A05.1.454.CMB.1.raw
  modified_base (125)..(125): a, c, t, g, unknown or other
  misc_feature (125)..(125): n is a, c, g, or t
  modified_base (132)..(132): a, c, t, g, unknown or other
  misc_feature (132)..(132): n is a, c, g, or t
  modified_base (233)..(233): a, c, t, g, unknown or other
  misc_feature (233)..(233): n is a, c, g, or t
  modified_base (551)..(551): a, c, t, g, unknown or other
  misc_feature (551)..(551): n is a, c, g, or t
  modified_base (597)..(597): a, c, t, g, unknown or other
  misc_feature (597)..(597): n is a, c, g, or t
  modified_base (626)..(626): a, c, t, g, unknown or other
  misc_feature (626)..(626): n is a, c, g, or t
  modified_base (646)..(646): a, c, t, g, unknown or other
  misc_feature (646)..(646): n is a, c, g, or t
tcagacgagtgcgtcacgaccggtgctcgatttagatagatagacagggggacccaacaaccacatccctcctcagaagcccccagagcacaacgccccaccatggactgacctggagatccttnttttggngcagcagccacaggtgcccactacccaggtccagtcttgtgctaggtctggggctaggaggtgaagacgccgtcggggacctgaggtagtaacggtttccngacgtaggtcttaccgaaggtactaccctaccgttacctaagtaggtacgtgtaccgttaacgttacgttagttgggtccggaccggacccgaccgggaccccccggtaaacgaaaggttcccgtttagggaagggttcggaacggtggggtaagtacgggtagacccgttaaccggcggttaggacccgtagttaacggtaaactaaacgtaaaaatccgtaacgtagtaaccgtacggagtacgacgtacgtactaaccgtacgacgaacgtctacctacggacggtaactattaacgttgtaaggtacggtacgngtacgacgacgtacgtcgtacgagtaacgtacgagttacgcgttanagttacgttagtttcgcgtccgtattagngttgacgtcttagtctactntagtacgtgctcggtacgaccgtacggtaccctagcccgtacgtctccgtaccg

SEQ ID NO: 261455 - DNA, 796 bp, Homo sapiens
  misc_feature: GYAE6OF02HLYE3.1.5.A05.1.454.CMB.1.raw
  modified_base (273)..(273): a, c, t, g, unknown or other
  misc_feature (273)..(273): n is a, c, g, or t
  modified_base (311)..(311): a, c, t, g, unknown or other
  misc_feature (311)..(311): n is a, c, g, or t
tcagacgagtgcgtcacgaccggtgctcgatttagatagatagacagggggacccaacaaccacatccctcctcagaagccccagagcacaacgccccaccatggactggacctggaggatcctcttttggtggcagcagccacaggtcgcccactcccaggtccagtcttgtgcagtcgtggggctgaggtagaagaacgccgtggggcctcgagtgtaacggttttccgtcgacgaacggtcttcgaggactacctaccttcaactaggtntcgtctatacagttggtgcgtccgacggcccccggaanaaaggtcttaggtaggtcggtagtaggggtatagggtacgtaacgaacggtacgtacgggaacgtaaagttacgggtaaaacaaaacctaaaaaaacttacgaacgtaaacggtaacgttacccggaagggtacgtaacgaacgttacccgtaaacccgtttaaccgggaaaccgggtacctaactaccggtcccgtacgggaacggttactttaaacctttagtaacggtacgggtaacggtacgttacggaacggttccgacgtacccggttagaaccggtagtaacccggaaagtaacccgggtacgggtcttaacgggtttacttttaaggtttttcggtaccggaccgttaaccgttactagggttacgggtaagttcgtttaatttacgtacggtacttacgttaaggttcgtaccgttaccgggtacgggtccgtaaacgggtcccgtggtacccgtaaccgttccctcgtaacccgg

SEQ ID NO: 261456 - DNA, 794 bp, Homo sapiens
  misc_feature: GYAE6OF02IJVAF.1.5.A05.1.454.CMB.1.raw
  modified_base (134)..(134): a, c, t, g, unknown or other
  misc_feature (134)..(134): n is a, c, g, or t
  modified_base (237)..(237): a, c, t, g, unknown or other
  misc_feature (237)..(237): n is a, c, g, or t
  modified_base (330)..(330): a, c, t, g, unknown or other
  misc_feature (330)..(330): n is a, c, g, or t
tcagacgagtgcgtcacgaccggtgctcgatttagatagatagacagggggacccaacaaccacatcccctcctcagaacgccccagagcacaacgccccaccatggctggacctgaggatccttctttttggnggcaggcagccacaggtcgccccactcccgaggtccagcttgtgcgagttcgtggggtctggagtgaaggacgccgtggggcctcaggtggtaacgtttccgngcgacggtcttcaagatacctacctttactacgtagggtatctacgtattacctaggttcgggacgtccgccgacccggtacccccggtaaanaaacgggttcgttacggaggttacgggtaacggtggggaacgttagggtacgtacgaacggtcgtacggtaacgtaagggttaaaccggtaaacaaaaaacgttaaaaatccgtaaaactaacggtaacgttcggaaacggtacgacgtaacggttacccgttaacgttaaacccgggacgtaaccgtaacgtcgacccggggacgttaaacggttacttttaaagttacgtaagggttcgaacggagtcggaactacgcggtaactggaagtaaccgtaccgtaaaagcccgtaggttacttaggttcttttagggttcgtaccgtacgtccgttaaggttaggtacggttagttaacgttactttaagggttacccacttacggttcttaaccgttcccgggttaacggccggttccggaacgggttcccgtggttacccgtaccggtccgttacccgacgg

SEQ ID NO: 261457 - DNA, 971 bp, Homo sapiens
  misc_feature: GYAE6OF02H2P91.1.5.A05.1.454.CMB.1.raw
  modified_base (135)..(135): a, c, t, g, unknown or other
  misc_feature (135)..(135): n is a, c, g, or t
  modified_base (153)..(153): a, c, t, g, unknown or other
  misc_feature (153)..(153): n is a, c, g, or t
  modified_base (235)..(235): a, c, t, g, unknown or other
  misc_feature (235)..(235): n is a, c, g, or t
  modified_base (262)..(262): a, c, t, g, unknown or other
  misc_feature (262)..(262): n is a, c, g, or t
tcagacgagtgcgtcacgaccggtgctcgatttagatagatagacaggggacccaacaaccacatccctcctcagaacgcccccagagcacaacgccccaccatggactggacctggaggatccttctttttggnggcagcagccacaggtcncccactcccaggtccagtcttgtgcagtcgtggggctggaggtgaaggacgccgtggggcctcgagtggtaacggttttccngacgaggtcttcgaggataccaccttnacgttaggtatcgactatactagttgggtacgccgtaccacggggaccccccggaagaaaacgggtccgtttacggacgggttagggtagttagggggtacgtacgggtaagtaccggaaaccggtccgttcgggtacccgtaaagttacggggttaaaacctaaaacgtaaaaaaacgtttaccgaaaaccgtaaaggtaaaccggtttaccccggaagggggtacctaaacggtaccggtttaacccctaaacccgtttttaaacccggaacggggtaaacccgtaaacccgtaaaccggttcccggaaccgggttaacgggttaaaccttttacttttaaacgttaacgttacgggggtaacttccggttaaggtaccggtacgtaaccggtaccgtttaggaacggttaacgtaacccggtaaagggacccgtaccggggtacctttaggtttaacttttacggttttttacgggttaccggttacccgttaaccctttcggttaaccggggttacgggttaaacgggtttccgttaaacgtttttaaccgtttacgggttaccctttaaccgttttaacgggtttttacctacccgggttaaccgggtttacccgggggaacccggttacgggggttaacccccggttaccgggtttacccccggttaaacccccggtttccgtttacccccggttaaccccgg

SEQ ID NO: 261458 - DNA, 722 bp, Homo sapiens
  misc_feature: GYAE6OF02GAOAL.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagtcttgtgcagtcgtggggctgaggtgaagacgccgtggggcctcgagtgtaaggtttcctgacaaggcttacgaggactaccaccttcacgtaggtatgactatacgagttcgggtgccgcccgacggccccccggaagaaacggtcgttacggacgtggtaacgtgggtagtaggtactccgaacggcgtaggacgtaagtaacggtaaacaaactaaaaagttccaaacgtacgtaaacgttccgaacgggacagtacgtacgtaaccgttacgaaggtaaccacgtacctccggacgtaacggtactttaagttagtacgtggaacgcggtaggacgtacgacggtccgtagaaccggtaacgtaccgtaacgaccggtacggtacttagggttaacttttacggttgggtacctacccggtacctttagtaaccgggttggtaacgttaccgtagtttacgtaccgtacttacgtttaaccgttcgtacccgtcgggtaccgggtccgtaaccgggtaccttcggttacccacccgtttcgaccctacccgg

SEQ ID NO: 261459 - DNA, 1052 bp, Homo sapiens
  misc_feature: GYAE6OF02I643R.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtcgcccactcccgaggtccagtcttgtgcagtcgtggggctggaggtagaagacgccgtggggcctcgaggtcggtaacggtttcctggacgtaaggtccttacgaggtaacttaccgtacccttcgacgttaaggtacttcgaccttatacctagtttgggtgccgtcccgtaacgggacccccccggaacgaaaacgggtcgttacggtaacggttgggaacgttgggggtatcggggtaactaccggaaaccggtccggtacgggacgtaaacggttaacgggttaaaccctaaaaaccgttaaaaaacgtttacccaaacggtaaaaccggttaaaccggttttaacccgggaaacgggggtaccgtaaacgggttaaaccggttaccccgttaaaccccggttttaaccggaaacgggggtaaccctaacccgttaaaaccgggttcccccgggtaacccgggttaaaaccggggtttaaacctttttaaacccgttttaaacggtttaaaccgggttaagggttaacccgggttacccggtaaacgggtaccggtaccgggttaaaccggaccccggttaacgggtaacggttaaaccggttacccccgggtaaaaggggtaaccccgtaccgggttaaccgtttaacgggttaaccgttttttacggttttttaacgggttaacccgggttaccccggttaacccgtttacgggttaaaccgggttttaggggtaaaccggtttacgttaacgtttacggtttacccgtacgttttaaccgttaacggtttttacccggtaaccggtttacccggggtaccgggttacccggttaacccgggtaacccggtttcccggtacccggtaaccccggtttcccgtaccccgttaccccgg

SEQ ID NO: 261460 - DNA, 687 bp, Homo sapiens
  misc_feature: GYAE6OF02HNM03.1.5.A05.1.454.CMB.1.raw
  modified_base (568)..(568): a, c, t, g, unknown or other
  misc_feature (568)..(568): n is a, c, g, or t
  modified_base (597)..(597): a, c, t, g, unknown or other
  misc_feature (597)..(597): n is a, c, g, or t
tcagacgagtgcgtcacgaccggtgctcgatttagatagatagacaggggacccaacaaccacatccctcctcagaagcccccagagcacaacgccccaccatggactggacctgaggatcctcttttggtggcagcagccacaggtgcccactcccaggtccagcttgtgcagtctggggctgaggtgaagaagcctggggcctcaggtgaaggtttccctgccaaggtccttcgaggtataccaccttcgacctaggtatgctatacattaggtgcgtccacggacccccggacgaaacggcttgagtcgggatcggggatcgggatacgaacgccgtaggcctaagtacggtaacaactaaaaattcaacgagtaacggttccgaggacgtagagtccaacctttaccgacggtacaacctagtacccgacggtacggtaagtttaaccgttagttacgtagggtaaacgtcttaagggactacgacgtacccgtagggacgtaactaccggaacgaacgtccgtacgtgtactttaatttcggtctaccggtccttagttacgngggttacgtaacgttagttacgttaccgngttacccgttaattttcccgggaacttccggttaccggggaccggtaccgggtaacccgttcggtaccgacccgttcctacccgttaccg

SEQ ID NO: 261461 - DNA, 726 bp, Homo sapiens
  misc_feature: GYAE6OF02J059I.1.5.A05.1.454.CMB.1.raw
  modified_base (326)..(326): a, c, t, g, unknown or other
  misc_feature (326)..(326): n is a, c, g, or t
  modified_base (338)..(338): a, c, t, g, unknown or other
  misc_feature (338)..(338): n is a, c, g, or t
tcagacgagtgcgtcacgaccggtgctcgatttagatagatagacaggggacccaacaaccacatccctcctcagaagcccccagagcacaacgccccaccatggactggacctggaggatccttcttttggtggcagcagccacaggtgcccactcccgaggtccagcttgtgcagtctgggctgaggtgaagagccgtgggcctcgagtagtaacggtttccgtgacgaacggtcttcgaggtaatacctacccttcgacttaggttactgactatacgtagttgggtcgcgccgaccggacccccgtaagaacggtcttaggngaaggtagtggntagtacgtacgacgacgtcggactaggttaacggaacaaacgtaaaaactcaacgtaaggaaccgttcgaacggtacaagttacgtaccgttaacccgttacgaacggtaacctactacggtacccgacgtaagtactttaagttacgtaagtcggatcggagtacgctacgccgtagacggttaacgtaaccgggtaagaaccggttacgtgtttagtttaaacgttttcggtttaccggattaccggtaccgttccgttaagggtacggttaacggtacttaacgtttacggtactacgtttacggttactacggtcccgttacgggttacccgggaacgttacccggtaccgtccggttcccgtaccggtttccgccgttacccg

SEQ ID NO: 261462 - DNA, 896 bp, Homo sapiens
  misc_feature: GYAE6OF02FGOW8.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtcgtggggctgaggtgaagaacgcctagggggcctcgacgtagtaacgggtttcctggacaagggtcttaccgaggtactactaccttcacgttagggtactcgctaatacagtttcggggtcgcggacccgaccgggtacccccccggaagtaaacgggtcctttagggtaacggttcggggtaacgttaggggtaacgtacgggtacgttaccgaaccggtacgttacggggaccgtaaaggttacgggtaaaaaccaaactaaaaaaacgtttaccgaaaaccggttaaacggtaaaccggtttaccggaacgggggaaccgtaaccggtaacgttaccccgtaaacccgttttaaacccggaaacgggggtaaccctaaacccggtaaacggttaccccgggacgggtaaacgggttaacgtttaaacccgtttaagtaaacggtttagggaaacgtaccggttaggtaacggaaccgtaaccggtaccgttacgggaacgttaaccggtacccggttaaaggaccccggacggttacttaacgggtttactttaacggttttaggtccgtacccggtttaacgtacggtttacggtaagggtaccgttaacgtacttacgggttactaccgtacgttaacgtttcgaaccgtccggttacggggacggtaaccgggtacccgtaggtttacccgacccgttcgtacctaacccgg

SEQ ID NO: 261463 - DNA, 724 bp, Homo sapiens
  misc_feature: GYAE6OF02JPTUA.1.5.A05.1.454.CMB.1.raw
tcagacgagtgcgtcacgaccggtgctcgatttagatagatagacaggggacccaacaaccacagtccctcctcagaagcccccagagcacaacgcccaccatggactggacctggaggatcctcttttggtggcagcagccagaggtgccactcccaggtccagcttagtgcagtcgtgggctgaggtgaagagccgtggggcctcgacggtggaacgggtttcctcggacgaacggtcttacgaggaactaccgaccgttcgactagggtatgaccgttaataccgtaattcggggttcgacggaccgaccggtcccccggaagtaacgggtcgttacggacggtacggtacggtaaggcgtagggactaccgaacggtcgtacgggataggtacggtaaacaaaccggtaaaacttccgaataggtaccgttaccggaggtacgacgagttaccgaacctttacggacggtactaaccgacggtacccggagtaacggtacttaacgttaggttagtacgggacgtaccgtagaccgacgtacgaccgtagaaccgcgtaaccggaacgaccgtagggtctaggttaacttagttttcgcgttaccgcgttacggtacgtacggtcgtacctacgttataccgtacgtcgtaacgttagaccgttccggtacggtacccggtcggtaacccgtcgtaccgtacccgtcgttaccgacccgg

SEQ ID NO: 261464 - DNA, 793 bp, Homo sapiens
  misc_feature: GYAE6OF02I73CZ.1.5.A05.1.454.CMB.1.raw
  modified_base (234)..(234): a, c, t, g, unknown or other
  misc_feature (234)..(234): n is a, c, g, or t
tcagacgagtgcgtcacgaccggtgctcgatttagatagatagacagggacccaacaaccacatccctcctcagaacgcccccagagcacaacgccccaccatggactggacctggagatccttctttttggtggctagcagccactaggtcgccccaactcccgaggtcccagtccttgtgcagtcgtggggcttgaggtgaagagccgtgggccctgagtgtaagttttccngacaaggtcttacgaaggtactaccacctttaccgacttaggttatcgacttataacctagtttgggtcgccggaccgaccgggacccccgaaagtaacggtcgttaggaggttacggaggtggacgttggtactacgaaccgtgaggtacgtaagttacggtaaacaaactaaaatcaaacgtaagttaacgtaccgaggtacgtaagtacgtaccttaaccggttaaccgaggtactaacccgtagtaccggaacgtacggtaactttacgtttaaagtagagggtacgtgtaacgagtaccgacgttacgacgtaactcgaaccggtaagacccgacggtacttagtttacgttttacgttttacgaccggtactttaaccgttcgttacggttaacggttaggttttaacccgttacgttttaacgtacccggttacgtttaacgtttacccggtttaacgaccggttttacccgggtacgggtaaccccggtaacggttaacccccgggtttaggacccccggtttaaccccggtttcgtaccccttaccccgg

SEQ ID NO: 261465 - DNA, 770 bp, Homo sapiens
  misc_feature: GYAE6OF02JY3FM.1.5.A05.1.454.CMB.1.raw
  modified_base (224)..(224): a, c, t, g, unknown or other
  misc_feature (224)..(224): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcagccacaggtgcccactcccaggtccagcttgtgcagtctgggctgaggtgaagagccgtgggcctcgagtgtaacggtttccgngacgaacggtcttacgaggattaccgtaccttcaacgtaggtatcgtactaagtacgtagttgggtcgtccgaccgacggtaccccccggaagaacggtccgttaggtaaggtcggaacgtggggagttacgggtactaccggtaaccgtaccgtacgggaactaaaggtacggtaaaacctaaaacgtaaaaattaccgaacgtaaggtaaacgttacccggaagggtacctaaggtaacggttaccctaacccggttaaccgtaacgggtaacctaaccggtaccgttaccggacggtaaggttacgtttaacgttacgtaacggtaacggcggtacgttaggacgtacgacggtacctaggagtaccgtaaccgtaggaccgtacggtacttaggttagtttatttacggcttacgtacgtcgttaacggtggtaacgtactttagttacgtacgtacttaccgtagtttacgaccgttcggtcggtaacccgttaacggttacccggttagtacccggttacccgttccgtacctacccggg

SEQ ID NO: 261466 - DNA, 866 bp, Homo sapiens
  misc_feature: GYAE6OF02JWREZ.1.5.A05.1.454.CMB.1.raw
  modified_base (263)..(263): a, c, t, g, unknown or other
  misc_feature (263)..(263): n is a, c, g, or t
  modified_base (273)..(273): a, c, t, g, unknown or other
  misc_feature (273)..(273): n is a, c, g, or t
  modified_base (287)..(287): a, c, t, g, unknown or other
  misc_feature (287)..(287): n is a, c, g, or t
  modified_base (856)..(856): a, c, t, g, unknown or other
  misc_feature (856)..(856): n is a, c, g, or t
tcagacgagtgcgtcacgaccggtgctcgatttagatagatagacaggggacccaacaaccacatccctcctcagagccccagagcacaacgccccaccatggactggacctggaggatcctctttttggtggcagcagccacaggtcgccaactcccaggtccagcttgtgctagtctgggggactggaggtcgaagtacgccgtggggtacctcgagtggtaacggtttccctggacaaggtccttacacgggtctaaccncccgttttanaccgtaagggttcngtacctactagtacgttgggttacgccggtaccgacgggccccccgtaacgaacggtaccgtttgggacgttacgggacgttagggggacttacgggtacgtaccgaacgggtaccgtgggtaacctaacggtacgggttaaaccgaaaacctaaaaacgtttccgaaccgggtaaacgtaaccgggtttaccgaacgggggttcctaacgggtaaccgttaccgtaaccccgttttacggaaggggtaaccctaccgtaccgttacccggacgtttaaccggtagttttaaccgttaacgtacggttacgggtaacgttacggtacggtaacggtacaaccggtaccggttaggaaacgtacggtaaacggtacgtaaccggtccgtaaccggttaggttacttttacgggtttactacgggtaccttaaccgtaggggtttaacggttcgggaacgttcggtttaacgttacgttaccgtaacgttccggttaagttacccggttggtaaccgggttacccggtacggtacccggttacggttacccgttaccgtcccggtttaccnccgttacccg

SEQ ID NO: 261467 - DNA, 781 bp, Homo sapiens
  misc_feature: GYAE6OF02FM060.1.5.A05.1.454.CMB.1.raw
  modified_base (143)..(143): a, c, t, g, unknown or other
  misc_feature (143)..(143): n is a, c, g, or t
  modified_base (149)..(149): a, c, t, g, unknown or other
  misc_feature (149)..(149): n is a, c, g, or t
  modified_base (199)..(199): a, c, t, g, unknown or other
  misc_feature (199)..(199): n is a, c, g, or t
  modified_base (222)..(222): a, c, t, g, unknown or other
  misc_feature (222)..(222): n is a, c, g, or t
tcagacgagtgcgtcacgaccggtgctcgatttagatagatagacaggggacccaacaaccacatccctcctcagaagcccccagagcacaacgccccaccatggactggacctggaggatcctcttttggtgcagcagccanaggtcncccactcccaggtccagcttgtgcagtctggggctgaggtgaagagccgngggcctgagtagtaacgtttccngcaaggtcttcgaggtataccgtaccttacacgttaggtatgtactaatacgagtttcggtcgacgccgtaccggcccccggaagaaacggtcttaggagtggagtgggataggactacgaacgcgtaggcaacgtggtaaaacaactaaaaacttcaaacgtagtaacgttaccgaagggtacaaggtaacgtttacctaaccgtttaacggaacggtaaccgaacctacgtacccggaacggtaacggttaactttacgtttaacgtacgtaggtaagtccgtaggacgtacggtacgacgttaggaacgttaacggaccgtaaaggaccgaccgggttacgtttaggtttaacgtttttacggttttacgttaccggtaccgttaccggttaagtttaacggggtgggttaaccggtttaacttaagttttaccgtttaccgggtctttaacgttaaccgttttaggaccccgtttaccggggacccgggtaaccggtacccgggtttaacccggttccggttacccggttacgtccccggttacttacccccggg

SEQ ID NO: 261468 - DNA, 775 bp, Homo sapiens
  misc_feature: GYAE6OF02F23J2.1.5.A05.1.454.CMB.1.raw
  modified_base (308)..(308): a, c, t, g, unknown or other
  misc_feature (308)..(308): n is a, c, g, or t
tcagacgagtgcgtcacgaccggtgctcgatttagatagatagacaggggacccaacaaccacatccctcctcagaagcccccagagcacaacgccccaccatggactggacctggaggatcctctttttggtggcagcaagcccacaggtcgccccactcccaggtccagtcttggtgcagtcgtgggggctggaggtagaaagaacgtccgtaggggcctcgtaggtggtaacggttttcctggacaaggtccttcgaggtattaccaccttcacgttaggtatcgtactactactaggtttgggngtccggccgaccggtaccccccgggaacgtaaacgggtccgttagggtaggtcggaggttcgggggtagtggtaactacgacggcgttggtactaagtaggttaaaccaaacgtaaaaacttcaactaagtaacgttccgaaggcgtaaggtacttaccctaccgtttaccggacgggtaaccacgacgtaccgcggtaacgtactttacgttaagttacgttacgggtaacgtcgtaggacgtacgacgtacccgtggaacggttacgtaaccgggaactaccgaccggtgttacgttaacgttttagttggttacgtaccgtaccgttcgtaagggttacggtaggtttactacgtttagttaccgtaccgtttaccgtttaacttcggttacccgtcccgggttaggtaccccggtaacgggtacccgtttagggacccggtttccgtacccgttactccccgg

SEQ ID NO: 261469 - DNA, 732 bp, Homo sapiens
  misc_feature: GYAE6OF02IH55K.1.5.A05.1.454.CMB.1.raw
tcagacgagtgcgtcacgaccggtgctcgatttagatagatagacaggggacccaacaaccacatccctcctcagaagcccccagagcacaacgccccaccatggactggacctggaggatcctcttttggtggcagcagccacaggtgcccactcccaggtccagcttgtgcagtctgggctggaggtgaagaagcctggggcctcagtgaaggtttcctgcgaaggtcttcaggtactacctaccttcaaccgtaggtatgtactaactacgagtttagggtcgccggccgtaccgggccccccggaagaaacgggtacttaggtaggtgggacggttagggagttcgggaataccgaacggtacgtggtactaagtacggtaaactaaacaaaaaacttacaacaagtaacgtacgacggacgtagagtacgtaaccttaccgaggtaacctacgacgtccggacgtaggtaactttaaccgttagtaagtacggtacgtcgtaaggtaacgccaacggtccgtaggtaacgtacgtaccgaaacggtaaccgacggttgtacggttaattttagttttcggtactacccggttacgttaacgtacggttacggtaacggttcttaagttacgttacgtacttacgttaacgttccgttacgtcccgggtttaacggaccggtacggtacccggttcggtaccggttaaccgttcccgtactaccccgg

SEQ ID NO: 261470 - DNA, 824 bp, Homo sapiens
  misc_feature: GYAE6OF02J0JJG.1.5.A05.1.454.CMB.1.raw
tcagacgagtgcgtcacgaccggtgctcgatttagatagatagacaggggacccaacaaccacatccctccctcagaacgcccccagagcacaacgccccaccatggactggacctggaggatcctcttttggtggcagcagccacgaggtcgcccactcccaggtccagcttgtgcagttcgtggggctggaggttgaagtagccgtcgggcctcgtacgtggtaacggtttcctgcgaaggtccttacgaggatactaccttcacgtaggtctagtactaagtcgtagttacgggtcgccgtccgaccgggtccccgaacgaaacggttcgttacggagtacggaggtcgggtacgtaggtactacgtacgtacgtacggaacgtaccgtaaggttaaaccaaacgtaaaaagtttccgaacgtaacggtaaccggtttaccggaagggtacgaacggtacttacccgtaaccgtttaaccggacgaaccgtaacgtacgtacccgacggtaaggttaaccgttaacgttacgtaacggtacggtaacgtacgtaacggtaacggtaccgtaaggtaccggttacggaacgttaccggtaaccggaacgtaaccggacgttaccgtttaagtttaccgtttacggttttacggtacggtaaccttaaccgttacggtttacgggtacgggtaaacgttacgtttaaccgttaacgttaccgttaacgtttaccgttaacggttaccggtaaccttccggggtaccggtaccggaaccggttaccgtaccggttacccgttacccgtccgttaccttacccgg

SEQ ID NO: 261471 - DNA, 994 bp, Homo sapiens
  misc_feature: GYAE6OF02IZGY7.1.5.A05.1.454.CMB.1.raw
  modified_base (371)..(371): a, c, t, g, unknown or other
  misc_feature (371)..(371): n is a, c, g, or t
tcagacgagtgcgtcacgaccggtgctcgatttagatagatagacaggggacccgaacaaccacatccctcctcagaagcccccagagcacaacgccccaccatggactggacctggaggatcctcttttggtggcagcagccacaggtcgcccgtactcccaggtcccagtcttgtgcagttcgtggggcttgaggtgaagagtccgtggggcctcgaggtgtaacggtttccagaccgaaggtcttacgaggtactaacctcccgttacacgttacggtatacgccttaatactagtttcgggtcgccgtacccgaccggacccccggtaacgtaaggtcctttggaacggttcgggtaggtacggggngtcgggactaccggaacggtcggtacggactaacggttacggtaaacctaaacggtaaaaacttcgaaaccgtaaggttaaccgtaccggaagaccgtaggtaacgttacccgttaaaccgttaccggaacggttaaccaccgttacggtacccggtaacggtaacgttacggtttaaaccgtttaaggtaacggtttacggggtacgtttacgttaacggtaccggttaaccgtacccggttaacggtacgtaacccggttaaacggtaccccggttaaacggacccgtaccgggttacggtttaaccgtttttaggttttaccggttttttaacggtacccggggtaacccgtttaacccggttttacgggttaacgggggttaaccgggttaaaccggtttttaacccggttaagttttttaaccccgggtaacccgttttacccgtttaaagggtttttaaccccgttttagggtaacccccggtttttaacccggggggttaacccggggtaaccccggttttaaaaccccggggtacccccggggttttttaaaccggacccccgggttttaaacccccggggttttaccccgttaacccccgggtttaacccccgg

SEQ ID NO: 261472 - DNA, 881 bp, Homo sapiens
  misc_feature: GYAE6OF02FIYMT.1.5.A05.1.454.CMB.1.raw
  modified_base (148)..(148): a, c, t, g, unknown or other
  misc_feature (148)..(148): n is a, c, g, or t
tcagacgagtgcgtcacgaccggtgctcgatttagatagatagacagggggacccaacaaccacatccctcctcagaacgcccccagagcacaaccgccccaccatggactggacctggagatccttcttttggtggcagcagcccanaggtcgcccactacccaggtccagtcttgtgctagtccgtggggtctggaggtagaacgtacgtccggtacggggtcctcgaggttggtaacgggttttccctaggaccgtaaggtcctttacggaacggtacttaacctaccgtttacaaccgttaggttatcgtacttaacgtacgtaggtttagggtcgccgtacccggtaaccggggcccccccgtaaagtaaacgggtccgtttagggacggagggtacggtaggggtcgtacgggttactaaccggtaccgaggttacggacgttaaggtaccgtaaaacgtaaactaaaacggttcgaaacgtacggtaaccgttacggaggacgtacgtacgtaccgttaacccttaacggacgggaacccttacgtaccggtacccggtaacgtaacgttactttaacgttacggtacgttacgggtacggtacgtacggtacgtaccggttaccggtacgttagggtaacggtccgtaacccggaaacgtacccgggtaccgtccgtttaagtttacggttttaacgtttcggttacggtaacccttagttaccgggttaggttccggtacgtttacgtttaaccgtttacgttaccgttacgtttaccgtaagttttccggaacccggtttccgggttaccgggaaccggttcccgggttacccgttacggtaaccctcccgtttaccgtacccttacccgg

SEQ ID NO: 261473 - DNA, 819 bp, Homo sapiens
  misc_feature: GYAE6OF02HDO1X.1.5.A05.1.454.CMB.1.raw
  modified_base (133)..(133): a, c, t, g, unknown or other
  misc_feature (133)..(133): n is a, c, g, or t
  modified_base (181)..(181): a, c, t, g, unknown or other
  misc_feature (181)..(181): n is a, c, g, or t
  modified_base (226)..(226): a, c, t, g, unknown or other
  misc_feature (226)..(226): n is a, c, g, or t
tcagacgagtgcgtcacgaccggtgctcgatttagatagatagacaggggacccaacaaccacatccctcctcagaacgcccccagagcacaacgccccaccatggactggacctggagatccttcttttggnggcagcagccacaggtgcccactcccaggtcccagcttgtgcagtcgnggggctggaggtgaagagccgtgggcctcgagtgtaaggtttccngaccaaggtccttagaggtactaccaccttcaacgtaggtatcgtactaattacgtaagttggggttcgccgtacccgaccgggaccccccggtaagaaacgggtccgttaggaggtacgggtaaggtaggggagtaggtaacgttaccgaaccggtacgtacggacgtaaggtacgggtaaaccaaacgttaaaaaattaccaagaacggtaacgtttaccggaaggggtactaaggtacgtaacccgttaaccgttttaaccggaacggggttaaccaacccgtacgtacccggtacgggtaacggttaacgtttaacgtttaacttaggttaagggtaaacggtccgttaaggaaccggtacgtaaaccggtccgttacggaacggttaacccgacccggtaaacggtacccggtaaccggttacgtaccgtttaaagttttacggttttcggtacgtaccgtacccgtttaggacggttaggtacttacgttaagtttaccgtcgtaccttacgttagttaccgtacgtccggttacgggaccttaaccggggacccttggaacccgtccggttcgtacccgtacccgg

SEQ ID NO: 261474 - DNA, 516 bp, Homo sapiens
  misc_feature: GYAE6OF01DWVKX.43.42.D09.1.454.CMB.1.raw
  modified_base (203)..(203): a, c, t, g, unknown or other
  misc_feature (203)..(203): n is a, c, g, or t
  modified_base (247)..(247): a, c, t, g, unknown or other
  misc_feature (247)..(247): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtgagacagttactgttaattntttggcctggtaccagcagaagcctggccaggctcccaggctcctcatctctgctgcatcctacagggccagtggcatcccagacaggttcagtggcaggtgggtctgggacagacttcactctctccatcagcagactggagccgtagaagtattttgacttaatttattactgtacactagtatggtagctactaacttcttaactttcgggcggacgggacaaggtggagtagtacgaaagacgtgtggctcgcacatctgtcttc

SEQ ID NO: 261475 - DNA, 578 bp, Homo sapiens
  misc_feature: GYAE6OF01DKQ6D.43.42.D09.1.454.CMB.1.raw
  modified_base (202)..(202): a, c, t, g, unknown or other
  misc_feature (202)..(202): n is a, c, g, or t
  modified_base (445)..(445): a, c, t, g, unknown or other
  misc_feature (445)..(445): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgctccaggggaaangccaccctctcctgcagggccagtgagacagttactgttaattattggcctggtaccagcagaagcctggccaggctccaggctcctcatctctgctgcatcctacgagggccactggcactcccagacaggttcaggtggcaggtgggtctgggacagacttcactctctccatcagcagacgtgggacgtcctaggaagtattttgacttaaattttattactgtacactagttatggtanctactaacttcttaacgtttcgggacggtaacgggtaaccgtaagggtacgggtaagtaacgttaaccgaaaacggtaacgttgggttacggtcctacggtacctaaccctagttccgttgttccgtttaccg

SEQ ID NO: 261476 - DNA, 508 bp, Homo sapiens
  misc_feature: GYAE6OF01AHV80.43.42.D09.1.454.CMB.1.raw
  modified_base (203)..(203): a, c, t, g, unknown or other
  misc_feature (203)..(203): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtgagacagttactgttaattattggcctggtaccagcagaagcctggccaggctcccaggctcctcatctctgctgcatcctacagggccactggcatcccagacaggttcagtggcaggtgggtctgggacagacttcactctctcatcagcagactggacgcctgaagtattttgactaatttattactgtcactagtatggtagtctactaacttctaactttcggacggaggaccaggtggagagtacgaacgactgtacggctgcacatctgtctac

SEQ ID NO: 261477 - DNA, 516 bp, Homo sapiens
  misc_feature: GYAE6OF01D4UWT.43.42.D09.1.454.CMB.1.raw
  modified_base (202)..(202): a, c, t, g, unknown or other
  misc_feature (202)..(202): n is a, c, g, or t
  modified_base (495)..(495): a, c, t, g, unknown or other
  misc_feature (495)..(495): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgctccaggggaaangccaccctctcctgcagggccagtgagacagttactgttaattatttggcctggtaccagcagaagcctggccaggctccaggctcctcatctctgctgcatcctacagggccacgtggcatccccagacaggttcagtgcagtggtctgggacaggacttcactctctccatcagcagactggacgcctagaagtatttgactaatttacttatgtctacagtattggtagctctaacttcttaacttcgggcggaagggaccgaaggtggaagagtacgaaacgaactggnggctgcaccattcctgtcttc

SEQ ID NO: 261478 - DNA, 887 bp, Homo sapiens
  misc_feature: GYAE6OF01BRVZO.43.42.D09.1.454.CMB.1.raw
  modified_base (210)..(210): a, c, t, g, unknown or other
  misc_feature (210)..(210): n is a, c, g, or t
  modified_base (219)..(219): a, c, t, g, unknown or other
  misc_feature (219)..(219): n is a, c, g, or t
tcagtgtgagtagtcacgaccggtgctcgatttagacacatacgcgagggaaagggagaagagctgcctcacgttaggaccctagagggaacctatggaaaccccagcgcagcttctcttacctcctgctactctggctcccgagtataccaccggagaaattgttcgttgacgctagtctacgaggcacctgtcttgtctcgagggaangccaccgtntcgtgctagggccaaggtcgagacgtacgttactaggttaattacgttcggccgttagggtaccaggtcctaacggtaacgtcccgttccggacctaacggggtccctacccgtaggtaccttcccgttacggaacttccgtaccgtcggccttaggacctacgtacccggtaacggacgggtcctaacgttcgggtacctacgtacccgaaggtaccgtagggttacctagggttacgtacgtacgggttgggtaccgtacgggaactacgggtaccttaccgaacgttccgtacctacgtaagtccgtaacgtaccgtaacgtaccgtacgggtaaacgtaccgttacggtaaacgtttacgttttacggaacctttaaaggttttaaccgttaaccgttaccggtaaccttaaaccggttaacggtttaacgtaccgggttaaccgtcccgttaaaccggttaaaccgtttaccggtttaaacccgggtttcggggtaacccggttaaacggggttacccgtaaaggggttaaccggtaacggttaaaccggttaacccggttaaaaaccgggtacggtttcgggttaaccgggtaccgtttaaccgggttaccctaaaccccggtttaaggttcccgtttaacggggtccccttttaaacccgg

SEQ ID NO: 261479 - DNA, 520 bp, Homo sapiens
  misc_feature: GYAE6OF01BHC65.43.42.D09.1.454.CMB.1.raw
  modified_base (445)..(445): a, c, t, g, unknown or other
  misc_feature (445)..(445): n is a, c, g, or t
  modified_base (504)..(504): a, c, t, g, unknown or other
  misc_feature (504)..(504): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcactccccagaccaggttcaggtggcaggtgggtctgggacagacttcactctctccatcagcagactggacgccgtagtaagtattttgacttaatttattactgtctactagtatggtanctactaactcttaacgttcggacggtaggaccgaaggtgagatacgaagtacgtgtagntcgcacatctgtctac

SEQ ID NO: 261480 - DNA, 535 bp, Homo sapiens
  misc_feature: GYAE6OF01B2QC8.43.42.D09.1.454.CMB.1.raw
  modified_base (202)..(202): a, c, t, g, unknown or other
  misc_feature (202)..(202): n is a, c, g, or t
  modified_base (443)..(443): a, c, t, g, unknown or other
  misc_feature (443)..(443): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtcttgtctccaggggaaangccacctctcctgcagggccagtgagacagttactgttaattattggcctggtaccagcagaagctggccaggctccaggctcctcatctctgctgcactcctacgagggccacgtggcactcccaagtaccaggttcaggtcggcaggttcgggtctgggacagtaccttcgactctctccatcagcagctggacgctaggaactatttgactaatttatactgtcactagtatggtacncttacaactcttaacgttcggacggaaggaccgtaggtcggaagtacgtacgaaacgtacgtggtacgactacgacactatcgtgtcttacg

SEQ ID NO: 261481 - DNA, 730 bp, Homo sapiens
  misc_feature: GYAE6OF01DNGGL.43.42.D09.1.454.CMB.1.raw
  modified_base (205)..(205): a, c, t, g, unknown or other
  misc_feature (205)..(205): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagactaccaccggagaaattgtgttgacgcagtctccaggcaccctgtctttgtctccgaggggaaancgcccaccctctcctgcagggccagtgagactagtttactgtttaattagttcggccttggtaccagcaagaacgcctggccaggcctcccgaggtcctcctcattctctgctgctactccctacgcggccctagtcggacctacgtcccaaggtacctagggttcaaggggttcggacgtagggttggggtccgtagggggaacctaacggttaccctttaccgaacctttcccgtacctacccgtaagttacccgacggtaccgtaaccgggtaaccgtcggggaacccgtacccggttaaggtaaacggtttacgtttttacggaacttttaaagttttacgtttaacctttacggttaccttaacgttaagttagtttacgggtaactccgttaaccttaacgtttacccgtttaaacggtttccggggacgggtaacgggtaaccgtaagggtacggtaacgtaacgtaaccgtaaagtacgtggtacgtcgtacgtacctacgtattcctgttcttacc

SEQ ID NO: 261482 - DNA, 516 bp, Homo sapiens
  misc_feature: GYAE6OF01A87E9.43.42.D09.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (393)..(393): a, c, t, g, unknown or other
  misc_feature (393)..(393): n is a, c, g, or t
  modified_base (440)..(440): a, c, t, g, unknown or other
  misc_feature (440)..(440): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgctccaggggaaangccaccctntcctgcagggccagtgagacagttactgttaattattggcctggtaccagcagaagcctggccaggctcccaggctcctcatctctgctgcactcctacagggccactggcactcccagacaggttcagtggcaggtgggtctgggacagtacttcactctctccatcagcagacgtggacnccgtagaagtatttgacttaatttattactgtctactagtatggtanctactacttcttaacgttcggacggacggacgtaggtgagtagtacaagacgtgtcggctgcactatctgtcttac

SEQ ID NO: 261483 - DNA, 585 bp, Homo sapiens
  misc_feature: GYAE6OF01EO5ZZ.43.42.D09.1.454.CMB.1.raw
  modified_base (200)..(200): a, c, t, g, unknown or other
  misc_feature (200)..(200): n is a, c, g, or t
  modified_base (244)..(244): a, c, t, g, unknown or other
  misc_feature (244)..(244): n is a, c, g, or t
  modified_base (426)..(426): a, c, t, g, unknown or other
  misc_feature (426)..(426): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtcttgctccaggggaancgccacctctcctgcagggccagtgagacagttactgttaattnttggcctggtaccagcagaacgcctggaccaggcctcccgaggtcctcctacacttcctctcggctgacctacttccctaacgcggggccctacgtcggaccacgtccccagactaggttcaggtcggcgtaggtgggtctcgggacagtacctcactctctacatcgagcgagcgtggacncgtagagtattgacttaatttactactgtactactagtagtgtactctactacgttacttacggttcggacggtaacggacgtaagggtacggaagtacgtaaccgaaacggtacgttggtacgcgtacgacctaacgtacgttcgttgttccttaccg

SEQ ID NO: 261484 - DNA, 629 bp, Homo sapiens
  misc_feature: GYAE6OF01B0HJ4.43.42.D09.1.454.CMB.1.raw
  modified_base (204)..(204): a, c, t, g, unknown or other
  misc_feature (204)..(204): n is a, c, g, or t
  modified_base (623)..(623): a, c, t, g, unknown or other
  misc_feature (623)..(623): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgtctccgaggggaaanacgccaccctctcctgcagggccagtgagacagttactgttaattattggcctggtaccagcagaagcctggccaggctcccgaggctcctcatctctgctgcatccgtacagggccacgtggcacgtccccagtacgtacggttcaggtggcgtaggttcgggtcgtgggaactacgtaccttcgactcctcctaccactcgagaccgaacgtacgtgggaacgtccgtaggtaacgtttacgttttacgaacgtttaattttaactttaccgttacttaccgtaccgtaagttacgtcggtaactccgttaactaaccttacgttaaccgttcgggacggtaacggaacgtaagggtcggtaagtacgtaacgaaacgtacggtgtacggtacacggtaccacgtacttcttcgttnttaccg

SEQ ID NO: 261485 - DNA, 647 bp, Homo sapiens
  misc_feature: GYAE6OF01EUHDT.43.42.D09.1.454.CMB.1.raw
  modified_base (203)..(203): a, c, t, g, unknown or other
  misc_feature (203)..(203): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgctccgaggggaaangcccaccctctcctgcgagggccagtgagactagttactagttaattagttcggccttaggtaccagacagaacgccgtggccaggcctacccgaggctcctcagtcctctgctgctactccgtacgcgggacctacgtggacactacccagaccgtaggtcaggttggctaggtggggtactacggggacagtacctcaacttctctaccgatcacgtacagtacgtggacgtcctagaagttactttagacttaaatttacttacgtagtacctaactaaggttagtaggttaacgccttactaaaccgtttcgttaaaccgtttcggggaacgggtaacgggaacccggtaaaggggttacggaaaggttacgtaaaccgtaaaacggtaacgtcggtacggtcgttacgaacctacgtaacttcgttcgtctttaacccg

SEQ ID NO: 261486 - DNA, 663 bp, Homo sapiens
  misc_feature: GYAE6OF01CB067.43.42.D09.1.454.CMB.1.raw
  modified_base (205)..(205): a, c, t, g, unknown or other
  misc_feature (205)..(205): n is a, c, g, or t
  modified_base (299)..(299): a, c, t, g, unknown or other
  misc_feature (299)..(299): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagactaccaccggagaaattgtgttgacgcagtctccaggccaccctgtctttgctccgaggggaaancgccacctctcctgcagggccagtgagactagttactgttaattgttcggactggtaccagcaagacgcctggccaggcctaccgaggctcctnatcctgtcgctgctacttccaagcgggcctacgtggcctatccccgaagacgtaggttcaggtcggctagggtcggtctagggactacggtaccttcgacttcgtactaccatcgaacgtccaaggtacgtcggacgtaccgtaggtaaacgtttagttttacggaccttaaagttttaaccgttacgttacggtacctaaccgttaaggtttacgtagggttaaccgttaccgttaccgtaaaccgtttaccgttaaaccggtttccgggaacgggtaacgggtaaccgtaaggtacggaacgtaactaaccgaaacgtacgtcgacggtactacggtactaccgtattctcggttcttaccg

SEQ ID NO: 261487 - DNA, 657 bp, Homo sapiens
  misc_feature: GYAE6OF01CSKCD.43.42.D09.1.454.CMB.1.raw
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
  modified_base (494)..(494): a, c, t, g, unknown or other
  misc_feature (494)..(494): n is a, c, g, or t
  modified_base (590)..(590): a, c, t, g, unknown or other
  misc_feature (590)..(590): n is a, c, g, or t
tcagtgtgagtagtcacgaccggtgctcgatttagacacatacgcagggaaaggggagaagagctgctcagttaggacccagagggaaccatggaaccccagcgcagcttctattcctcctgctactctggctcccagataccaccggagaaattgtgttgacgcagtctccaggccaccctgtctttgctccgaggggaaancgacccaccctcncctgcacggccagtgagacagttactagttaattatttcggcctggtaccagacagaacgccgtaggcccaggccctcccgaggcctccctcattcctctgacctgtaccacttcccgtaaccggcggcccaacgttcggacctacccgtcccaaaggcgtaggttccaggtcgggtcagggttcggtccgtagggggaactacgttacccgttcaaccgttccttacccacgtagtaccgacggtacaggtaccgtagggaccctcgtaagaagttntttacgacttaattttactacttagtacccaagttgacgttgtacgtcctaacgtcttaccgtttaacgttacgggacgtaacggaccgtaaaggnggaatacgtaccggaaatcgttcggtccggacgtcgtaccctaacgttactacgttcgttcctaccg

SEQ ID NO: 261488 - DNA, 720 bp, Homo sapiens
  misc_feature: GYAE6OF01CE35U.43.42.D09.1.454.CMB.1.raw
  modified_base (204)..(204): a, c, t, g, unknown or other
  misc_feature (204)..(204): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggcctcccagactaccaccggagaaattgtgttgacgcagtctccaggccaccctgtctttgctccgagggaancgccacctctctgcagggccagtgagactagttactagttaatttagttcggacctaggtaccagtacaaggtaacgccgtaggccgaacgggtcctacccgaggtccctcctacattcccgtacgttcgccttcgacctaacgtcccgtaacggtaccgggacccctacggtcggacctaaccgtccgaacgtaaccgttacggttcgaacgggttcgggacgtagggttacgggtcggtacggggaactaacggtaccttaccgtacgttccttaccgacctagtacgacgacgtacgacgtacggacgttacgtaacggtaagttacgtttacgtaactttaaacgtttactttacgttacgtaaccgtacgtaagttacgttaggtacctacgttaacctaaccgttacgttaacggttccggaacggtacggtaaccgtaggtacggtaacgaacgtacgaaacggtcggtagtaccgagtaccgtacgaacttgtccttgtccgttaccg

SEQ ID NO: 261489 - DNA, 768 bp, Homo sapiens
  misc_feature: GYAE6OF01EW7KV.43.42.D09.1.454.CMB.1.raw
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgctccgaggggaagcgcccaccctctcctgcgagggccagtgagactagttactgttaattagttcggccttaggtaccagcaagaacgcctgggaccagggtcctcccgagccttcctcactctctgctgcctactcccgacgacgggcctacgtcggacctaccgtcccgaagtaccgtacggggttacacgggttcggcgtagggttcggggtccgtaggggacctaaggttaccctttacctaccgtccgttcctacccgagttccgaacgtaccgtaggtacgttacgggaaccgtaccgtaaggtaacggtttacgttttacgtaccttttaaattttacgttaccgttacgttaccgtaaccgtaggttacgttacggtaacgttcccttaaccgttaaccgttaccgtttaaccgggtttaccggggaaccgggttaacggggtaaaccggtaaggggttaacggtaagggtaaaccggtaaacggtaaaaccgggttaacggttcgggttaccggttacgaccggtacccgtaacccttacgtttacccggtttacgttaccgtttacccg

SEQ ID NO: 261490 - DNA, 585 bp, Homo sapiens
  misc_feature: GYAE6OF01AK5HO.43.42.D09.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (248)..(248): a, c, t, g, unknown or other
  misc_feature (248)..(248): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggccaccctgtctttgctccgaggggaaangccaccctntcctgcagggccagtgagacagttactgttaattnttggcctggtaccagcagacgcctggccaggcctccgaggctcctcatctctgctgctatcctacgcgggcccacgtggctactccaggacaggttcaggtcgcaggttcggtctgggacacgtacttcgactctcgtcatcagcagacgtggactcgtagtaagttagtttcgacttaagttacttactagtaccgactagttacgtgtaacgtcgtactaacgttacgttaacgttacgggacggtaacgggtaccgtagggtacggaacgtacgtaacgtaaacggtacgtcggtacggcttacgaccgtaactacgttcgttcgttcttaccg

SEQ ID NO: 261491 - DNA, 645 bp, Homo sapiens
  misc_feature: GYAE6OF01AR0H6.43.42.D09.1.454.CMB.1.raw
  modified_base (202)..(202): a, c, t, g, unknown or other
  misc_feature (202)..(202): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtcttgtctccaggggaagngccaccctctcctgcagggccagtgagacagttactgttaattatttggcctggtaccagcagagcctggccaggcctccaggctcctcntcnctgctgccatccctagacgggcccaagtcggcactccccgagacgtacggtttccaggttcgggccaggttcgggtctggggaccaggtaccttccaccgttctccgtccattccagcctagaaccgtgggacgccttaggaacgttattttacggacttaaagttttacttaaccgtttaggtacccgtaaccgtaaggttaagttacgggttaacgtacccttactaaacccgtttacgttaaacccgttttccgggacgggtaaccgggaccgtaaaggggttcgaaggtacgtaccgaaacggtaatcgggtagtccgtagacctaccgacttcgtcgttcttacg

SEQ ID NO: 261492 - DNA, 761 bp, Homo sapiens
  misc_feature: GYAE6OF01BM4V9.43.42.D09.1.454.CMB.1.raw
tcagtgtgagtagtcacgaccggtgctcgatttagacacatacgcagggaaaggggagaagagctgctcagttaggacccagagggaaccatggaaacccagcgcagcttctcttcctcctgctactctggctcccagactaccaccggagtaaattgtgttgacgcacgtctccgaggccacccttgttctttgtccgtccggaaggggtaaacgcgccctaccctcctcctgacgaggccagtcgagtactagttacttagtttaattacgttcggaccttaggtaaccagtacgaagacggtccgtacgggacccacgggtccctaccgaccggtccttcccgtctaccttccgtcgtcgtcctctacctacgtacccggtaccggccggtaccctcgttacggacctaccgtaccgaacggtacgtacggttcgacgggtcgtacgtaggggttcggtacggacgggtactacgtcttaccacttccgtctactaatcgacgtacgacgtcgtcgtacgtaccgtaagtaacgtttacgtttacacttttaaagtttacttaccgtagtaccgtaacgttaggtttacgtacggttacttaaccgtaccttaacgtttacccggtttaacggttacggggacccgggttaaacggtaacgttacggggaattaaaccggagtaaacccggttaactagggtcggtttacgacgtaacccggttaccacttacgttccgtttccggttaccttacccg

SEQ ID NO: 261493 - DNA, 709 bp, Homo sapiens
  misc_feature: GYAE6OF01D9U8R.43.42.D09.1.454.CMB.1.raw
  modified_base (205)..(205): a, c, t, g, unknown or other
  misc_feature (205)..(205): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggccaccctgtctttgtctccgaaggggaangccaccctctcctgcagggccaggtgagacagttactgtttaattagtttggccttggtaccagcagaacgcctggccaggcctcccgaggccttcctcattctctgcctggccacttccctaacgacgggccctacgtcgggaccatccccgaagtaccgtaagggttccaagggttggacgtaggttcggggtctaggggaacacgtaccttcaccgttcttacctcccgtaataccgtacgaccgtaggtaccgtgggaccgtcgtagtaaagtttacttttaggaacctttaagttttctacgttcggtacctaacgtagttagtggttaccgaccttacgttaaccgtttaccgtaacggtttccgggaacgggtaccgggaaacccgtagggttaagggaacttaacggtaacccgtaaacgggttaaccggtttggtaccggtaccgttacgacccttaacccgtagttttaccccgttagttacccgtttaaaccg

SEQ ID NO: 261494 - DNA, 664 bp, Homo sapiens
  misc_feature: GYAE6OF01D1I3M.43.42.D09.1.454.CMB.1.raw
  modified_base (219)..(219): a, c, t, g, unknown or other
  misc_feature (219)..(219): n is a, c, g, or t
  modified_base (338)..(338): a, c, t, g, unknown or other
  misc_feature (338)..(338): n is a, c, g, or t
  modified_base (633)..(633): a, c, t, g, unknown or other
  misc_feature (633)..(633): n is a, c, g, or t
  modified_base (645)..(645): a, c, t, g, unknown or other
  misc_feature (645)..(645): n is a, c, g, or t
  modified_base (654)..(654): a, c, t, g, unknown or other
  misc_feature (654)..(654): n is a, c, g, or t
tcagtgtgagtagtcacgaccggtgctcgatttagacacatacgcagggaaaggggagaagagctgctcagttaggacccagaggaaccagtacggaaaccccagcgcagcttctccttcctcctgctctctggctcccagataccaccggagtaaattgtgttgacgcagtcctaccaggacctaccctgttcctttgtccgtaccgaaggggaaacncaccctaccctctcctgccgacgggtaccaggtagaagtacctagtttacttaggttaattagtttcggccttacggaccagtcaagaagccgtaggccacggtccaccaggtcctacnctacgtcctcgtcgctagtaccacttacccgagtacgggacctacgtcgacaccgtacccgagtacgtacggttcgacgtcggtacgtggtcggtacgtaggactaacgtccttacgtactaccgttacctacttacacgaagaccgtagtaccgtacggatccgtaagtaattaccgtttgtaactttaactttatacgtactcgaactatacgtgacctctaacttactagttaccgttacggaggtaacgtacgtaagggctaaaggtactaacgaacggtagtagttacgnaacgtccctaanacgttactntacccttacg

SEQ ID NO: 261495 - DNA, 846 bp, Homo sapiens
  misc_feature: GYAE6OF01A26QF.43.42.D09.1.454.CMB.1.raw
  modified_base (109)..(109): a, c, t, g, unknown or other
  misc_feature (109)..(109): n is a, c, g, or t
  modified_base (224)..(224): a, c, t, g, unknown or other
  misc_feature (224)..(224): n is a, c, g, or t
tcagtgtgagtagtcacgaccggtgctcgatttagacacatacgcaggggaaaggggagaagagctgctcaggttaggacccaggagggaaccatcggaaaccccagcncagcttctcttcctcctgctactctggctcccagactaccaccggagaattgtgttacgacgcagtctccaggcctacctgttcttcgtctacgagggaactcgccctaccttcnccgtgaccgtacgggacccaggttacgaacgtacgttacgtttaacttagttttaaacgttttcgttccggttaccgttacgggtaacctaggtaccggtaacgaaccggtcccggttccgggaacccgttacgggcctaacccgtcggtaccttccctacgttctccttccgtgtacctcgaccttccgttaccgacggacgggacccttaggtccgacctcctaccggtagtaccgtacggtacggacggtgggacgttcggtgggtcgtaaccggggtactaccggtactttccgacttccgtacgtaccgtctacgagtacgtagtaccggtaggaccttacggtagtaaccgttagttttaacgaacgtttttaattaccgtttaagcccgtttaaaccttaacggttacgtttaacggttacggttaccgttacgtttaaacccgtaacctttttaaccgggtacccggtttacccgggaaccgggggttaccgtaaacgggttaacgggtaccggtaaacgttaacccggttaaacgtaacgggtaaccggttacgggtaccggttaccgtaactaacccggttacttaccgtttaccgttcggttccttacccg

SEQ ID NO: 261496 - DNA, 765 bp, Homo sapiens
  misc_feature: GYAE6OF01DLKS6.43.42.D09.1.454.CMB.1.raw
  modified_base (201)..(201): a, c, t, g, unknown or other
  misc_feature (201)..(201): n is a, c, g, or t
  modified_base (299)..(299): a, c, t, g, unknown or other
  misc_feature (299)..(299): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagtactaccacggagaaattgtgttgacgcagtctccaggcacctgtcttgctcgaagggaacncgccacctctcctgcagggccagtgaacgactagttactagttaattagtttcggcctaggacagtcaggaacgcctggccaggctaccgaggcctcncactctactgctgcctactaccgtacgacgggtcccacgtggcctacgtaccccgagacgtacggttcgaacgggtcggtacacgggttcgggtaaccgtacgggggaacctaacgggttacccgtttactaaacccggtttccttacccgttaccccgtaacgttaccgaaacggtacccgtaacggtaccggttaacggggaccgtaacccggtttaagggtaaaacgttttacgtttttaaccgggaactttaaaccggttttttaacgtacccggttacgtttacccgaacgtttacgttaacgttagggtacctacccgtttaacgtaaccgtttaccggttaaccggtttccgggacgggttaacgggtaaccgtaggggtacggtaggtaacctaaccgtaaacgttacggtagtaccggacgtacgtaccaacgttagtccgttgttcccttaacccg

SEQ ID NO: 261497 - DNA, 497 bp, Homo sapiens
  misc_feature: GYAE6OF02F49P3.43.42.D09.1.454.CMB.1.raw
  modified_base (203)..(203): a, c, t, g, unknown or other
  misc_feature (203)..(203): n is a, c, g, or t
  modified_base (428)..(428): a, c, t, g, unknown or other
  misc_feature (428)..(428): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacctctcctgcagggccagtgagacagttactgttaattattggcctggtaccagcagaagcctggccaggctcccaggctcctcatctctgctgcatcctacagggccactggcatcccagacaggttcagtgcagtggtctgggacagacttcactctctccatcagcagactggagcctgaagtattttgactaatttattactgtcacagtatggtanctcaacttctaactttcggcggtagggaccaggtgagagtacaacgactgtgctgcaccatctgtcttc

SEQ ID NO: 261498 - DNA, 553 bp, Homo sapiens
  misc_feature: GYAE6OF02IW3B7.43.42.D09.1.454.CMB.1.raw
  modified_base (202)..(202): a, c, t, g, unknown or other
  misc_feature (202)..(202): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaanagccaccctctcctgcagggccagtgagacagttactgttaattatttggcctggtaccagcagaagcctggccaggctcccaggctcctcatctctgctgcatcctacagggcccactggccatccccagacaggttcagtggcagtgggtctgggacagacttcactctctccatcagcagactggagcctgaagtattttgactaattttattactgttcacctagtatggtactctactaacttccttaacgtttccgggacggtaacgggtaccgaagggttgggaacgtagtaacgaaacggtaactggtacggtctcggaccgaccgtataccttcgtaccttc

SEQ ID NO: 261499 - DNA, 498 bp, Homo sapiens
  misc_feature: GYAE6OF02IO3MZ.43.42.D09.1.454.CMB.1.raw
  modified_base (203)..(203): a, c, t, g, unknown or other
  misc_feature (203)..(203): n is a, c, g, or t
  modified_base (312)..(312): a, c, t, g, unknown or other
  misc_feature (312)..(312): n is a, c, g, or t
  modified_base (429)..(429): a, c, t, g, unknown or other
  misc_feature (429)..(429): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtgagacagttactgttaattatttggcctggtaccagcagaagcctggccaggctcccaggctcctcatctctgctgcatcctacngggccactggcatcccagacaggtcagtggcagtggtctgggacagacttcactctctcatcagcagactggagcctagaagtatttgactaatttatactgtcactagtatggtanctacaactctaacgttcggcggtaggacaggtgagtagtacaacgtactgtagctgcactatctgtctc

SEQ ID NO: 261500 - DNA, 505 bp, Homo sapiens
  misc_feature: GYAE6OF02IPJEE.43.42.D09.1.454.CMB.1.raw
  modified_base (203)..(203): a, c, t, g, unknown or other
  misc_feature (203)..(203): n is a, c, g, or t
  modified_base (430)..(430): a, c, t, g, unknown or other
  misc_feature (430)..(430): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtgagacagttactgttaattatttggcctggtaccagcagaagcctggccaggctcccaggctcctcatctctgctgcatcctacagggccactggcatcccagacaggttcagtggcagtggtctgggacagacttcactctctccatcagcagactggagcctgaagtatttgactaatttatactgtcacagtatggtanctacactcttaactttcggcggagggaccaaggtgagacgtacaacgacgtagtggactgcaccatctgtcttcg

SEQ ID NO: 261501 - DNA, 516 bp, Homo sapiens
  misc_feature: GYAE6OF02FPHY3.43.42.D09.1.454.CMB.1.raw
  modified_base (203)..(203): a, c, t, g, unknown or other
  misc_feature (203)..(203): n is a, c, g, or t
  modified_base (436)..(436): a, c, t, g, unknown or other
  misc_feature (436)..(436): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctcatcagcagactggacgcctgaagtattttgacttaatttattactgtctacctagtatggtanctacaactcttaacgttcggacggacggacgtaggtgagacgtacaaacgtactgtagcgtcgacacctagtctgttctc

SEQ ID NO: 261502 - DNA, 716 bp, Homo sapiens
  misc_feature: GYAE6OF02G28VS.43.42.D09.1.454.CMB.1.raw
  modified_base (203)..(203): a, c, t, g, unknown or other
  misc_feature (203)..(203): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtgagacagttactgttaattatttggcctggtaccagcagaagcctggcccaggcctcccgaggcctcctcattcctctgctgcctatccctacgacgggcccacgtcggcagtcccccgagactagggtttccaaggtcggccaggtcggggtctgggggacaggtacctttcacgttccctacgtacccgtagtcgtaacgccgtaaacggtaccgttacgggtaaccgtacccgtaagggtaaaacggttaacgttttttacggaccgttaaaacgtttttaacgttaacgttacggttaaccgaaccgtaaacggttaacgttacgggtaacgtacgttacgtaaaccgttaccgttaaaccgttttccggggaacggtaacggggtacccgtaaggggttacggaacgtaacgtaccgaaaaccggtaacgtacggtacggtacgtacgtaccgtaacccgtactaccgttcgtacccttaccg

SEQ ID NO: 261503 - DNA, 553 bp, Homo sapiens
  misc_feature: GYAE6OF02G1YVS.43.42.D09.1.454.CMB.1.raw
  modified_base (204)..(204): a, c, t, g, unknown or other
  misc_feature (204)..(204): n is a, c, g, or t
  modified_base (440)..(440): a, c, t, g, unknown or other
  misc_feature (440)..(440): n is a, c, g, or t
tcagtgtgagtagtcacgaccggtgctcgatttagacacatacgcagggaaaggggagaagagctgctccagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtgagacagttactgttaattatttggcctggtaccagcagaagcctggccaggctcccaggctcctcatctctgctgcatcctacacgggccactggcactcccagacaggttcagtggcaggtgggtctgggacagacttcactctctccatcagcagactggagcctagaagtattttgacttaatttattactgtcacctagtatggtanctacaacttcttaacgtttcggacggtacgggtaccgaagggttcggaagtacgtaacgaaaccgtaacgtaggtcggtacgtacgaccaccgtaattcttacgttcttaccg

SEQ ID NO: 261504 - DNA, 577 bp, Homo sapiens
  misc_feature: GYAE6OF02J2L5A.43.42.D09.1.454.CMB.1.raw
  modified_base (300)..(300): a, c, t, g, unknown or other
  misc_feature (300)..(300): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctcngctgcatcctacacgggccactggcactcccagacaggtcagtggcaggtcggtctgggacagacttcacttctctccatcagcagactggatccgtagaacgtatttcgcttaatttacttactcgtactacctagttactaggttacgccttacctaaacttaccgtttaacgtttcgggaccggaagggtacctaagggttcgaagtaccgtaacgaaaccgtagtccggtacggtactacggtaccaccttacgttacgtcgttccttaaccg

SEQ ID NO: 261505 - DNA, 521 bp, Homo sapiens
  misc_feature: GYAE6OF02FY9C7.43.42.D09.1.454.CMB.1.raw
  modified_base (203)..(203): a, c, t, g, unknown or other
  misc_feature (203)..(203): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtgagacagttactgttaattatttggcctggtaccagcagaagcctggccaggctcccaggctcctcatctctgctgcatcctacagggccacgtggcatccccagacaggttcaggtggcaggtgggtctgggacagacttcactctctcatcagcagactggacgcctagaagtattttgacttaatttattacttgtcacctagttatggtagtctactaacttcttaacgttcggacggaggaccgaaggtgagtatacaacgtacgtgtcgctgcactatctgtcttac

SEQ ID NO: 261506 - DNA, 541 bp, Homo sapiens
  misc_feature: GYAE6OF02GTHNW.43.42.D09.1.454.CMB.1.raw
  modified_base (203)..(203): a, c, t, g, unknown or other
  misc_feature (203)..(203): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtgagacagttactgttaattatttggcctggtaccagcagaagcctggccagtctcccaggctcctcatctctgctgcatcctacagggccactggccatcccagacaggttcagtgcaggtggtctgggacagacttcactctctcatcagcagactggagcctagaagtattttgacttaaattttattacttgtacactagtatggtatctacaacttacttaacgtttcggacggacgggtaccaagggtggaagtacgtaacaaacggtaactggtaggcgtagacctaacctagtcttacgtcttacg

SEQ ID NO: 261507 - DNA, 622 bp, Homo sapiens
  misc_feature: GYAE6OF02F9RJG.43.42.D09.1.454.CMB.1.raw
  modified_base (203)..(203): a, c, t, g, unknown or other
  misc_feature (203)..(203): n is a, c, g, or t
  modified_base (309)..(309): a, c, t, g, unknown or other
  misc_feature (309)..(309): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacctctcctgcagggccagtgagacagttactgttaattattggcctggtaccagcagaagcctggccaggctcccaggctcctcatctctgctgcatcctanagggccacgtggcactcccagactaggttcaggtcgcgtaggtgggtcgtgggacagtacttcactctctcatcagcagacgtggactcctagaagtattttacgacttaaattttacgttacgttacgtacctaaccgtagttacgttagggttacgtccttacctaaaccgtttaccgtttaaaccgtttccgggaccgggtaacgggtaaccgtaagggttacgggaacgtaacgtaaccggaaaaccggtacgtaggttaccggtacgttacggacctaaccgtacgttccgttacgttacctttaccg

SEQ ID NO: 261508 - DNA, 546 bp, Homo sapiens
  misc_feature: GYAE6OF02IFE2I.43.42.D09.1.454.CMB.1.raw
  modified_base (203)..(203): a, c, t, g, unknown or other
  misc_feature (203)..(203): n is a, c, g, or t
  modified_base (422)..(422): a, c, t, g, unknown or other
  misc_feature (422)..(422): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtgagacagttactgttaattatttggcctggtaccagcagaagcctggccaggctcccaggctcctcatctctgctgcatcctacgacgggccacgtggcctatccccgaagaccaggtttccaaggtcggcaggttcgggtctggggactaggacttcactccttctccatcagcagacgtggacgctagaagtnttttgacttaatttattacgtgtactacctagtatcggtatcctactacttctaacgtttcggacggagtaccgaggtgagtagacgaacgacgtgtcgacgtcgactacctatctagtctacg

SEQ ID NO: 261509 - DNA, 519 bp, Homo sapiens
  misc_feature: GYAE6OF02IQMK3.43.42.D09.1.454.CMB.1.raw
  modified_base (203)..(203): a, c, t, g, unknown or other
  misc_feature (203)..(203): n is a, c, g, or t
  modified_base (389)..(389): a, c, t, g, unknown or other
  misc_feature (389)..(389): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtgagacagttactgttaattattggcctggtaccagcagaagcctggccaggctcccaggctcctcatctctgctgcatcctacagggccactggcactcccagacaggttcagtggcagtgggtctgggacagacttcactctctccatcagcagactgganccgtgaagtattttgacttaatttattactgttcaccagtatggtagctctaactctaactttcggacgtagggacctaaggtgagtagtacaaacgtactagtgtctgactaccgtatacttgtcttac

SEQ ID NO: 261510 - DNA, 733 bp, Homo sapiens
  misc_feature: GYAE6OF02JZE55.43.42.D09.1.454.CMB.1.raw
  modified_base (203)..(203): a, c, t, g, unknown or other
  misc_feature (203)..(203): n is a, c, g, or t
  modified_base (267)..(267): a, c, t, g, unknown or other
  misc_feature (267)..(267): n is a, c, g, or t
  modified_base (302)..(302): a, c, t, g, unknown or other
  misc_feature (302)..(302): n is a, c, g, or t
  modified_base (380)..(380): a, c, t, g, unknown or other
  misc_feature (380)..(380): n is a, c, g, or t
  modified_base (435)..(435): a, c, t, g, unknown or other
  misc_feature (435)..(435): n is a, c, g, or t
tcagtgtgagtagtcacgaccggtgctcgatttagacacatacgcagggaaagggagaagagctgctcagttaggacccagagggaaccgatggaaacccagcgcagcttctcttcctcctgctactctggctcccagataccaccggagaaacttgtgttgacgcagtctccaggcaccctgtcttgtctccgaggggaaancgccaccctctcctgcgacgggccagtgagacctagttactgttaattagttggcctggtaccngcagtaagcctggcaggcctcccgaggtctccctnacttaccgtctgcctgcctacgttccctacgggacggtcccagttggcctaacgtccccgaagaccgtaggttaccgngtacggctaggttgggtccgtaggggacctaggtacccttaccgaccgtttcccncgttaccccgagttccgaccgacgtaacgtacgtcgggtacgaccgtaggtaaacgttacgttttacgacgtttaacgttacgttttaaccgttacgttaccaacgttaccgtttaaggttcggttacgtaccgtaccttaaacgttaccgtttaaaccggtttccgggtaaccggtaacgggtaacccgtaaggggtacggtaagtaaccggtaaccgtaaaccggttaacgttaccgggttacgtaccggttacgtaacccgaccgtttaacgaccgtttacgtaccgtttacccg

SEQ ID NO: 261511 - DNA, 655 bp, Homo sapiens
  misc_feature: GYAE6OF02JA4I0.43.42.D09.1.454.CMB.1.raw
  modified_base (203)..(203): a, c, t, g, unknown or other
  misc_feature (203)..(203): n is a, c, g, or t
  modified_base (400)..(400): a, c, t, g, unknown or other
  misc_feature (400)..(400): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtgagtacagttactgttaattatttcggcctggtaccagtcagaacgcctggccagcctcccagggcctcctcatctctcgctgacctatcctacgacgggtcccaacgtcggaccactccccgaaggtaccacgggtttaccagggttcggaccgtaggttcgggttcccgnggggtaacctagggtaccctttacgacctcgttcctacccgtattacgacggtacaggtacgtaggtacgctacgtaagtacgttttcgacgttaatttacgttaacgttcgtacctaacgtacgtaaagttcggtacgtacgtactaccgttacgttaaccgttcgggacggtaaacggtccgtaaggtcgaacgtacgtaacgaaacgtacgtagtacggactacgtcgaaccgtactcgttacgttcttacg

SEQ ID NO: 261512 - DNA, 570 bp, Homo sapiens
  misc_feature: GYAE6OF02HXUFT.43.42.D09.1.454.CMB.1.raw
  modified_base (203)..(203): a, c, t, g, unknown or other
  misc_feature (203)..(203): n is a, c, g, or t
  modified_base (315)..(315): a, c, t, g, unknown or other
  misc_feature (315)..(315): n is a, c, g, or t
  modified_base (335)..(335): a, c, t, g, unknown or other
  misc_feature (335)..(335): n is a, c, g, or t
  modified_base (359)..(359): a, c, t, g, unknown or other
  misc_feature (359)..(359): n is a, c, g, or t
  modified_base (438)..(438): a, c, t, g, unknown or other
  misc_feature (438)..(438): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagatacccaccggagaaattgtgttgacgcagtctccaggcaccctgtctttgctccaggggaaangccaccctctcctgcagggccagtgagacagttactgttaattattttcggccttggtaccagcagaagcctggccaggcctccaggctcctcatctctgctgcatcctacngggccatggcatcccagacnggttcagtgcaggtggctgggacngtacttcactctctcatcagcagactggagcctagagtatttgacttaatttattactcgtacacctagttataggtanctactaacttcgttaacgtttccgggacggtaagggaccgtaagggttagaacggtacgtaaccgtaaaacggtaaccgtggttacggtacgttacgaccgttaacctaacgtttcgttacgttccttaccg

SEQ ID NO: 261513 - DNA, 558 bp, Homo sapiens
  misc_feature: GYAE6OF02GDZLY.43.42.D09.1.454.CMB.1.raw
  modified_base (204)..(204): a, c, t, g, unknown or other
  misc_feature (204)..(204): n is a, c, g, or t
  modified_base (428)..(428): a, c, t, g, unknown or other
  misc_feature (428)..(428): n is a, c, g, or t
  modified_base (536)..(536): a, c, t, g, unknown or other
  misc_feature (536)..(536): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgtctccgaggggaaanagccaccctctcctgcagggccagtgagacagttactgttaattatttggccttggtaccagcagaagcctggccaggctccaggctcctcatctctgctgctactcctacgacgggcccaacgtcgggccactccccgagaccgacggtttcagggttggctaaggtgggtctggggacagtacttcacttctctccatcagcagacgtggacgctagaagtnttttcgattaatttattacgtcgtacactagtatggtatctactaacttcttaacgtttcggacggtaacggacgtaaggtggagagtacgaaacgtacgtaggtcgngtacgcgacctatctgtcttac

SEQ ID NO: 261514 - DNA, 735 bp, Homo sapiens
  misc_feature: GYAE6OF02J001E.43.42.D09.1.454.CMB.1.raw
  modified_base (203)..(203): a, c, t, g, unknown or other
  misc_feature (203)..(203): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccacctctcctgcagggccagtgagacagttactgttaattattggcctggtaccagcagaagcctggccaggctcccaggcctccgtcatcgtctgctgctatcctacgacggggacccacgtcggacacttacccgagaccgtacgggttcacggtcgggactacggttcggggttctagggggaacctaaggtacccgtttactaaccggttccttaccgtccgtaactccgtaacgtccgtaaacggtaccggtacgggtacggtacccgttagggtaaacgtttacgttttacggaaccgttttaacgtttttaacgtttaccttacgttaaccctaaccggttaagtttacgtaacgggttacgtaccgttaccgtaaacctttccgtttaaaccgggttttacgggaacccgggttaacgggttaaccggtaacgggttacgggaagttaacggtacgtaaaaccggtacggttggtacggtaccgacggtaccgtaccacgttcgttaccgttcgtttaaccg

SEQ ID NO: 261515 - DNA, 690 bp, Homo sapiens
  misc_feature: GYAE6OF02JDB9V.43.42.D09.1.454.CMB.1.raw
  modified_base (204)..(204): a, c, t, g, unknown or other
  misc_feature (204)..(204): n is a, c, g, or t
  modified_base (310)..(310): a, c, t, g, unknown or other
  misc_feature (310)..(310): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgtctccgaggggaaangccaccctctcctgcagggccagtgagacagttactgttaattatttggcctggtaccagcagaagcctggccaggcctcccgaggctcctcattctctgctgctntcctagacgggccacgtcgcctactaccccagacctaggttcaggtcggacagggttcgggtcgtacggggtacacggtacctttcgaaccgttccgtacctaccgaagttccgaacgtaccgtaacggtaaccgttcgggaccgtaccggttaacggtaaagttacgttttacggacgttaaactttttaactttacgttcgttaccgtaacccttaaggttacgttagggtaacgttcctaaccgttaaccgttacgtttaaccgtttccgggacgggtacgggtaaccgtaagggttacggaacgtaccgtaacgtaaaccggttacgtggtacgtacgtacgtacctaaccgtagttccgttacgttaccttaccg

SEQ ID NO: 261516 - DNA, 610 bp, Homo sapiens
  misc_feature: GYAE6OF02GFD2L.43.42.D09.1.454.CMB.1.raw
  modified_base (204)..(204): a, c, t, g, unknown or other
  misc_feature (204)..(204): n is a, c, g, or t
  modified_base (315)..(315): a, c, t, g, unknown or other
  misc_feature (315)..(315): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgtctccgaggggaaangccacctctcctgcagggccagtgagacagttactgttaattagttggcctggtaccagcagaagcctggccaggctcccgaggctccgtcatctctgctgcatcctacgnggcccagtggccactccccgaagtacgtacggttcaaggtcggactagggttcggggtctgggggaacagtacctttcacgttctcctacatccacgcaagacgtggacgccgttaggaagttagttttgacttaaacttttattactgtacctaaccgtagttaagttggtacgtaccttacgtaaccgttacttaaccggtttcgggacggtaacgggaccgtaagggtagacgtagtaaccggaaacgtacgtggtacggtacgtacgccgacctatcgttacgtcttaccg

SEQ ID NO: 261517 - DNA, 577 bp, Homo sapiens
  misc_feature: GYAE6OF02G0WFQ.43.42.D09.1.454.CMB.1.raw
  modified_base (203)..(203): a, c, t, g, unknown or other
  misc_feature (203)..(203): n is a, c, g, or t
  modified_base (453)..(453): a, c, t, g, unknown or other
  misc_feature (453)..(453): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaangcccaccctctcctgcagggccagtgagacagttactgttaattatttggcctggtaccagcagaagcctggccaggcctcccgaggctcctcatctctgctgctatccacgacgggccacgtcggactactccccagactaggttcagtggcaggtgggtctgggacagtcttcactctctcatcagcagcgtggacgcgtagaagtatttgacttaatttacttacgtgtactactagtagtggtacnctactaacttcttaacgtttccggacggtacggtaccgtagggtcggagtaacgtaacgtaaacggtacgttcggtacggtacctacgtaccctaaccgtacgttccgttacgttaccttaccg

SEQ ID NO: 261518 - DNA, 633 bp, Homo sapiens
  misc_feature: GYAE6OF02G3WAO.43.42.D09.1.454.CMB.1.raw
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgtctccgaaggggaaagcgccaccctctcctgcagggccagtgagacagttactgttaattatttggcctggtaccagacagaacgcctggccaggcctcccgaggccttcctcatctctgctgccatcctacgacgggccacgtggccactcccgagacctaggttcgaggtggctaggtgggtcgagggactagtcttacacttctcctaccatcgacgcgacgtacgtcggacgtacgtagaagttagtttacgtactttaattttacgttacttacgtaccgtacgtaaggttacgtaggtaactccttaactaaccgttaccgtttaacggtttccgggacggtaacgggtaacgtaagggtacggtaagtaacggttaaccgaaacggtacgtcggtacggtacgtacgaccgtaccgtacgttcttacgttccttacc

SEQ ID NO: 261519 - DNA, 771 bp, Homo sapiens
  misc_feature: GYAE6OF02I6OR9.43.42.D09.1.454.CMB.1.raw
  modified_base (204)..(204): a, c, t, g, unknown or other
  misc_feature (204)..(204): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgtctccgaggggaaangccaccctctcctgcagggccagtgagactagttactgttaattagttggcctggtaccagcagaagcctggccaggcctcccaggcctcctcatcctctgctgcctactccctagacgggccctacgtcggacctacgtccccaagtaccgtagggtttccaagggttcggacgtaagggttcggggtaccgtacgggggaacaacggttacctttcccacgtttcccgttcctaccctaagttccgaacggacccgtaagggtaccgttagggacccgtaccgttaggtaaacggtttacgtttttacggaaccttttaaattttaccgtttaaccgttacgttaacccgtaaccgttaagggtttaacgttacgggttaacctacccgttaccttaaaccgtttaccgtttaaaccgggttttccggggaacccgggtaaacggggtaaccgttaaacgggggtacggtaacggtaaccgttaaccggtaaaaccggtaacggttacggtaccgggtacgttaccggaccttaccgtaacgttaccgttcggttaccttaccgg

SEQ ID NO: 261520 - DNA, 770 bp, Homo sapiens
  misc_feature: GYAE6OF02IO39J.43.42.D09.1.454.CMB.1.raw
tcagtgtgagtagtcacgaccggtgctcgatttagacacatacgcaggggaaagggggagaagagctgctcagttaggacccagagggaaccatggaaaccccagcgcagcttctcttcctcctgctactctggctcccagataccaccggagaaattgtgttgacgcagtctccaggcaccctgttctttgtctccgaggggaagcgccaccctctcctgcagggccagtgagactagttactagtttaattagttggcctaggtaccagacgagaagtcctggccgaggcctccgaggtcctcctcactctctcgtctgctactcctacgacgggcctacgtggcctactcccgagtaccgtaggttcgaggtcggacgtagggttgggtcgtagggaacctaggtacctttccggaaccttccgtacgttaccctagtaccgacgtacaacgggtaccgtagggaaccgttaccgtaggtaacgtttagttttacgaacgttttaaacttttacgttaacgttacgttaaccgtaaccgtaggtttaacgttacgggtttaacgtacccgttaacgttaaaacccgttttaccggtttaaaccgggttttaccgggggaaaccgggtaaaccggggttaaccgttaaacggggtaccgggtaaacgtacggttaaaacccggttaaaacggtacggttacggtaaccgggtaaccgttacggaacccttaaccggtaacctttaccggttaccgtttaccgttaccg

SEQ ID NO: 261521 - DNA, 720 bp, Homo sapiens
  misc_feature: GYAE6OF02JMKI6.43.42.D09.1.454.CMB.1.raw
  modified_base (204)..(204): a, c, t, g, unknown or other
  misc_feature (204)..(204): n is a, c, g, or t
  modified_base (251)..(251): a, c, t, g, unknown or other
  misc_feature (251)..(251): n is a, c, g, or t
  modified_base (294)..(294): a, c, t, g, unknown or other
  misc_feature (294)..(294): n is a, c, g, or t
  modified_base (317)..(317): a, c, t, g, unknown or other
  misc_feature (317)..(317): n is a, c, g, or t
tcagtgtgagtagtcacgaccggtgctcgatttagacacatacgcaggaaagggagaagagctgctcagttaggacccagagggaaccatggaaacccagcgcagcttctcttcctcctgctactctggctcccagactaccaccggagaaacttgtgttgacgcagtcctccaggcaccctgtctttgctccgaggggaaacngccaccctctcctgcacgggccagtgacgactagttactgttaattnttggcctggtaccagcagacgctggccaggcctccaggctccncatctctgctcgcactccgtacngggccagtcggaccactccccgaagacgtacggttacaggtcgacgtagttacgggtcttaggggacctaaggtactttacccacgttacccgtccgttaccacgttacgaacgtccgaacgtacgtacggacgtccgtagtaaacgttagttttacgacgttaaatttttacgtaaaccttcggaaaccttaccgtaaggtaacgtttagggtactacccgtttaaccgttaaactttacccgtttaaacgtttccggggaacggtaaacggggttaaccgtaaacggggttacggaacggttaacgttaaaccggaaaaccggtaacggtttaccgtacgggtaacctttacgggaacccttacccgttaagtttacccgtttacggttaccctttaacgg

SEQ ID NO: 261522 - DNA, 720 bp, Homo sapiens
  misc_feature: GYAE6OF02HZ8GZ.43.42.D09.1.454.CMB.1.raw
  modified_base (114)..(114): a, c, t, g, unknown or other
  misc_feature (114)..(114): n is a, c, g, or t
  modified_base (206)..(206): a, c, t, g, unknown or other
  misc_feature (206)..(206): n is a, c, g, or t
  modified_base (311)..(311): a, c, t, g, unknown or other
  misc_feature (311)..(311): n is a, c, g, or t
  modified_base (540)..(540): a, c, t, g, unknown or other
  misc_feature (540)..(540): n is a, c, g, or t
tcagtgtgagtagtcacgaccggtgctcgatttagacacatacgcagggaaaggggagaagagctgctcagttaggacccagagggaaccatggaaaccccagcgcagcttctnttcctcctgctactctggctcccagataccaccggagaaattgtgttgacgcagtctccaggcaccctgtcctttgtctccgaaggggaaancgcccaaccctctcctagcgacgggccagtggacgacaggttactgttaattatttcggcctggtaaccagcgaagaagcctaggccaggctccgaggcctccgnactctctgctcgacactcctacgcgggaccctactggaccacttcccgaacgactacggttacacgtaggccgtaaggtcgggtctagggacctaggtaccttcgactcgtccttccataccgagtcaacgtacacggggtacaccgtaggaaagttacgttttacacggtttaaaactttttacttaacgttacgttaaccacgtaaacgttacggttacggttaacnccgtaacttaacgttaaccgtttaaacgttttccgggaacggggtaaacggtaacccgttaaacgggtaggggtaaacttaccggaaacggttaaaaacccgaggttaaccgtttacgggaacccgttggtaacccgaaacccgttaaacgttaccggtttcggttacccttttaaccgg

SEQ ID NO: 261523 - DNA, 707 bp, Homo sapiens
  misc_feature: GYAE6OF02JA4AQ.43.42.D09.1.454.CMB.1.raw
  modified_base (681)..(681): a, c, t, g, unknown or other
  misc_feature (681)..(681): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcacctgtcttgtctccgaagggaagcgccctaccctctccgtagccgacgggccaagtggacacgtagttacttagttaaatttcgttcgtccgtacggtacaggtcaagaacggtctcggccacggcctaccgaggtccctcgtactattccttccgtgcgtacgactaactcccggtaacgaccgggtccacgtaccggtacctacgtacccgaacggtacgtaaccggttcgtaacgggtcgtcggaacggtttggacggtacgggacttaacgtcgttactaccgtatcccgtatacgtacgacgtacgacggtacgtaacgggtcgtacgttaacggtaacggttaacggttttacgtaacgtttaacgttttaacgttaaacccgttcgtaccgttaaaccgtaacgtttagtaacgttacgtacctacgtaaccgttacgtacgttcggtacgacggtaaccgtagggtactagagtaacgtaagtcgtaagtcgtancggtacacttcgtacttcgtataccg

SEQ ID NO: 261524 - DNA, 659 bp, Homo sapiens
  misc_feature: GYAE6OF02G4XF0.43.42.D09.1.454.CMB.1.raw
  modified_base (199)..(199): a, c, t, g, unknown or other
  misc_feature (199)..(199): n is a, c, g, or t
  modified_base (605)..(605): a, c, t, g, unknown or other
  misc_feature (605)..(605): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagactaccaccggagaaattgtgttgacgcagtctccgagcacctgtcttgctcgagggaangccacctctctgcgagggccagtgacgactagttactagttaattagttcggaccgtaggtaccagtacaaggtacgcctaggccgaggccttacccgaggtccttacccgtactacttacctcgtcgtactgacctactaccgtacgacgggcctaacgtcggaccaccgtacccgagtaccgtaggttaccaagggtcgacgtagggtcggtacgtaggacctagtaccgttcacttcgtacctacctataccgagtacgacgtaacggtcggtaacgtaccgtagtaacggttagtttacggaactttaacgttaatccgttagtaccctagtaagtacgtagtaccgtactacttaaccgtacgttaacgttcgggacggtaacggaccgtaaggtcgtaanacgtaacgaagttcgtagtccgttagacaccgtatacgttacgtcttactaccg

SEQ ID NO: 261525 - DNA, 749 bp, Homo sapiens
  misc_feature: GYAE6OF02G4RYR.43.42.D09.1.454.CMB.1.raw
  modified_base (204)..(204): a, c, t, g, unknown or other
  misc_feature (204)..(204): n is a, c, g, or t
  modified_base (320)..(320): a, c, t, g, unknown or other
  misc_feature (320)..(320): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggctcccagataccaccggagaaattgtgttgacgcagtctccaggcaccctgtctttgtcctcgaaggggaancgaccaccctctcctgcacgggccagtgagactagttactagttaattattcggccttaggtaccagcaagacgcgtcggccgacggcctaccgaggcctccacgtactctcgtcnctgcctactcctacgacgggtccacgtcgacctaacctcccgaagtaccgtacggttacgaggtcggacgtaggggtcgggtacgtacggggactacggtacctacgtaccttccgttaccgtacctaacgtccgacgaccgtaacggtacgttacgggaccgttaacggtacggggttaaattttaccggtttaacggtaacgttttaaacgtttttacgttaaccgttaccgttaacgtaccgtttaacggttaagttccggttaacgtacttaacccgttaacgtttaccgttaaaccggtttccgggaaacgggttaaccgggaccggtaacgggtaggtaacgtaacggaaaccgttaaaccggttaagtaccgggtacgtacgtacggaccgtaaccgttacggtccttacggttcctacccg

SEQ ID NO: 261526 - DNA, 755 bp, Homo sapiens
  misc_feature: GYAE6OF02INDE0.43.42.D09.1.454.CMB.1.raw
  modified_base (205)..(205): a, c, t, g, unknown or other
  misc_feature (205)..(205): n is a, c, g, or t
  modified_base (441)..(441): a, c, t, g, unknown or other
  misc_feature (441)..(441): n is a, c, g, or t
tcagtgtgagtagtcacgaccggtgctcgatttagacacatacgcagggaaaggggagaagagctgctcagttaggaccagagggaaccatggaaacccagcgcagcttctcttcctctgctactctgctcccagataccaccggagaattgtgttgacgctagtctccgagcaccctgttcctttgtcctaccgaaggggaaancgtccacctctctcgcgacgggcaggtgacgactagttacgttgtttaacgttagttcggcgtacgtaccgagacaagtaacgtccgtacggccgaacggcctacccgagtcctaccgttacgacttctaccgtgtaccgtcgtaccacttaccgtaacgacgggtccaacgtccggactaccgtacccgtaaggtaactacggttacgaggtacgtacgtagggttacgggtacncggggtaaactacgttactccgttaacctttccgtaccgttaccgtaacgtacgaccgtacggtacgtaacggtcggtaaccgttacgtaacgtaacgttacgtttacgtaaccgttaatttacgtttactacgttaaccgtaacttaacggttgtacgggttatacccgttacgttaaaccgttacgtttaaaccggttccggggtaaacggtaaccggtaacgtaacggtaggtaaccgtaagtaaccgtaaacggtacggttaacggtcgaaccgtagtaccctaagtaccgtacgttacccgtagttacc

SEQ ID NO: 261527 - DNA, 910 bp, Homo sapiens
  misc_feature: GYAE6OF02JVQGE.43.42.D09.1.454.CMB.1.raw
  modified_base (509)..(509): a, c, t, g, unknown or other
  misc_feature (509)..(509): n is a, c, g, or t
tcagtgtgagtagtcacgaccggtgctcgatttagacacatacgcagggaaaggggagaagagctgctcagttaggacccagagggaaccatggaaaccccagcgcagcttctcttcctcctgctactctggacctcccaagactacccgaccggtaagtaaatttggttgttacgaccggtctacggttacctcccgacgggccctacccgttgttccgttttagtccctacggaaaggggtaaacgcgtcccctacccgttcgtcccttggaccgacgggcctaggtgacaacgttacgtttaaccgtaggtttaacttaggttttcggccttacgaccgtacgacgaacggtaaccgtccgacgggtacccgacggtcccctaccggaaggttccttacccgacttacttccgtccgtacgtccgtacgtcctaaccttacccgaacgggccccgttaaccgaaccggtcgtaccgacccgtaccggtacgtacgggtacgttaancggggttacgacggttaggtgggtacccggtaacgtaaccggtaactttaccgaccctacggtttacccctaggttaccctaagtccggtaccgtaccggaacggtaccgggtaacgacccggttacggtttaacggttaactttacgtttaacggttaacgttaacgtttttaacgttaaccgttacgtaaccgtttacgttaaagtttacggttacgtaacgttaccttaaacccgttacggtttaccggtttaaaccgggttcgggtaaaccgggtaacgggtaaccgggttacgtacggtaacgtaaccggttaacggaaccgttaacggtaacggttacgtaaccggtccgtaaacgggacctttagggttaccgtttaaccgttacgtttacccg

SEQ ID NO: 261528 - DNA, 779 bp, Homo sapiens
  misc_feature: GYAE6OF02HPVQ7.43.42.D09.1.454.CMB.1.raw
tcagtgtgagtagtcacgaccggtgctcgatttagacacatacgcagggaaaggggagaagagctgctcagttaggacccagagggaaccatggaaaccccagcgcagcttctcttcctcctgctactctcggctccagactaccgaccgacgtaaattgtgttgacgcgagtctccaggccaccctgttctttcgtctcgtaacgggtaagaccgtccaccctcgtcctcggccgacggaccaacggtgacgactacgttaactaggttaatttacggtttcgtaccttacggtaccgagcgttaacgaacgtcccgtcggtaccgtacgggcctaccggtaggtccccttacgacctacgttccttcctcggtccgtcgtccaacctccgtaccgtaccggccgtaccgtccgggacttacccgtacccgaaggtaccgtacggttaccggtacgggtaccggacggtcgggtaacggggtttccggaacggggtaccctacggtttaaccgtcccgttaaccgttcccgtactttcccgaacgtaccgtaccgtaccgacgtaccgtacggtacggacgtaacggtacgttacgtttctaaccgttaacgttttacttacttaccgtacgtacgtacgtaacgtgtacgttacgactacttaccgttaccgttacgggtacgaaagggtaccgtaggtacggtaacggtacgaacgtaactacggttaacgttacggtcgtaacgtcctaacgttaccgtacttcgtacttaaccg

SEQ ID NO: 261529 - DNA, 517 bp, Homo sapiens
  misc_feature: GYAE6OF01ED1KC.9.86.H09.1.454.CMB.1.raw
  modified_base (289)..(289): a, c, t, g, unknown or other
  misc_feature (289)..(289): n is a, c, g, or t
  modified_base (409)..(409): a, c, t, g, unknown or other
  misc_feature (409)..(409): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaagccccaaatcatgatttatgaagtcactaagcggcctggggatttcngctcgcttctctggctccaagtccgtcaacacggcctcctgacaatctctggctccagactgaggacgaggctcattattactgttgctcatatacagtgtaagtagttgggtgttcggnggaggacaagctgaccgtcgtagtcagcccaaggctcgcccctggtcactcctcgttccccaccctcctcgacgtacgtatccactgacgcgggctggcaaggcgacg

SEQ ID NO: 261530 - DNA, 516 bp, Homo sapiens
  misc_feature: GYAE6OF01B3TG5.9.86.H09.1.454.CMB.1.raw
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaagcccccaaatcatgatttatgaagtcactaagcggccctcggggatttctgctcgcttctctggctccaagtccgtcaacacggcctccctgacaatctctggctccagactgaggacgaggctcattattactgttgctcatatacaggtgtaagtagttgggtgttcggcggagggaccaagctgaccgtctaggtcagcccaaggctcgcccctcgtcactctcgttcccaccctcctcacgactatccactgacgcggctggcaggcgac

SEQ ID NO: 261531 - DNA, 575 bp, Homo sapiens
  misc_feature: GYAE6OF01C0Y5B.9.86.H09.1.454.CMB.1.raw
  modified_base (293)..(293): a, c, t, g, unknown or other
  misc_feature (293)..(293): n is a, c, g, or t
  modified_base (371)..(371): a, c, t, g, unknown or other
  misc_feature (371)..(371): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagtttttaaccttgtctcctggtaccaacaccaccaggcaaacgcccccaaactcatgatttatgaagtcactaagcggcctcggggatttcngctcgcttctctggctccaagtccgtcaacacggcctccctgacaatctctcgggctccagactgaggacgaggctanattattactgttgctcatatgcagtatggtgactactccggttggtacgttcgggacggagggaaccaagggtccgaccggttccgtaaggtccgacggtaccccgaagggtcctccggtccccccgtcggtccaccgttccgtccgttcccccgcccttcctcgacgtaccgtatccgtacgtggacggtcgggcgtgggacg

SEQ ID NO: 261532 - DNA, 517 bp, Homo sapiens
  misc_feature: GYAE6OF01DSHNG.9.86.H09.1.454.CMB.1.raw
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaacctgtctcctggtaccaacaccacccaggccaaagcccccaaatcatgatttatgaagtcactaagcggcctcggggatttctgctcgctttctctggctccaagtccgtcaacacggcctccctgacaatctctgggctccagactgaggacgaggctcattattactgttgctcatatacaggtgtaagtagttgggtgttcggcggagggaccaagctgaccgtctaggtcagccaaggctgccccctgtcactctcgttcccaccctctcgagtacgtatcacgtgacgcggctggcaggcgacg

SEQ ID NO: 261533 - DNA, 567 bp, Homo sapiens
  misc_feature: GYAE6OF01BB5I2.9.86.H09.1.454.CMB.1.raw
tcagtgatacgtctcacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcactcaccctgccccgattaacgttggacaggaacccttggtcttccggcgagcgggcttttcacccgctttatcgttacttatgtcagcattcgcacttctgatacctcagcatgcctcacagcacaccttcacaggcttacagaacgcctcccctacccaacaacgcaataacgcgtcgctgccgcacgcttcggtgctagtcggtttacgccccgttttcacttcctccccgcctactctcgaagtcgtac

SEQ ID NO: 261534 - DNA, 582 bp, Homo sapiens
  misc_feature: GYAE6OF01BRLYX.9.86.H09.1.454.CMB.1.raw
  modified_base (262)..(262): a, c, t, g, unknown or other
  misc_feature (262)..(262): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaagcccccaaatcatgatttangaagtcactaagcggccctcggggatttctgctcgcttctctggctccaagtccgtcaacacggcctcctgacaatctctggctccagactgaggacgaggctcatttattactgttgctcatatacaggtgtaagtagttgggtgttcgggcgggagggaccaagctggacccgtcgtaggtcgaccgaccggacgtccgtccccgtcccgttcgtaccttacgttccgtcccgttaccccgtccctccgtaccgtaacgtacgttaccgtaccgtcgtacggccgggtaccgggcggtacggacggacggccgtaacg

SEQ ID NO: 261535 - DNA, 517 bp, Homo sapiens
  misc_feature: GYAE6OF01EG9IY.9.86.H09.1.454.CMB.1.raw
  modified_base (509)..(509): a, c, t, g, unknown or other
  misc_feature (509)..(509): n is a, c, g, or t
tcagtgatacgtctcacgaccggtgctcgatttagtgctatagacttgggtttggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaacctgtctcctggtaccaacaccacccaggcaaacgccccaaactcatgatttatgaagtcactaagcggcctcgggatttctgctcgtcttctctggctccaagtccgtcaacacggcctcctgacaatctctgggctccagactgaggacgaggctcattattactgttgctcatatacaggtagtaagtagttgggtgttcggcggagggacaagctgacgtctaggtcacgccgaggctcgcccctggtcactctcgtcccnccctctcg

SEQ ID NO: 261536 - DNA, 530 bp, Homo sapiens
  misc_feature: GYAE6OF01DJKR2.9.86.H09.1.454.CMB.1.raw
  modified_base (296)..(296): a, c, t, g, unknown or other
  misc_feature (296)..(296): n is a, c, g, or t
  modified_base (517)..(517): a, c, t, g, unknown or other
  misc_feature (517)..(517): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcagttgggagttttaaccttgtctcctggtaccaacaccaccaggaccaaacgcccccaaaactcatgatttatgaagtcactaagcggcctcggggatttcngctcgcttctctggctccaagtccgtacaacacggcctcctgacaactctcgtggctccagactgaggacgagctcgattattactgttgctcatatacgaggtgtaagtagttgggtgttcggcgggaggaccaagtctcggaccgtcgtaggtcagcccaaggcctcgcccctggtcactctcgttcccgccctcctcgacgatactcactgacgcggnaggcgaggcgacg

SEQ ID NO: 261537 - DNA, 766 bp, Homo sapiens
  misc_feature: GYAE6OF01C3MPC.9.86.H09.1.454.CMB.1.raw
  modified_base (262)..(262): a, c, t, g, unknown or other
  misc_feature (262)..(262): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggattttaaccttgtctcctggtaccaacaccaccaggacaaacgccccaaatcatgtatttangatgtcaatcatcggcctgagggttctgatcgcttctcgtcggctaccgaagtccggacaaccgaccggtccctcccgtcgtaccgtccttcgtcggggccttacccgagtacgtacggaaccggaacggagggtccttaggtaactttagttttcctcggtcccttcccttactaacttaacgttaacggaaacgggggtaccaacggtacctaaccgttaccgttaccggttaaccgtttaacggttaccggggaccggggtaaccggggtaaccccgtaaggtcccgtaccgggtaaccccggttacccggttaccgggggtacccgtaaccggaccccgtaaccgggtacccgtcccggtacccccccgttcggttacccgacccgtttcccgttcccggtttaccccccctaacccccgttccccgttacccgtaaccggttaacccgttaaccgtacccgtaacgttacgggtaccgggccggggtccgtaaccgggg

SEQ ID NO: 261538 - DNA, 524 bp, Homo sapiens
  misc_feature: GYAE6OF01CFCE2.9.86.H09.1.454.CMB.1.raw
  modified_base (263)..(263): a, c, t, g, unknown or other
  misc_feature (263)..(263): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaacctgtctcctggtaccaacaccacccaggcaaacgcccccaaactcatgatttangaagtcactaagcggcctcggggatttctgctcgcttctctggctccaagtccgtcaacacggcctccctgacaatctctggctccagactgaggacgaggctcatttattactgttgctcatatacgaggtgtaagtgttgggtgttcgggcggaggaccaagctgaccgtcgtagtcagcccaaggctcgcccctcggtcactctcgtccccaccctcctcgacgacttactccacgtgacggcggctggcaggcgacg

SEQ ID NO: 261539 - DNA, 646 bp, Homo sapiens
  misc_feature: GYAE6OF01DLRFQ.9.86.H09.1.454.CMB.1.raw
  modified_base (387)..(387): a, c, t, g, unknown or other
  misc_feature (387)..(387): n is a, c, g, or t
tcagtgatacgtctcacgaccggtgctcgatttagtgctatagacttggggtttgggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcagttgggtagttttaacctgtctcctggtaaccaaccaccacccaggaccaaacgcccccaaactcatgtatttatgaagtcacgtaacgcggcccgtcggggatttcctgctcgtcttctcgtcggctccaagtccgtcaacgacggcctcccngaccaatctcgtgggcctccagtactggacggacgaggctacatttatacttgttgtctcaattactacgtaggttagtaaggtaggtttggggtaggttccggggacgggtacgggaccaaggtccgtacggaccccgttacgtagggtaccacggtacccaacggggtcccttcccgggacccccccgttggggttacccctacccgttaccccgtttcccggtttaccccccctacccccgttccgttaaccccgg

SEQ ID NO: 261540 - DNA, 522 bp, Homo sapiens
  misc_feature: GYAE6OF01BJHGM.9.86.H09.1.454.CMB.1.raw
  modified_base (262)..(262): a, c, t, g, unknown or other
  misc_feature (262)..(262): n is a, c, g, or t
  modified_base (323)..(323): a, c, t, g, unknown or other
  misc_feature (323)..(323): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggattttaaccttgtctcctggtaccaacaccacccaggcaaagcccccaaactcatgatttangaagtcactaagcggccctcggggatttctgctcgcttctctggctccaagtccgtcaacncggcctccctgacaatctctggctccagactgaggacgaggctcattattactgttgctcatatacgaggtgtaagtagttgggtgttcggcggaggacaagctgccgtctagtcagcccaaggctcgcccctgtccactctcgttccccgccctcctcgacgtacgtatccactggacgcgggctgggcagggctacg

SEQ ID NO: 261541 - DNA, 592 bp, Homo sapiens
  misc_feature: GYAE6OF01CI2WF.9.86.H09.1.454.CMB.1.raw
tcagtgatacgtctcacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggcaacatagccttctccgtcccccttcgcacgtaacaccaagtacaggaatattaacctgtttccatcgactacgcctttcggcctcgccttaggggcactcacctgcccattaacgtgacagtaccttggtcttcggcgagcggtcttttcacccgtctttactcgttacttatcgtcagctattcgctacttctgactcctcagcatcgcctcacacgcactaccttcacacgacttacacgaaccgccctcccctaaccaacaacgacaactaacgcgtcgctcgccgacacgtcgttcggtcgacgtacgtcggtttaaccgtccccgtttcaccttccttaccccgcctacgttcgtacgtaagtaccgtaac

SEQ ID NO: 261542 - DNA, 534 bp, Homo sapiens
  misc_feature: GYAE6OF01AEW8Q.9.86.H09.1.454.CMB.1.raw
  modified_base (261)..(261): a, c, t, g, unknown or other
  misc_feature (261)..(261): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagtttttaacctgtctcctggtaccaacaccaccaggcaaacgccccaaatcatgatttangaagtcactaagcggcctcggggatttctgctcgcttctctggctccaagtccgtcaacacgcctcctgacaatctctggcctcagactgaggacgaggctcattattactgttgctcatatacgaggtgtaagtagtttgggtgttcggcgggtacgggacaagctggaccgtcgtaggtcacgacccaaggcctcgacccctcggtccacgtctccgttcccgccctcctcgacgtacgtactcaccgtgacggcgggctggcaaggcacg

SEQ ID NO: 261543 - DNA, 556 bp, Homo sapiens
  misc_feature: GYAE6OF01DDD1B.9.86.H09.1.454.CMB.1.raw
  modified_base (263)..(263): a, c, t, g, unknown or other
  misc_feature (263)..(263): n is a, c, g, or t
  modified_base (292)..(292): a, c, t, g, unknown or other
  misc_feature (292)..(292): n is a, c, g, or t
  modified_base (382)..(382): a, c, t, g, unknown or other
  misc_feature (382)..(382): n is a, c, g, or t
  modified_base (489)..(489): a, c, t, g, unknown or other
  misc_feature (489)..(489): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcagttgggatttttaacctgtctcctggtaccaacaccaccaggccaaacgcccccaaatcatgatttangaagtcactaagcggcctcggggatttcngctcgcttctctggctccaagtccgtcaacaccggcctccctgacaatctctggctcagactgacggacgaggctctattattactgttnctcatatacaggtagttaagttaggttgggttggttcgggcgggaacgggaccaaggcctacggtaccgtccgtaggtcacgccgaacggcctcgccccgtcggtcncttctccgttcccgccctcctacgacgtacgtactcacgtggacgtccgggactggacgaggcgacg

SEQ ID NO: 261544 - DNA, 717 bp, Homo sapiens
  misc_feature: GYAE6OF01D81ML.9.86.H09.1.454.CMB.1.raw
  modified_base (180)..(180): a, c, t, g, unknown or other
  misc_feature (180)..(180): n is a, c, g, or t
  modified_base (200)..(200): a, c, t, g, unknown or other
  misc_feature (200)..(200): n is a, c, g, or t
tcagtgatacgtctcacgaccggtgctcgatttagtgctatagactttggggtttggggggctttgcctgggctctgctgctcctcaccctcctcactcaggaccgcagggtcctgggcccaggtctcgccctgactcagcctcgcctcgtgtctgcgtctcctggacagtcatccaccntcctcctgcacgtggaaccngctagttgggtacttttaaccgtgtctcctggtaaccaacaccaccgaggacaaaccgccccaaatcagttcgtatttagagtaacgttcaacgtaacggccgggtaccgtggggtactttcgtacgtccttaccgttcttcgtcgttcgtacctacgtaccgtcctacgaccgtccggtcctaccgtagtactacttcgtacggtcggtcctacgacgtacgtaggacggtacgtcggtacttacgtaaacttttacgttacgttcgttaccgtacttaactaacgttaacgtaacgggtagggtttaaggttaacgggtttgggttcgggttacggtacgggacgggtaacggaccgttacgttcgtaccgttacccggttcgtacggtaccgacgaacccgtagtcccgttccccgtccggttacgccttaccgtccgtacccgtccccgcttaccgacgtacgtaatccgtacgacggtgggaccggtcggtacgacggaccgtaggcctaag

SEQ ID NO: 261545 - DNA, 693 bp, Homo sapiens
  misc_feature: GYAE6OF01DEUHK.9.86.H09.1.454.CMB.1.raw
  modified_base (228)..(228): a, c, t, g, unknown or other
  misc_feature (228)..(228): n is a, c, g, or t
  modified_base (303)..(303): a, c, t, g, unknown or other
  misc_feature (303)..(303): n is a, c, g, or t
tcagtgatacgtctcacgaccggtgctcgatttagtgctatagacttgggtttgggggggggtcacaagaggcagcgctctcgggacgtctccaccatggcctgggctctgctgctcctcaccctctcactcaggacgcagggtcctgggcccagtctgccctgactcagcctgcctccgtgtctgcgtctcctggacagtcgatcaccatctcctgcactggaaccngctagttgggaactttttaacctgtctcctaggtaccaacaccaccaggaccaaacgccccaaatcatgatttanagaagtcacgtaagccggccgtcgggtatttcgtgctcgtcttctctcggctccgaagttcccgtacaacaccggcctcctagactaatctcgtcggcctaccgagacgtggacggtacgacggtctactaatttacttacgtgttcgcttacagttaatacgtagggttagttaaacggtttgggtttacggggttggtttaccggggtacgggaacggggtaaccgtaaacggtccgttaccgggtacccgttacccggtaagggttacccgaacgggtacccccgtaaagggtccccgttcccggtacccccccggttacgggttacccctacccgtttacccgtttacccggtttccccccctaacccgttccccgttaaacccgg

SEQ ID NO: 261546 - DNA, 543 bp, Homo sapiens
  misc_feature: GYAE6OF01BAC20.9.86.H09.1.454.CMB.1.raw
  modified_base (264)..(264): a, c, t, g, unknown or other
  misc_feature (264)..(264): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaacgcccccaaactcatgatttangatgtcaatcatcggccctcaggggtttcattcgcttctctggctccaagtctgacacacggcctcctgacaatctctgggctccaggctgaggacgaggctgattattactgctgctcatatgcagagtggtgactacgtcccgtggtagttcggcgggagggaccgaaggtcgacccggttccgtaggtccacggcccgaggtcctcgcccccgtcggtccaccgtctcgttcccacccttcccacgtacgtaccgtaccacgtgacggcgggtacg

SEQ ID NO: 261547 - DNA, 530 bp, Homo sapiens
  misc_feature: GYAE6OF01AWI2L.9.86.H09.1.454.CMB.1.raw
  modified_base (260)..(260): a, c, t, g, unknown or other
  misc_feature (260)..(260): n is a, c, g, or t
  modified_base (287)..(287): a, c, t, g, unknown or other
  misc_feature (287)..(287): n is a, c, g, or t
  modified_base (318)..(318): a, c, t, g, unknown or other
  misc_feature (318)..(318): n is a, c, g, or t
  modified_base (411)..(411): a, c, t, g, unknown or other
  misc_feature (411)..(411): n is a, c, g, or t
  modified_base (479)..(479): a, c, t, g, unknown or other
  misc_feature (479)..(479): n is a, c, g, or t
  modified_base (526)..(526): a, c, t, g, unknown or other
  misc_feature (526)..(526): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggattttaaccttgtctcctggtaccaacaccaccaggcaaacgccccaaatcatgatttangaagtcactaagcggcctgggatttcngctcgcttctctggctccaagtccgtcaacncgcctcctgacatctctggctcagactgaggacgaggctacatttattactgttcgctacatatacgaggttgtaagtggttgggtgttcggnggacgggacaagcgtacgaccgtcgtaggcacgccaggcctacgccccttggtccactcgtcgtcccnccctcctcgacgtactactccacgtgacggtcgggctcgggacaggntacg

SEQ ID NO: 261548 - DNA, 654 bp, Homo sapiens
  misc_feature: GYAE6OF01DTTD5.9.86.H09.1.454.CMB.1.raw
  modified_base (512)..(512): a, c, t, g, unknown or other
  misc_feature (512)..(512): n is a, c, g, or t
tcagtgatacgtctcacgaccggtgctcgatttagtgctatagacttgggtttgggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcattgggtagttttaaccttgtctcctggtaccaaccaccaacccaggaccaaacgcccccaaactcatgatttatgaagtcactaagccgcctgggattctgctcgtcttctctggctccaagtcccgtacaacgacgcctccctagactaatcctcgtcggctccgaagtaccgtggaacggacgaggtcctacgaatttactaccgttgttcgactcgtaattacgtaacgtagggttacggttaaaggtttaggtttgggggttcggtttaccggggngggtaaccgggtaaccgaacggccgttacgggacccgttaccggaggttacccacggacccgtaaggtccggttccccgtccccccgttacgggtacctacccgttcccttcgtttacccccccgcccgttccctaacccgg

SEQ ID NO: 261549 - DNA, 665 bp, Homo sapiens
  misc_feature: GYAE6OF01C4IA1.9.86.H09.1.454.CMB.1.raw
  modified_base (228)..(228): a, c, t, g, unknown or other
  misc_feature (228)..(228): n is a, c, g, or t
  modified_base (463)..(463): a, c, t, g, unknown or other
  misc_feature (463)..(463): n is a, c, g, or t
  modified_base (468)..(468): a, c, t, g, unknown or other
  misc_feature (468)..(468): n is a, c, g, or t
tcagtgatacgtctcacgaccggtgctcgatttagtgctatagacttggggtttgggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcatcaccatctcctgcatggaaccngcagttgggattttacctgctcctgtaccaacaccacccggactaaaccgacccaaactcatgatttatagaatcactaagccggccgtggggtactttctggtctcgtcttctcgtcggtctaccaacgttccgtacaaaccgaccggtccctcccgtagaactaactctcgtcgggtcctaccgacgtacgtggacggaccgtaaggctacttaagttacttacgttggttcncttanaatataacgtaggttaagttacggttaagggtttgggtaggttccgggtagggaacggaccaacggtcttaacgggcccttaccggttaacggcgtaaccgtacccggaacgggtccgtcccggtacccccgtttaccgggtaccctaccttcccgttaccggtttaccccccacccgttcccgtacgtaaacccgg

SEQ ID NO: 261550 - DNA, 735 bp, Homo sapiens
  misc_feature: GYAE6OF01D6TEZ.9.86.H09.1.454.CMB.1.raw
  modified_base (278)..(278): a, c, t, g, unknown or other
  misc_feature (278)..(278): n is a, c, g, or t
  modified_base (350)..(350): a, c, t, g, unknown or other
  misc_feature (350)..(350): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcagttgggtacgtttttaaccttgtcctcctggtaacccaaccacccacccgaggaccaaacgcccccaaactcatgtaatttanagaagtcacgtaacggccggccgtcgggtatttctgtctcgtcttctcgtggcctccgacgtccgtacaacncgtcctcctcactactctcggtcggccgtccagacgtacggacggaacggacggtctacgtatttaactttacgttcggttacgtctactataacttacggtaaggtttaggttaaaggtttagggtttacggggttgggttaccggggtacggggaacggggtaaccgtaacggtacggtaccggtacccggttccggttaacggtacgtaacgcccgtaaacgggtccgtacccggtaccccccgttcgggtacccgttacccttccggttacccgttaccccctaccccgtacccttaccgtaacccggtaaccgttacggttacctaccgggtacggtaacgggtcccggggtacggtacggccgggaacggcggtaaccg

SEQ ID NO: 261551 - DNA, 669 bp, Homo sapiens
  misc_feature: GYAE6OF01BJH7C.9.86.H09.1.454.CMB.1.raw
  modified_base (653)..(653): a, c, t, g, unknown or other
  misc_feature (653)..(653): n is a, c, g, or t
tcagtgatacgtctcacgaccggtgctcgatttagtgctatagacttgggtttggggggggtcacaagaggcagcgctctcgggacgtctccaccatggcctgggctctgctgctcctcaccctcctcactcaggacgcaggtcctgggcccagtctgccctgactcagcctgcctccgtgtctgccgtctccgtggacagtcgatcaccatctcctgcacgtggaaccagctagttgggtactttttaacctgtctcctcggtaccaacaccaccaggaccaaacgaccccaaactcatagtatttagagagtacaacgtaacgccggtcccgtagggtactttcgtgctcgtcttctcgtcggctaccgtaacgtcgtaccaaccgtccggtcctaccctacgaactacgttcctccgtcgggtcctaccgacgtacgtaggacggacgtacggtctactagtttacgttacgtcgttacgtctactagttactacgtacggttagttaaggtttggttacgggttcgggttacgggacgggtaacgggacgtaacggtcgtaccggtaccgtccgtacggtaccgaacggcccgtaacggtccgttcccgccccgttcggtcccttaccgtcccgttacccgttaccccnccccgttccgtacccg

SEQ ID NO: 261552 - DNA, 531 bp, Homo sapiens
  misc_feature: GYAE6OF01D1S72.9.86.H09.1.454.CMB.1.raw
  modified_base (262)..(262): a, c, t, g, unknown or other
  misc_feature (262)..(262): n is a, c, g, or t
  modified_base (425)..(425): a, c, t, g, unknown or other
  misc_feature (425)..(425): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaacgccccaaatcatgatttangaagtcactaagcggcctggggattctgctcgcttctctggctcaagtccgtcaacacggcctcctgacatctctggctccagactgaggacaggctcatttattactgttcgctcattatacgaggttagtaagtgttgggtgttcgggcggaggacagcgngtaccgtctaggcacgccgaacggctcgccccgtcggtcactcgttccgttcccacccttcctacacgtacgtactccgactggacgcgggactggacgagcgacg

SEQ ID NO: 261553 - DNA, 800 bp, Homo sapiens
  misc_feature: GYAE6OF01COOMG.9.86.H09.1.454.CMB.1.raw
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcagttgggtagtttttaaccttgtctcctggtaccaacaccacccaggaccaaacgacccccaaatcatgaattttatagtaagtacaacgtaacggccggcccgtcggggtatttctgtccttcgtctttctcgtcggcctaccaacggttcccgtaccaaccgaccggtccctcccgtacgaactaacgttcctcgtcgggcctaccgaagtacgtacgggaacggaccggtacggtaccttactaacgttttaacgtttaccgtttggtttacgtaccttactaagttaacgtaaccggttagggttaagggtttaaagggtttagggtttggggggtttacggttaccgggggacggggtaaccggggaaccgtaacgggtccggttacgggtaaccccggtttacggtacgggttaccgaacccggtaccccggtaacgggtccccgttccccggtacccccccggtttcgggttaacccctacccgttccctttccccggttacccccctaccccgtttcccgtaaccgtaccggtaaccgttacctaccgtacggttcggacgggtcccgggtacgttaggggacgtaacgggcgtaacg

SEQ ID NO: 261554 - DNA, 793 bp, Homo sapiens
  misc_feature: GYAE6OF01DV022.9.86.H09.1.454.CMB.1.raw
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggacgttttaacctgtctcctggtaccaaccaccacccgaggaccaaacgcccccaaactcatgatttatagaagttcaacgtaacggccgggcccgttacgggggtacttttcgtcggtccttccggtcttttcctccgttcgggtccttacccgaacggttcccgtaccgaaccgacccgggtcccctacccctaggaaccaactcctcgtcggaccttccgaagtaccgtggaacgggacgtcggtctactatttattaccttgttacgtctataacttagtaacgtaggggttaaggttaaacggtttaggtttcgggggttcggttaccggggtacgggggaacgggtaacccgtaagtcccgttacgggtacccgttaccggttacgggaccaaccggtaccccgtaaacggtccgttaccccggtcccccggttccggttaaccgtcccgtttcccggtttacccttaccccccgtaaccccgttcccgttaccgaacccggttaaccgttaccgttacccgtaccggtagggtaacccggggtccggggttacccggagggtaacccgggtaagggccgttaaacgg

SEQ ID NO: 261555 - DNA, 579 bp, Homo sapiens
  misc_feature: GYAE6OF01BULGZ.9.86.H09.1.454.CMB.1.raw
  modified_base (261)..(261): a, c, t, g, unknown or other
  misc_feature (261)..(261): n is a, c, g, or t
  modified_base (337)..(337): a, c, t, g, unknown or other
  misc_feature (337)..(337): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggtattttaaccttgtctcctggtaccaacaccaccaggcaaacgccccaaatcatgatttangaagtcactaagcggcctcggggatttctgctcgcttctctggctccaagtccgtcaacacgcctcctgacatctntcggctcagacctgaggacgaggctcaatttattactgtttacgctctatatacgtaggtgtaagttaggtttgggtgttacgggcgggaggccaaggctagaccgtcgtaggtcaacgcccaaggcctcgccccctcggtccaccttccgtacgttccccgcccctccgtcgtaacgtaccggttacttccgacgtacgggacggtccgggggcttcggggaccgaagggtccgtaaccgg

SEQ ID NO: 261556 - DNA, 619 bp, Homo sapiens
  misc_feature: GYAE6OF01CV0IS.9.86.H09.1.454.CMB.1.raw
  modified_base (230)..(230): a, c, t, g, unknown or other
  misc_feature (230)..(230): n is a, c, g, or t
tcagtgatacgtctcacgaccggtgctcgatttagtgctatagacttggggtttgggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccngcagttgggattttactgtctctgtacaacaccaccaggacaaacgccccaaactcatgtatttatagaagtcacgtaacggccggcccgtcggggtactttcgtgtctcgtcttctctggctccaacgtccgtacaacaccggcctccctacgacaatcctcgtcgggctccgagtacgtggacggacgaggctctatttattacgtgttcgctacatatacgtaggttagttaaggttaggttgggttggttcgggacgggtacgggaaccgtaagtcgtacggtaccggtccgtacgggtccgacggtacccgaaggtccgtcccggtcccccgttcggttcctacccgttcgttacccggtttcccccgtcccgttcccgtaccg

SEQ ID NO: 261557 - DNA, 515 bp, Homo sapiens
  misc_feature: GYAE6OF01BVN9T.9.86.H09.1.454.CMB.1.raw
  modified_base (458)..(458): a, c, t, g, unknown or other
  misc_feature (458)..(458): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaagcccccaaactcatgatttatgaagtcactaagcggccctcggggatttctgctcgcttctctggctccaagtccgtcaacacggcctcctgacaatctctggctcagactgaggacgaggctcattattactgttgctcatatacaggtgtaagtagttgggtgttcggcggaggacagctgaccgtctagtcacgccaggctcgcccctcggcnctctcgttccaccctcctcgacgtacgtatccacgtgacgcgggctggcaggcgacg

SEQ ID NO: 261558 - DNA, 678 bp, Homo sapiens
  misc_feature: GYAE6OF01BAKVU.9.86.H09.1.454.CMB.1.raw
tcagtgatacgtctcacgaccggtgctcgatttagtgctatagacttggggtttgggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactcggaaccagctagttgggtactttttaacctgtcctccgtacgtaaccaaccaccacccaaggaccaaaccgaccccaaatcatgtatttagagaatccacgtaacggccggtcccgtgggtacttcgtgtccgtcgtcttccgtcgtcggtacctaccgtaacgtccgaccaaccgtccggtccctaccgtcgtaacctacgtccgtcgtcggtacctaccgaggtacgtacgggaaccggtacgtacggtaccttacttaactttacgttacgttcgttacgtcgttaactaacgtacgttaacggtagggttacgttaggttagggttcggggtacggttacggggacggtaacggacgtaacgtcgtacggtaccgtcgtacgtaccgcggaccgtacggcctcccgtacccgtcgtacccgtctcccttacccgcctacctcgtaaccgg

SEQ ID NO: 261559 - DNA, 652 bp, Homo sapiens
  misc_feature: GYAE6OF01BXF1Y.9.86.H09.1.454.CMB.1.raw
  modified_base (210)..(210): a, c, t, g, unknown or other
  misc_feature (210)..(210): n is a, c, g, or t
  modified_base (299)..(299): a, c, t, g, unknown or other
  misc_feature (299)..(299): n is a, c, g, or t
tcagtgatacgtctcacgaccggtgctcgatttagtgctatagacttggggtttgggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctctggacagtcgatcacntctctgcactggaaccagctagttgggtacttttacctgtctcctggtaccaacaccaccaggcaaacgccccaaactcatgtatttanagaagtcaactaaggccggtcccgtgggactttctgcctcgtctttctctcggtctaccgaagtcccgtacaaccaccggtcccttcccgtgaacctaacttctccgtcgggcctccgagtacgtacggacggacggacgtcctactatttattacgttgttactctactatacgtacgtaggttagtaaggttggtttgggtggttacgggtcgggaacgggaccgtaaggtccgtacggacccggttccgtacgggtaccgaccgacccggtaacggcccttcccggtccccccgtcggttaccctacccgtttcctccggtttacccccctacccgtcccgttaacccgg

SEQ ID NO: 261560 - DNA, 736 bp, Homo sapiens
  misc_feature: GYAE6OF01D5DPV.9.86.H09.1.454.CMB.1.raw
  modified_base (192)..(192): a, c, t, g, unknown or other
  misc_feature (192)..(192): n is a, c, g, or t
  modified_base (263)..(263): a, c, t, g, unknown or other
  misc_feature (263)..(263): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccngcagttgggtattttaaccttgtctcctgtaccaacaccaccaggacaaacgccccaaatcatgtatttangaagtcacgtaagccggccgtcgggtatttctgctcgtctttctcgtggcctccgtaacgtccgtaccaaccaccggtccctccctagaactaacttccgtcgtcgggccttaccgagtacgtggacggacggacgtcttactaatttacttacgttcgttcgtaccttactaacttaacgttaaccgtagggtttaaggttaaacgggtttaggggttttacgggggttcggtttacccggggaacggggtaacgggtaacccgtaaaggtccgttaccggtacccggttaccgtaacgggttacaccgggtacccgtaacgggtcccttacccggtcccccgttaccggtcccttacccgttccgttccccggttcccccgtacccccgtccgttaccgacggttaccgttacgttccgaccgttgggaccgggtccggggtaccgttacgggacgtaacgggcgtaacgg

SEQ ID NO: 261561 - DNA, 689 bp, Homo sapiens
  misc_feature: GYAE6OF01DCT03.9.86.H09.1.454.CMB.1.raw
  modified_base (296)..(296): a, c, t, g, unknown or other
  misc_feature (296)..(296): n is a, c, g, or t
  modified_base (327)..(327): a, c, t, g, unknown or other
  misc_feature (327)..(327): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccaccaggacaaacgcccccaaactcatgatttatagaagtcaactaagccggccgtcgggatttcngctcgcttctctgctccaagtccgtacaacncgcctcctgacatctcgtcggctcagactgaggacgaggtctactatttattacgtgtttcgcttacgaattaacgtacgtagggttaggttaaaggtttagggtttggggttcggtttacggggaccggggtaacggggtaacccgtaaggtccgttacggaaccccggtttccgtaacgggttaccgaacgaccccgtaacgggtcccgttacccggtccccccgttcgggttaccctacccgttcccgtttacccggttccccccgtcccccttaccgtacccggtaacgtacccggttactccgtaaccgtcggaaccgggtccggggtacgtacgggaccgtaacgggccgtaaccg

SEQ ID NO: 261562 - DNA, 511 bp, Homo sapiens
  misc_feature: GYAE6OF01BV1EL.9.86.H09.1.454.CMB.1.raw
  modified_base (316)..(316): a, c, t, g, unknown or other
  misc_feature (316)..(316): n is a, c, g, or t
  modified_base (365)..(365): a, c, t, g, unknown or other
  misc_feature (365)..(365): n is a, c, g, or t
  modified_base (405)..(405): a, c, t, g, unknown or other
  misc_feature (405)..(405): n is a, c, g, or t
  modified_base (412)..(412): a, c, t, g, unknown or other
  misc_feature (412)..(412): n is a, c, g, or t
  modified_base (415)..(415): a, c, t, g, unknown or other
  misc_feature (415)..(415): n is a, c, g, or t
tcagtgatacgtctcacgaccggtgctcgatttagtgctatagacttgggtttgggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcattgggattttaacctgtctcctggtatcaacacgcccagacaaagcccccacactcttaattatgaggtcactaagcggccctnacggggtttctggtcgtcttctctgcctcaagtctgcaacacgcctccngacatctctggctccagtctgacgcgaggctgattatacngcagctnatntgctagttcgttcttcttcaagtattagtcggcggacggcaggcctggcccgtcgtgacgtcacgccccgagtccgtcgcccccttgcgcttcccg

SEQ ID NO: 261563 - DNA, 788 bp, Homo sapiens
  misc_feature: GYAE6OF01BAKM9.9.86.H09.1.454.CMB.1.raw
  modified_base (274)..(274): a, c, t, g, unknown or other
  misc_feature (274)..(274): n is a, c, g, or t
  modified_base (309)..(309): a, c, t, g, unknown or other
  misc_feature (309)..(309): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagctagttgggtacgttttaaccttgtctcctaggtaaccaaccaccacccaggaccaaacgaccccaaactcatgtatttanagaatcaactaaggccggtccgtcgggtactttcngtcctcgtcttctcgtcggcctaccgaacgtccgacaaccgcggtcccctacctcgaactacgttcctacggtcggcctaccgaagtaccgtagggacggacgtacggtcttacgtaattttacttacggttgttacgtaccttacgaatttacgtaacggtagggtttaggttaaagggtttaggggtttggggttaccgggtttaccgggggaaccggggtaacgggtaaaccgtaaggtcccggttaacggtacccggtttaccggaaccgggttccgaacccggtaccccgtaacgggtcccgtccccggtacccccggtttacggtcccctacggttccccgttaccccgggttccccccttccccgttacccgtaccggtaaccggttaacccgttaccgttaccgtaaccggttacggggaaacccgggtcgggttccccggaagggggacccaacgggggtccccgtaacg

SEQ ID NO: 261564 - DNA, 669 bp, Homo sapiens
  misc_feature: GYAE6OF01CJZ1S.9.86.H09.1.454.CMB.1.raw
  modified_base (274)..(274): a, c, t, g, unknown or other
  misc_feature (274)..(274): n is a, c, g, or t
  modified_base (335)..(335): a, c, t, g, unknown or other
  misc_feature (335)..(335): n is a, c, g, or t
  modified_base (380)..(380): a, c, t, g, unknown or other
  misc_feature (380)..(380): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctctggacagtcgatcaccatctcctgcacctcggacccaccactgattagttgggctattactaaccttgtctcctggtatcaacaaccgccagacaaacgccccacactacttaattangagtcactagccggcctcgaggggtttctggtctcttctctgcctcgaagtctggacaacnccggcctccagactactctgcggtctccagtctaggaccgacggnggtcttaggtaatttactacgtcgactacgtctactaagttctcggtacttaagggttttcgtttacccctttgtttaaccgaagttacgtttacggtttaccgggggaccggggtaacggggaaccctagggtccgttacccgggaacccgtttccgtaacgggaacggttacccaaccgggtaccccacgggtccccttacccggggccccccgtttagggtcccctaccgttacccgttcccgttccccctacccgttcccacggtacgtaaccttcgccgtacgg

SEQ ID NO: 261565 - DNA, 624 bp, Homo sapiens
  misc_feature: GYAE6OF01C1ZWM.9.86.H09.1.454.CMB.1.raw
  modified_base (406)..(406): a, c, t, g, unknown or other
  misc_feature (406)..(406): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagaattgggatttaaccttgtctcctggtaccaacaccacccaggcaaacgcccccaaactcatgatttatgaagtcaactaagcggtcccgtcggggtatttctgtcctcgtcttctcgtacggcctaccaagtccgtacaacaccggcctcccgtgactaactctcgtcggctccgagacgtgaggacgagcttacatttatacgtgttgctnatatacgaggtagtaagtaggttgggtcggttacgggacggtacgggaacctaacggcctacggtacccgtcgtacggtaccacggtacccgacggtcctcccgtccccgtacggtccaccgttccgtcccgttccccacccgttccgtacaacggtaccgttactaccgtcgtacggtacggccgggtacgtacggtaccgacgggccgcgtaacgg

SEQ ID NO: 261566 - DNA, 549 bp, Homo sapiens
  misc_feature: GYAE6OF01BE5N7.9.86.H09.1.454.CMB.1.raw
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccaccaggcaaacgccccaaatcatgatttatgaagtcactaagccggcctcggggatttctgctcgcttctctggctccaagtccgtacaacaccggccctccctgaccaactctcgtgggcctccgagactggacggacgaggctcatttattactgttcgctctatatacgaggtagtaagttaggttgggtgttcgggcgggaggaccgagctagaccgtctaggtcacgccaaggcctcgcccccgtgtccactcctcgttccccaccctctaccgacgtactactccactgacggcgggactggcaaggcgacg

SEQ ID NO: 261567 - DNA, 829 bp, Homo sapiens
  misc_feature: GYAE6OF01BKZAD.9.86.H09.1.454.CMB.1.raw
  modified_base (192)..(192): a, c, t, g, unknown or other
  misc_feature (192)..(192): n is a, c, g, or t
  modified_base (263)..(263): a, c, t, g, unknown or other
  misc_feature (263)..(263): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccngcagttgggattttaacctgtctcctcggtaccaacacccaccaggcaaacgcccccaaatcatgatttangaagtcactaagcggcccgtgggtattcgtgctcgtctttctctggcctcaacgtccgtacaaccgaccggcccttcccgtaggacctaacgtcctaccgtcggcctaccgagtacgtcggacggacgaacggcttacgtaagtttacttacgttggttcgtactactaacttaacgtaaccgttagggttacggttaaaggttacgggtttaggggttacgggttaccgggacgggggtaacgggtaacccgtaaggtccgttaccggtacccggtttaccggttaaccgggtaccgtaaccgggaccccggtaaacgggtccccgtttacccgggtccccccccggtttacgggttacccccgtaacccgtttccccgtttacccccgggtttaccccccgtaaaccccccgtttcccccgtaacccggtaaacccgggttaaaccccggttttaaccgttaccccggttaaaccccggtttacggggtaaaccgggggtacccggggggttacccggtttaaacccgggggaccgggtaaacccggggtcccggtaacccggg

SEQ ID NO: 261568 - DNA, 760 bp, Homo sapiens
  misc_feature: GYAE6OF01B93QB.9.86.H09.1.454.CMB.1.raw
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactaggaaccagctagtttggggtaattttttaaccttgtccttccgtacggtaacccaaccaccaacccgaggaccaaaaccgacccccaaaactcaattgtaatttagtagtaagtacaacgtaacggccgggtaccgtcggggtacttttcgtcgtctcgtctttctcgttggacctaccgaacgtaccgtaccaaacgtacccggtccttaccgtagaactaactccgttcgtacggcctacgaacgaaccgtagggaacggtaccggacggacttacgtaatttacgtttacgtgttacgtctactattaacgtacgtagggttagttaaggttagggtttcgggttagggttccggggaacgggtaaccgggaacgtaacggtcgtaccgggtaaccccgtagttaacggaccgtaaccgaccccggttaacggccctcccggtacccccgttcggtacctacccgttcccgtacccggttcccccgtccccttaccaccgtaacggttacccgacttacccgacggtgggtaccgggccgggtacgacggtaacgggacggttcgaaacgg

SEQ ID NO: 261569 - DNA, 739 bp, Homo sapiens
  misc_feature: GYAE6OF01EI8P0.9.86.H09.1.454.CMB.1.raw
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccattcctcctgcacgtacggaaccagctagtttagggttaactttttaccgttcgtccgtccgtacggtaacccaaccaacccgaacccgacggaccaaaaccgaccccctaaactcaacgttagttaacttttagacgtaaacgttaccgaaccgttaacggcccgggttacccgtacggggttactttccgtcggtccttaccgtctttccgtcgtcggtacctaccgtaacgtcctacgaccgccgtccctaccgtacaacgtacttcccgtaggtccgtcaccgagtacgtacggacggacgtaggccttaagtaactttacgttacgttcggttacacgttataattcgttaacgtagggtttaaggttacggtttaggggttcgggtacggttaccggggaccgggaacgggtaccgtagtccggtaccggtaccttacggtccgactacggaccgcggtaccgtcccgtaccgttcgactaccttcgtcctaccctccgtacaccggtagtaccgtcttacgacggtcggcggttcggaccgtacggaggccgacgtacg

SEQ ID NO: 261570 - DNA, 697 bp, Homo sapiens
  misc_feature: GYAE6OF01DGHO2.9.86.H09.1.454.CMB.1.raw
  modified_base (376)..(376): a, c, t, g, unknown or other
  misc_feature (376)..(376): n is a, c, g, or t
  modified_base (392)..(392): a, c, t, g, unknown or other
  misc_feature (392)..(392): n is a, c, g, or t
  modified_base (686)..(686): a, c, t, g, unknown or other
  misc_feature (686)..(686): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagctagttggggtaacgtttttaaccttgtcctccgtacggtaacccaaaccacccaaccgacggaccaaaaccgcccccaaaactcatagtaatttagtagaacgtacaacgtaacggccggtccgtcgggtactttcgcgcttcgtcttctcgtcgctccacggtcctacacgaccgcctccngactatctcgcggtcncgagcgtaggacggacgacgtctacttatttacttacttcgttcgtctactaactagtaacgtaggttaggttaaggttagggttcggggtggttcgggacgggtaacgggtacgacgtccgttcggtaaccgttacggtagtaccgaacggacccgacggtcccgtacccggtccccgttacgggttacctacccgttccgttccccgttaccccacccgttacccgtaccgtaacggtacccgttactaccgtaccggtcggacgggtcccggggtacgttcgggaaccggnggtacgtaacg

SEQ ID NO: 261571 - DNA, 1059 bp, Homo sapiens
  misc_feature: GYAE6OF01BKZW2.9.86.H09.1.454.CMB.1.raw
tcagtgatacgtctcacgaccggtgctcgatttagtgctatagacttgggtttgggggctttgcctgggctctgctgctcctcaccctcctcactcgaggacgcgacggggtccgtcgggcccagtctcgccctgacctcgacgccgtcgtccgttccggttcgtcgtgtccgttcctccgtcgggaacacggtcgactaccaacctacttcctcctcggacctaacggtaccgggaaaccaggtaccgtttaagggttttacggggtttaaaccgtttttttaacccgttcggtttacccgtttacccggttaaccggttaaacccccaaaaccccaacccccgaaaccccggaaccggggtaaaaccccctaaaaaccccggaacccccctaaaaacttcttaaacgttagtttaaacttttaaagtaacgtaaaccggttaaccgtaaacggttaacccggggtcccgggttacccggggttacggggtttacttttccggttcggtccgttaccgttccgttttccgtccggttaccgtaccttacccggttaaccggtacccgtaacccgtaacccggtccggttaccccttacccgaacgtaaaccgttaaccgttcccggtttaccggggacggtaccccgtaacgggtacgggtacggaacggggaaccgggacgggtacggtacgtttaagttaaccgtttacgtttaccgtcggttaccgtcgtacgttaacgtaagtttacggccggaagtttaagtacggggttacgtaaccgtaacccggttacccgggttccgggtttaacgggtaccgggggttaccggggaaccgggttaaaccggggtaacgtacccgggggttaaccgttccccgttaaaccggggtacggtaacccgtacccgggtaacggttaccccggtccgttaccccggtcccgtaacgttaccccgtcccgtttacccgttccccggtacccttacccggtacggttaaccacggttaaccctcgtacggttcgaaccggggtccgggaccggttggtaacccgg

SEQ ID NO: 261572 - DNA, 158 bp, Homo sapiens
  misc_feature: GYAE6OF01D1T7E.9.86.H09.1.454.CMB.1.raw
  modified_base (158)..(158): a, c, t, g, unknown or other
  misc_feature (158)..(158): n is a, c, g, or t
tcagtgatacgtctcacgaccggtgctcgatttagtgctatagacttgggtttggggctttgcctgggctctgctgctcctcaccctcctcactcaggacgcagggtcctgggcccagtctgccctgactcagcctgcctcgtgtctgcgtctccgtn

SEQ ID NO: 261573 - DNA, 986 bp, Homo sapiens
  misc_feature: GYAE6OF01A4MSV.9.86.H09.1.454.CMB.1.raw
tcagtgatacgtctcacgaccggtgctcgatttagtgctatagacttgggtttgggggctttgcctgggctctgctgctcctcaccctcctcactcacggacgcagggtcctgggcccagtctgccctgactcagcctgcctcgtgtctgcgtctcctggacagtcgatcaccatctcctgcactggaacccagctagttgggtacttttaacctgtctccgtacggtaccaaccacctacccgaggaccaaacggcccccaaaatctaagtcgtatttagtgaacgttcaacgttaacggccggacccgtacgggggtaactttccgtgcccgttccgtccgtttcgtccgttacggacccgttacccgaaccggtttacccgtaccgtaaacccgtacccgggtccccttaccccgtacggtaaaccctaaacttccgttaccggttaccgggacccttacccggaaggtaccgttagggaaacgggtaccggtacgggtacccttaacgtaacgtttttaacgttaaccgtttcggtttaccggtacttaccgtaaaccttttaacggtaaccgttaaacggggtttaaccgtttaaaagggtttacggggttttaacggggggttcggttttaaccggggggaaccgggtaaaccggggttaaacccgaaaacgggttccgtttaaccgggttaaacccccggttcgttaaaccggggtttacccgaacccgggtaaccccggttaaaaccgggttccccggttcccccggttaaccccccccgggtttcgggttaaccccccgttaaccgttttcccccgggttacccgtttaacccccccggtaccccgtttacccggttaacccggtaaacgggttaaacccgtttacggttaccccgtaaacgggtttcgggaaacccggggcccgggttacccggttaaacgggacccgggttaaaacggggccctttaaaacccgg

SEQ ID NO: 261574 - DNA, 695 bp, Homo sapiens
  misc_feature: GYAE6OF01BF1KN.9.86.H09.1.454.CMB.1.raw
  modified_base (266)..(266): a, c, t, g, unknown or other
  misc_feature (266)..(266): n is a, c, g, or t
  modified_base (686)..(686): a, c, t, g, unknown or other
  misc_feature (686)..(686): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgcccctgactcagcctgcctccgtgtctgcgtctcctggacagtcgatcaccatcctcctgcactggaaccagctagttgggtacgttttaccttgtctcctacggtaccaacaccaccgaggaccaaacgcccccaaatcatntattatagtaagtcaacgtaacgccggtcccgtcgggtatttcgtcgtctccgtacttcctcgtcggtcctaccgtaacgtcccgtacaacccgaccggtccctcctacgaacctacgtcctcgtcggcctaccacggtactaggacggtaacggcggtactactaagtttactaccgtttgttacgtacttacgaatttacgtaacgggtagggttaaggttaaggtttaagggtttcggggtacgttcgggggacgtaaccggggaactacgtcgttccgacggtttacccgaggtcgacggacccgtaaggcccgttccgtccccgttccggtacctccgttaccgttcccgtccccgttccctacccgtacgacggttactaactccgtacagggaccggccggtactcgggaacnggcggtaac

SEQ ID NO: 261575 - DNA, 716 bp, Homo sapiens
  misc_feature: GYAE6OF01DJTVP.9.86.H09.1.454.CMB.1.raw
tcagtgatacgtctcacgaccggtgctcgatttagtgctatagacgttggggtttgggggggggtcacaagaggcagcgctcgtcgggacgtctccaccatggcctgggctctgctgctcctcaccctcctcactcaggacgcgagggtcctgggcccagtctgccctgactcagcctgcctcgtgtctgcgtctccgtggacagtcgatccacctatcctcctgaccacgtacggaaccagctaggtttacggggtactttttaacctgtcctccgtacggtaacccaaccacccacccgaggaccaaaccgaccccctaaagtcagtacgttaatttagagtaacgtacaacgtaacggcccggtaccgttagggtactttcgcgtcctcgtcttcgcgtcgtctacgtacgtccgacacgtccgtcctacctagactagtccgtcgtcggcctacgagtacgtcggaacggacgtacgtcttacttaactttacgtacgtttcgtcgtaccttagtaacttacgtaacggtagggtttaacgttaagggtttcggttcggggttacggtacggggtaacggacggaaccgttaaggtccgtacggtaacccgttcgtacggtaccgaaccggtaccgtaacggttcccgtcccggtaccccgttggtacccttaccgttacccgttcccgtaaccccctccgtaccgtaccgg

SEQ ID NO: 261576 - DNA, 819 bp, Homo sapiens
  misc_feature: GYAE6OF01A5QSX.9.86.H09.1.454.CMB.1.raw
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctcgtgtctgcgtctcctggacagtcgatcaccatctcctgcacgtggaaccagctagtttaggggtaactttttaaccttgtccttccgtacggtaacccaaaccacccaacccgacggaccaaaccgacccccaaaactcaattgtaatttaagtacgtaagtaccaacgtaacggccgggtacccggttcggggtacttttccgtcggtccgttccggtcctttcgttccgtaccgggtacccttaccgtaacggttacccgtaaccgaacccgacccgggttccccttacccgtacgtaactaaccgttccgttccgtacgggtcctaccgtaagtaaccggtaggaacgggacgacggtacctacgtaacgtttactacgttgttcgacttactaacgttaacgttaacggtacgggttaaggtttaacggttaggggtttacgggttacgggtaccggggtaacggggaacggggtaaccctaacggtccgtaccggttacccgtacggtaacgggtccgtaaacgtaccccggaaccggtacccgtcccggttaccccgtccgggtaaccctacgttccgttaccccggtccccgttccctacccgttagacccgttaccgtactaccggacgtacggtccggtcgggtacgacgggaaccggacggtcgacg

SEQ ID NO: 261577 - DNA, 714 bp, Homo sapiens
  misc_feature: GYAE6OF01B8VPN.9.86.H09.1.454.CMB.1.raw
  modified_base (213)..(213): a, c, t, g, unknown or other
  misc_feature (213)..(213): n is a, c, g, or t
  modified_base (225)..(225): a, c, t, g, unknown or other
  misc_feature (225)..(225): n is a, c, g, or t
  modified_base (232)..(232): a, c, t, g, unknown or other
  misc_feature (232)..(232): n is a, c, g, or t
tcagtgatacgtctcacgaccggtgctcgatttagtgctatagacttggggtttgggggggggtcacaagaggcagcgctctcgggacgtctccaccatggcctgggctctgctgctcctcaccctcctcactcaggacgcgagggtcctgggcccagtctgccctgactcagcctgcctccgtgtctgcgtctcctggacagtcgatcaccntctcctgcacgnggaaccngctagttggggtacttttaaccttgtctcctcggtaaccaacaccaccaggaccaaacgccccaaatcatacgtatttatagaacgttcaacgtaacgccggacccgttacgggtatttcgtcgcttcgtcttcctcgtggtaccttccaaacgttccggtaccaaacgtccggtccctccgtagaacctaactccgttcgtcgggtaccttaccgaacgtacgtagggaacggacgacgggtccttaactaatttaatttacgtgtttcgacttacgaattaccgtaagtagggttagttaaggttgggttggggttacgttcggggacggaacgggttaccaacggtcgtacggtaccgtaccgtagggtacctaaccgggaccgtaaccgggttccgtcccggtaccccccgtttacggtaccccttaccgttccgtttaccccggtttacccccctaaccccgttccgttaaacccgg

SEQ ID NO: 261578 - DNA, 582 bp, Homo sapiens
  misc_feature: GYAE6OF01A1D17.9.86.H09.1.454.CMB.1.raw
  modified_base (271)..(271): a, c, t, g, unknown or other
  misc_feature (271)..(271): n is a, c, g, or t
  modified_base (308)..(308): a, c, t, g, unknown or other
  misc_feature (308)..(308): n is a, c, g, or t
  modified_base (507)..(507): a, c, t, g, unknown or other
  misc_feature (507)..(507): n is a, c, g, or t
  modified_base (529)..(529): a, c, t, g, unknown or other
  misc_feature (529)..(529): n is a, c, g, or t
  modified_base (540)..(540): a, c, t, g, unknown or other
  misc_feature (540)..(540): n is a, c, g, or t
  modified_base (571)..(571): a, c, t, g, unknown or other
  misc_feature (571)..(571): n is a, c, g, or t
  modified_base (576)..(576): a, c, t, g, unknown or other
  misc_feature (576)..(576): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctccgtggacagtcgatcaccatcctcctgcactggaaccagcagttgggtagttttaaccttgtcctcctggtacccaaccacccacccaggcaaacgcccccaaactcatgattanagtaatcacgtaacgccggcccgtcggggtactttcngtctcgtcttctcgtcggctccgaacgtcccgtacaaccgtaccggcccttccccgtagacctaactccgtaccgtcggccctaccgagtaccgtggacggacgacggtcttacctatttagttctgttgcctctatatacgaggttgtaagttgggttgggtcgtcggacgggaggacacgcgtccgacgtcgtagcncgccaggtcctcgcccgtgccnctctcgtcccncctctcgagtctatcacgtgacggtcggcgngacgngccgta

SEQ ID NO: 261579 - DNA, 663 bp, Homo sapiens
  misc_feature: GYAE6OF01B7SJN.9.86.H09.1.454.CMB.1.raw
  modified_base (172)..(172): a, c, t, g, unknown or other
  misc_feature (172)..(172): n is a, c, g, or t
  modified_base (211)..(211): a, c, t, g, unknown or other
  misc_feature (211)..(211): n is a, c, g, or t
  modified_base (215)..(215): a, c, t, g, unknown or other
  misc_feature (215)..(215): n is a, c, g, or t
  modified_base (231)..(231): a, c, t, g, unknown or other
  misc_feature (231)..(231): n is a, c, g, or t
  modified_base (302)..(302): a, c, t, g, unknown or other
  misc_feature (302)..(302): n is a, c, g, or t
tcagtgatacgtctcacgaccggtgctcgatttagtgctatagacttggggtttgggggggggtcacaagaggcagcgctctcgggacgtctccaccatggcctgggctctgctgctcctcaccctcctcactcaggacgcagggtcctgggcccagtctgccctgactcancctgcctcgtgtctgcgtctcctggacagtcgatcaccntccncctgcacgtggaaccngctagttgggtacttttacctgcctcgtgtaaccacaccaccgagaccaacgaccccaatcatatatttanagaagtacacgtaacgccggtccgtacgggtactttcgcgcttcgtcttctcgtcgtctacgaacgtccgtacgaaccgccggtccctacctgaactacttccgtacgtcgggtctaccgagtacgtacggaggacggtacgtccttaataactttatacgttgttactactactattacgtaacgtagggttagttaaggttgggttagggttcggtacgggagggtaaccgggtaactacgggtcgtacgtacccggtacgtacggtaacgtaccgacccgtaagggcccctttcccggacccccgtttgtacccgtaccgttccgtttacccccgtccccgtaccccttccgttaccg

SEQ ID NO: 261580 - DNA, 715 bp, Homo sapiens
  misc_feature: GYAE6OF01AO5CW.9.86.H09.1.454.CMB.1.raw
  modified_base (186)..(186): a, c, t, g, unknown or other
  misc_feature (186)..(186): n is a, c, g, or t
  modified_base (226)..(226): a, c, t, g, unknown or other
  misc_feature (226)..(226): n is a, c, g, or t
  modified_base (650)..(650): a, c, t, g, unknown or other
  misc_feature (650)..(650): n is a, c, g, or t
tcagtgatacgtctcacgaccggtgctcgatttagtgctatagacttgggtttggggtacgatttgatgttacctgatgcttagaggtcttttcctggaagcagggcatttgttgcttcagcaccgtagtgcctcgtcatcacgcctcagtcctttgtattttccggatttcgcctaggaaaaccngcctacacgacttaaaccgggacaaccgtcgcccgcaacntacgccttcctcccgtccccttgcagtaacaccaagtacagaatactacctgttccatcactacgcttcgcctcgccttagggcactcacctcgcccgtattacgtgacacggtaccttgtctcggcgagccggtctttcaccgttcttatcgttactagtcgtcagtctacttcgactacgtttcacgtactaccctccagtcctagtccgaccctacacgacgtacccaccgtaccttccgaacgacggttacccttaaacgacccggtaaccctcccccttaacccccgtaaccgaaaccctaaaccgtaccgtaaacgttaaccggcccgttaccggtcgtacccggtcccaccgacggtttcccgttaccgggtcgtaccgttcggttttacccgggtttacccttacccccggttttnaccccgtttccccgttacccggtaccctaacggttccctaaacgggtaacccgttccggttaccc

SEQ ID NO: 261581 - DNA, 573 bp, Homo sapiens
  misc_feature: GYAE6OF01BAVDL.9.86.H09.1.454.CMB.1.raw
  modified_base (219)..(219): a, c, t, g, unknown or other
  misc_feature (219)..(219): n is a, c, g, or t
  modified_base (232)..(232): a, c, t, g, unknown or other
  misc_feature (232)..(232): n is a, c, g, or t
  modified_base (250)..(250): a, c, t, g, unknown or other
  misc_feature (250)..(250): n is a, c, g, or t
  modified_base (283)..(283): a, c, t, g, unknown or other
  misc_feature (283)..(283): n is a, c, g, or t
  modified_base (319)..(319): a, c, t, g, unknown or other
  misc_feature (319)..(319): n is a, c, g, or t
  modified_base (387)..(387): a, c, t, g, unknown or other
  misc_feature (387)..(387): n is a, c, g, or t
  modified_base (460)..(460): a, c, t, g, unknown or other
  misc_feature (460)..(460): n is a, c, g, or t
  modified_base (491)..(491): a, c, t, g, unknown or other
  misc_feature (491)..(491): n is a, c, g, or t
tcagtgatacgtctcacgaccggtgctcgatttagtgctatagacttggggtttgggggggggtcacaagaggcagcgctctcgggacgtctccaccatggcctgggctctgctgctcctcaccctcctcactcaggacgcagggtcctgggcccagtctcgccctgactcagcctgcctcgtgtctgcgtctcgtggacagtcgatcacctatctccngcactcggaaccngacagtgactgttcggtnacttaatactattcgtcctcgtacgtaccaacncaccaccgagacaaccgtcccaatcagtgtattagngacgtacaagtcgtccgtccgttcggtcgggtcctagtacgtcttcttcgtcgtcgtcctacgatcgnggaccacgtccgccctacgtcgccgttccgtacggtgcctagcgctggacgtagtcggagtacttgttacttntcgcatcgtacgtactagtcgacgtaccacnccgtaccagtactcgtaggtaaccggcggtacgaccgtcgtaccaccggtacgtacgaccacccgtaccgcccgtcctaccg

SEQ ID NO: 261582 - DNA, 784 bp, Homo sapiens
  misc_feature: GYAE6OF01DQHTD.9.86.H09.1.454.CMB.1.raw
  modified_base (183)..(183): a, c, t, g, unknown or other
  misc_feature (183)..(183): n is a, c, g, or t
  modified_base (230)..(230): a, c, t, g, unknown or other
  misc_feature (230)..(230): n is a, c, g, or t
  modified_base (311)..(311): a, c, t, g, unknown or other
  misc_feature (311)..(311): n is a, c, g, or t
  modified_base (339)..(339): a, c, t, g, unknown or other
  misc_feature (339)..(339): n is a, c, g, or t
tcagtgatacgtctcacgaccggtgctcgatttagtgctatagacttgggtttggggggggtcacaagaggcagcgctctcgggacgtctccaccatggcctgggctctgctgctcctcaccctcctcactcaggacgcagggtcctgggcccagtcctgccctgactcagcctgcctccgtntctgcgtctcctgaccagtccgatccacatctcctgacactggaccngctagttgggtattttaacctgcttacctggtaaccaaccaccaccgtacggaccaaaccgccccaaactcatcgtattangaacgtcactaacggccgccgttgggtnttcgtgacttcgtcttctgacggtcttaccgaagtcccgtacaaccgtcggtaccctccgtacacgtactcgtcgtacgggtacctaccgtaacgacggtcggtaaggaccgggttacggacctttaccggtaattttaaacgttttccgttacgttacgtaccgttacgttaaactacggttaaaccggttaacgggtttaaggttaaaacggggtttaacgggtttttccgggggtaacgggttttacccggggggacggggttaaaccggggaacccgttaaaacgggttcccggtttacccggtaaccccgggttaccgttaacgggtacccggtaacccgtaacccggggtaacccgggttccgtcccccggtacccccgtacgggttaccctacccgttccccgttacgggtttcccccccgtcttcccggtaaaccgg

SEQ ID NO: 261583 - DNA, 817 bp, Homo sapiens
  misc_feature: GYAE6OF01EFOIL.9.86.H09.1.454.CMB.1.raw
  modified_base (796)..(796): a, c, t, g, unknown or other
  misc_feature (796)..(796): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatccaccatcctcctgcacgtcggaaccagctagtttcgggttaactttttaaccttgtcctccgtacggtaacccaaccacccaaccccacggaccaaacccgacccccaaactcattagtatttagacgtaacgtacctaacgtaacggcccggtcccggtaggggttctttaccgtcgtccttcgtccttccgtcgtacggtcctaccgtacgtcccgtaccaaccgtcccgtccctcctacgtactacttcgtaccggtcggtacctaccgaacgtacggtaggaacgggacggtacgtaccttactttaagttttacgttaccgtttaggttacgtaccttacgtaatttaaccgtaacggttagggttaacggtttaagggttaggggtttaggggttcgggtacccggggaggggtaacccgggtaaccgtacgtccgtaccgggtacgttcccggtagacccgtaccggaaccccgtacggtccccgtcccggttacccccgttcggtaccctacccgttcccgtacccggttccccccgtacccgttaccgtaccgttaaccgtaccgttccgttacccgtacgggtacggtacccggggtccgttacgggaaacccggnggtaccccggggagtaaccgg

SEQ ID NO: 261584 - DNA, 769 bp, Homo sapiens
  misc_feature: GYAE6OF01E3YU1.9.86.H09.1.454.CMB.1.raw
  modified_base (571)..(571): a, c, t, g, unknown or other
  misc_feature (571)..(571): n is a, c, g, or t
tcagtgatacgtctcacgaccggtgctcgatttagtgctatagacttgggtttgggggggggtcacaagaggcagcgctctcgggacgtctccaccatggcctgggctctgctgctcctcaccctcctcactcaggacgcgagggtcctgggcccagttcctcgccctgactcagcctgccttccgtgtctgcgtcctccgtaggactagtcgactacaccgtactcctcctcgcctacgacggaaccagtacttaggttacgggttaacttttaccgttcgttcctccgtacggtaaccctaaccgaccctacccgaacgtaacccgaaaccaccccctaaatccgaacttgttaatttactacggaactcccgaaacgtaccgggacccggtccggtttacgggtatttccgatccgttacgtcctttccgtgtccgtcctacgaacgttcccgaacgaaccgcccgtcctacgtaacgaccctacttcgtaccggttgaccgttaccaacggtaccgtaggaccggtacgagttaccttattaacgtttacgttacgttacgggtttnaaccggtactaacgttacgttcggtaaggttaaggttaggttcgggtttaggggtacccggtttaggggacggaacggtaaccggtaacgtccggtacgtaccggttaccgtacgtacgaccggtcccgtagtcccgtacccgtcccgtcggttaccctccggttttaccaccccggttcccgtacccctccgtaacg

SEQ ID NO: 261585 - DNA, 670 bp, Homo sapiens
  misc_feature: GYAE6OF01C4K4R.9.86.H09.1.454.CMB.1.raw
  modified_base (244)..(245): a, c, t, g, unknown or other
  misc_feature (244)..(245): n is a, c, g, or t
  modified_base (440)..(440): a, c, t, g, unknown or other
  misc_feature (440)..(440): n is a, c, g, or t
  modified_base (520)..(520): a, c, t, g, unknown or other
  misc_feature (520)..(520): n is a, c, g, or t
tcagtgatacgtctcacgaccggtgctcgatttagtgctatagacttggggtttgggggggggtcacaagaggcagcgctctcgggacgtctccaccatggcctgggctctgctgcctcctcaccctcctcactcgaggacgcgagggtcctcgggcccagtctcgccctgactcagcctgcctccgtgtctcgcgtctcctggacagtcgactccaacctactctcctgacacgtcggaaccnnctagtttggtacttttactgtctctacgtaaccaacaccaaccgagaccaaaccgaccccaaagtcactagtaatttagacgaacgtacaacgttaacggccggtaccgttcgggtacttttcgcgcgttaccgtcttcgtcgtacgtccttaaccgtacgttacccgaccaaccgtacccgtacctacccgtanaacctacgttcctcggtaccggaccttacgacgtagtacggaacgggactaggtcttagtaactttacttacgtgttacncttagaactgttacgtaaggttacgttaaggttcggttggtacggtacggacggacgtactacgtcgtaccgttccgtagacgtacgaccgtacgaccgtcgtccccgtccgtactaccgtacttcccgtcttaccccgcctacgtaccg

SEQ ID NO: 261586 - DNA, 838 bp, Homo sapiens
  misc_feature: GYAE6OF01E4VKL.9.86.H09.1.454.CMB.1.raw
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcacgcggaaccagctagttgggtactttttaaccttgtcctcctcggtaccaaccacccaacccgaggaccaaaccgacccccaaactctaatgtatttagtagaacgtcaacgtaacgcccggtcccggttacgggttactttcgtcgccttccgtctttccgtactcggtccttaccgaacgttccccggtacaaccgtaccggtcccctccgttacgaacctacgtccgtaccggttcgggacctacccgaaggtaccgtagggacgggacgacggtccttacgtagttttaacgttattcggtttacgacttactaagtacgttacgtagggtttaacgttaaaggtttcggggtttggggttaccgggttacggggaccgggggtaaccgggtaaccgtaacggtacccggttacgggtacccccggttaccggtaaccgggttaccggaacccggtaccccggaaacggttcccgggttaccccggttaccccccggtttaccggtttcccttacccggtttcccggtttaccccggtttcccccccgttaccccgttccccgttaaccggtaacccggtaaccgttaaccctaccggtacggttacgggaccggtccggggtacgtaccgggaccgtaaccggccgtacg

SEQ ID NO: 261587 - DNA, 718 bp, Homo sapiens
  misc_feature: GYAE6OF01A20NV.9.86.H09.1.454.CMB.1.raw
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
  modified_base (269)..(269): a, c, t, g, unknown or other
  misc_feature (269)..(269): n is a, c, g, or t
tcagtgatacgtctcacgaccggtgctcgatttagtgctatagacttggggtttggggggggggtcacaagaggcagcgctctcgggacgtctccaccatggcctgggctctgctgctcctcaccctcctcactcaggacgcagggtcctgggcccagtctgccctgactcagcctgcctcgtgtctgcgtctccgtggacngtcgatcaccatctcctgcactacgaccngctagttgggtacttttacctgtcctccgtgaccaacnccaccaggaccaaacgaccccaatcatagtattagacgaagtcacgtaacggccggtaccgtggggtactttcgcgtacctcgtctttcgtcgtcggactaccgtaacgtccaaccgtaacgccggtcctccgtagtaaccactttcgtcgtacgggtcctaccgaggtacgtacgggaacggtacggtcgacctttactaatttacgttacgttcggttacgtcctaactacgttacgtaacggttaggttaagttaacgggttaggtttacgggggggttcgttacggggtaccggggacgtaaccgggtacgtaccggtacggtaacccggttcgtacggtaccgtaccggtaacccggtaaggtcccggttacccgtcccccggttcgtacccgtaccgttacccgtttaccccgttacccccgttccgttacccgttaacccgg

SEQ ID NO: 261588 - DNA, 794 bp, Homo sapiens
  misc_feature: GYAE6OF01AL3YC.9.86.H09.1.454.CMB.1.raw
  modified_base (194)..(194): a, c, t, g, unknown or other
  misc_feature (194)..(194): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatcctcctcgcactggaaccngctagttgggtagttttaaccttgttcctccgtcggtacccaaccaccacccgacggaccaaaccgacccccaaaactctaatcgtaattttaagagtaacgtccaacgttaacggcccgggtcccttcgggggtattttccgtggtccttccggtcctttctcgtcggtcctaccgtacggttcccgtaccaaacccgtccccggtcccttaccccgtagaacctaacgttcccttccggtcggtccctacctaagaccggtaggacgggacggtacgtcgttacttaacgtttatttccgtagtttcgtactctaactacgttaacgtaggggtttaacgttaagggttagggtttacggggtcgggttaccgggtacggggggtaaccgtaaccggtaacgtccggtaccggtcccggttacccggttacgggacctaaccgacccggttaaccgggtccccgttccccggtacccccggtttcgggtacccttacccggttcccgttcccgttccccggtaccccgttacctacccgtaacgtccgtttaacgtccgaccggttcggcggtacggtcggaccgtaggcggctacgg

SEQ ID NO: 261589 - DNA, 688 bp, Homo sapiens
  misc_feature: GYAE6OF01BUXD1.9.86.H09.1.454.CMB.1.raw
  modified_base (446)..(446): a, c, t, g, unknown or other
  misc_feature (446)..(446): n is a, c, g, or t
  modified_base (509)..(509): a, c, t, g, unknown or other
  misc_feature (509)..(509): n is a, c, g, or t
tcagtgatacgtctcacgaccggtgctcgatttagtgctatagacgttggggtttggggggggggtcacaagaggcagcgctctcgggacgtctccaccatggcctgggctctgctgcctcctcaccctcctcactcgaggacgcagggtcctcgggcccagtctcgccctgactcagcctcgcccttccgtgtcctgccgttccgtccgtaggacagtacgatccacctatctcctgacacgtacgaaccagcgtagttggttaacgttttaccttgtcctcgtacgtaaccaacacccgaccgaagaaccaaaccgacccctaaatcgtatagtaattagagaactctaacgtacgccggtcccgtggttacttcgcgtacttcgtcttaccgttgtccgtaccctacgtaacggtcccaacgtaaccgcccgtcctaccgganactaacttcgtacgtcgctaccgagacgtaggacgcgtagtactattacgttatcgtgttacncttatatagtacgtaggtgttaaggttggtagggttaccggacgggtacggaaacggtcgaacgtcgttaaccgtccggtaccgttacggaccgtaaccgccgtacggcccttcccgggtccccttacgggtaccttacccgttcccgttacccctaaccccctcccgttcgtaaccgg

SEQ ID NO: 261590 - DNA, 699 bp, Homo sapiens
  misc_feature: GYAE6OF01B539Q.9.86.H09.1.454.CMB.1.raw
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagctagttgggtacttttaaccttgtctcgtagtaccaacaccaccaggacaaacgaccccaatcatgtattatagaacgtacacgtaacggccggccgtcggggtatttcgtcgtcctcgtcttctcgtcggtcctaccgacggtccgtacaaccgaccggtccctacccgtacgacctaacgtcgtccgtcggtacctaccgaggtcgtagggacggacggacggtctacgtaatttacgttacgtgttacgtctacgtacttaagtacggtacggttagttaagggtttagggttcggggttcggtacggggacgggtaacgggtaccgaggtaccgtacggtacccgttacgtacggacgaccgtaccggacggtccgttccgtaccccgtcgtaccgtaccttccgttacccgttcccctaccgttcccgtacgtaaccgtacgttacgtccaccgggtacggacggtacccgggttcgaacgggacgtaacgggtcgtaacg

SEQ ID NO: 261591 - DNA, 771 bp, Homo sapiens
  misc_feature: GYAE6OF01EVDED.9.86.H09.1.454.CMB.1.raw
  modified_base (191)..(191): a, c, t, g, unknown or other
  misc_feature (191)..(191): n is a, c, g, or t
  modified_base (703)..(703): a, c, t, g, unknown or other
  misc_feature (703)..(703): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctctgcactggaaccngtcgtagttgggtacgttttaaccttcgtccttaccgtcggtacccaaccaccaccgacggaccaaaccgaccccctaaagtcctagttacgtatttacgtagtaacgtacaacgtaacggcccggtccggtacgggttatttcctcggtcttccgtctttcgtcgtccggtacctaccgtaaccgtccgtaccaaccgtacccggtcccttacccagtaacctaacgttccgtccggttacggaccctaccgtagggtaaccgttacgggaaacgggtaccggaacggttccctttaaacgtaacgtttttagtttacgttgtttcgtacttactacgtttaactaacgggttagggtttaacgggttaaggggtttacgggtttggggttacgggttaccgggcggggtaaacggaccgtaacggtccgtacggtaccctcggtaggccgtaccgacggtaccgtccgtcccgggtacccttgccttaccgtccgttacccgttaccccnccgttaccgcgtaaccgttacgtctaccgtaggtccggaagggtcccggtagacggaccgtgccgtag

SEQ ID NO: 261592 - DNA, 512 bp, Homo sapiens
  misc_feature: GYAE6OF02IP911.9.86.H09.1.454.CMB.1.raw
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccaccaggcaaacgccccaaactcatgatttatgaagtcactaagcggccctcggggatttctgctcgcttctctggctccaagtccgtcaacacggcctcctgacaatctctggctccagactgagacgaggctcattattactgttgctcatatacaggtgtaagtagttgggtgtcggcggaggacaagctgaccgtctaggtcagcccaagctcgcccctcggtcactctcgttcccgcctctcgagacgtatcacgtgacgcgggctggcaggcgacg

SEQ ID NO: 261593 - DNA, 517 bp, Homo sapiens
  misc_feature: GYAE6OF02IQURA.9.86.H09.1.454.CMB.1.raw
  modified_base (316)..(316): a, c, t, g, unknown or other
  misc_feature (316)..(316): n is a, c, g, or t
tcagtgatacgtctcacgaccggtgctcgatttagtgctatagacttgggtttggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggattttaacctgtctcctggtaccaacaccacccaggcaaagcccccaaatcatgatttatgaagtcactaagcggccctcggggatttctgctcgcttctctggctccaagtccgtnaacacggcctccctgacaatctctggctccagactgaggacgaggctcattattactgtttgctcatatacaggtgtaagtagttgggtgttcggcgggtaggaccaagctgaccgtcctaggtcagacccgaaggctcgcccctcgtcactctcgttcccacctcctcagacgtatcacgtgacgcggctggcaggcacg

SEQ ID NO: 261594 - DNA, 515 bp, Homo sapiens
  misc_feature: GYAE6OF02FXUN2.9.86.H09.1.454.CMB.1.raw
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccaccaggcaaagcccccaaatcatgatttatgaagtcactaagcggccctcggggatttctgctcgcttctctggctccaagtccgtcaacacggcctccctgacaatctctgggctccagactgaggacgaggctcattattactgttgctcatatacaggtgtaagtagttgggtgttcggcggagggacagctgaccgtctaggtcagcccaaggctgcccctcggtcactctcgttcccgcctcctcagaccgtatcactgacgcgggctggcaggcgacg

SEQ ID NO: 261595 - DNA, 527 bp, Homo sapiens
  misc_feature: GYAE6OF02GDDOO.9.86.H09.1.454.CMB.1.raw
tcagtgatacgtctcacgaccggtgctcgatttagtgctatagacttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaacgcccccaaactcatcatttatgaggtcactaagcggccctcaggggtttctattcgcttctctggctccaagtctgacaacacggcctccctgacaatctctgggctcaggctgaggacgaggctgatttattactgctgctacaaaagaagtagccctctcgttggttttcgggcgggggaccaagggtcgaccgtctaagtcagcccaaggctcgcccctcggcactctcgtcccaccctcctcacgacgtatcactcgagcgggctggcaacggg

SEQ ID NO: 261596 - DNA, 562 bp, Homo sapiens
  misc_feature: GYAE6OF02GPDXN.9.86.H09.1.454.CMB.1.raw
  modified_base (449)..(449): a, c, t, g, unknown or other
  misc_feature (449)..(449): n is a, c, g, or t
  modified_base (510)..(510): a, c, t, g, unknown or other
  misc_feature (510)..(510): n is a, c, g, or t
  modified_base (522)..(522): a, c, t, g, unknown or other
  misc_feature (522)..(522): n is a, c, g, or t
tcagtgatacgtctcacgaccggtgctcgatttagtgctatagacttgggtttggggtacgatttgatgttacctgatgcttagaggctttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcggcttttcacccgctttatcgttacttatgtcagcattcgcacttctgatacctccagcatgcctcacagcacaccttcacnggcttacagaacgcctccctacccaacaacgcataacgcgtcgctgcccgcagcttcggtncagtgggttacnccccggtttcactcttcccgcctactctacgacgacgtac

SEQ ID NO: 261597 - DNA, 618 bp, Homo sapiens
  misc_feature: GYAE6OF02IZ12B.9.86.H09.1.454.CMB.1.raw
  modified_base (263)..(263): a, c, t, g, unknown or other
  misc_feature (263)..(263): n is a, c, g, or t
  modified_base (299)..(299): a, c, t, g, unknown or other
  misc_feature (299)..(299): n is a, c, g, or t
  modified_base (415)..(415): a, c, t, g, unknown or other
  misc_feature (415)..(415): n is a, c, g, or t
  modified_base (581)..(581): a, c, t, g, unknown or other
  misc_feature (581)..(581): n is a, c, g, or t
tcagtgatacgtctcacgaccggtgctcgatttagtgctatagacttgggtttgggggcgtttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaacctgtctcctggtaccaacaccaccaggcaaagccccaaaatccatcgatttangaagtcaacgtaagcggcccctacggggtactttcncgtcttcgtctttctcgtcggcctacctaagtcctgggcaaacgacggcctccctagacccattcctcgttgggccttcccggggctgggaagggtcgacggctcaacttattacngtacagctcaatactaacaaccagcgaacactcgttgttggttcggacggagggactaggaactcggacccgttcgtaggtccaacgtacccaagggcctcggccccctaggtcctacttcgttaccggttccccgccccttccgtacctaacggtaccgtttaancccgtagttccggacgggtccgggtctacgggaccgg

SEQ ID NO: 261598 - DNA, 520 bp, Homo sapiens
  misc_feature: GYAE6OF02I4QFP.9.86.H09.1.454.CMB.1.raw
  modified_base (326)..(326): a, c, t, g, unknown or other
  misc_feature (326)..(326): n is a, c, g, or t
  modified_base (357)..(357): a, c, t, g, unknown or other
  misc_feature (357)..(357): n is a, c, g, or t
tcagtgatacgtctcacgaccggtgctcgatttagtgctatagacttgggtttggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcattgggattttaacctgtctcctggtaccaacaccacccaggcaaagcccccaaactcatgatttatgaagtcactaagcggcctcggggatttcngctcgcttctctggctccaagtccgtcaacncggcctccctgacaatctctgggctcagactgaggacgaggctcattattactgttgctcatatacaggtgtaagtagttgggtgttcggcggagggaccaagctgaccgtcctaggtcagcccaggctcgcccctcggtcacgtctcgtcccgccctctacg

SEQ ID NO: 261599 - DNA, 716 bp, Homo sapiens
  misc_feature: GYAE6OF02F810E.9.86.H09.1.454.CMB.1.raw
  modified_base (297)..(297): a, c, t, g, unknown or other
  misc_feature (297)..(297): n is a, c, g, or t
tcagtgatacgtctcacgaccggtgctcgatttagtgctatagacttgggtttggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcattgggtagttttaacctgtctcctggtaccacaccaccaggcaaacgccccaaactcatgatttangaagtcaactaagcggcccgtcgggatttcgtgccttcgcttctcgtcggtcctaccaacgttccgtaccaaccgacccgggtcccttcccgtacgaacctaaacgttccgttaccgttcggggcctacccgaacggtaaccgttacgggaacgggaaccggtacgggccttaccgtaatttaactttaaccgtggtttcgtccttactaattacgtaacgtaggttaggttaaaggttaggttgggggttacggtttcggggacgggacggggtaaccgtaaggtcgttacggacccgttaccgtacgggtaccgaccgggtaccccgaacgggtcccgttaccggtacccccccgtttcgggttacccttacccgttccgttcccggtttcccccctaccccgtccccgttaaccgg

SEQ ID NO: 261600 - DNA, 528 bp, Homo sapiens
  misc_feature: GYAE6OF02GGWP1.9.86.H09.1.454.CMB.1.raw
  modified_base (482)..(482): a, c, t, g, unknown or other
  misc_feature (482)..(482): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaacgcccccaaatcatgatttatgaagtcactaagcggccctcggggatttctgctcgcttctctggctccaagtccgtcaacacggcctccctgacaatctctgggctccagactgaggacgaggctcattattactgttgctcatatacaggtgtaagtagttgggtgttcggcggagggaccaagctgaccgtctaggtcacgcccgaaggctcgcccctcgtccactcctcgttcccncctcctcacgactatccacgtgacggcgggctggacacggcgtacg

SEQ ID NO: 261601 - DNA, 527 bp, Homo sapiens
  misc_feature: GYAE6OF02H04VD.9.86.H09.1.454.CMB.1.raw
  modified_base (261)..(261): a, c, t, g, unknown or other
  misc_feature (261)..(261): n is a, c, g, or t
  modified_base (399)..(399): a, c, t, g, unknown or other
  misc_feature (399)..(399): n is a, c, g, or t
  modified_base (505)..(505): a, c, t, g, unknown or other
  misc_feature (505)..(505): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagtttttaaccttgtctcctggtaccaacaccaccaggcaaagccccaaatcatgatttangaggtcaataagcggccctctggggtccctgatcgcttctctggctccaagtctggcaacacggcctccctgaccgtctctcggctccgaggctgacgatgaggctgattatactgcagctcatatgcaggcacccanaatgtcttacggaagtcggaccacggtccaccgtccgtaggtccacggacccaacggcccaaccccgatcgtccactctcgttccccacctcctcacgtacgtacncacgtcgacggcggtctggacg

SEQ ID NO: 261602 - DNA, 558 bp, Homo sapiens
  misc_feature: GYAE6OF02H6XQQ.9.86.H09.1.454.CMB.1.raw
  modified_base (287)..(287): a, c, t, g, unknown or other
  misc_feature (287)..(287): n is a, c, g, or t
  modified_base (532)..(532): a, c, t, g, unknown or other
  misc_feature (532)..(532): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccaccaggcaaagccccaaatcatgatttatgaagtcactaagcggcctgggatttcngctcgcttctctggctccaagtccgtcaacaccggcctccctgacaatctctggctcagactgaggacgaggctcaatttattactgtttcgctcatatactaggtagtaagttaggttgggtgttcgggacgggacgggaccaagctcgtaccgtccgtaggtcacgaccgaaggcctccgcccccgttcgtcctactccgttccgttccccgccctccctcgacgtaccgttactccgtacgnggcggcggcgtacggcaacgggcacg

SEQ ID NO: 261603 - DNA, 513 bp, Homo sapiens
  misc_feature: GYAE6OF02G0QG1.9.86.H09.1.454.CMB.1.raw
  modified_base (324)..(324): a, c, t, g, unknown or other
  misc_feature (324)..(324): n is a, c, g, or t
  modified_base (464)..(464): a, c, t, g, unknown or other
  misc_feature (464)..(464): n is a, c, g, or t
  modified_base (481)..(481): a, c, t, g, unknown or other
  misc_feature (481)..(481): n is a, c, g, or t
  modified_base (489)..(489): a, c, t, g, unknown or other
  misc_feature (489)..(489): n is a, c, g, or t
  modified_base (494)..(494): a, c, t, g, unknown or other
  misc_feature (494)..(494): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggattttaacctgtctcctggtaccaacaccacccaggcaaagcccccaaaactcatgattttatgaagtcactaagcggccctcggggatttctgctcgcttctctggctccaagtccgtcaacncggcctccctgacaatctctggctccagactgaggacgaggctcattattactgtttgctcatatacaggtgtaagttagttgggtgttcggcggagggaccagctgaccgtctaggtcagcccaggctcgcccctgtcnctctcgtcccaccctcncagactanccacngacgcggctggcaggcgac

SEQ ID NO: 261604 - DNA, 538 bp, Homo sapiens
  misc_feature: GYAE6OF02GYSLW.9.86.H09.1.454.CMB.1.raw
  modified_base (304)..(304): a, c, t, g, unknown or other
  misc_feature (304)..(304): n is a, c, g, or t
  modified_base (325)..(325): a, c, t, g, unknown or other
  misc_feature (325)..(325): n is a, c, g, or t
  modified_base (394)..(394): a, c, t, g, unknown or other
  misc_feature (394)..(394): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaacgcccccaaactcatgatttatgaagtcactaagcggccctcggggatttctgctcgcttcnctggctccaagtccgtcaacncggccctcctgacaatctctgggctccagactgaggacgaggctcattattactgttcgctcatatacnggtagtagtagttgggtgttcggcggaggacagctagaccgtctaggtcacgaccaggctcgccccctcggtccactcgtccgttccccacccttcctcgacgtacctaactccactgacggcgggctcgggcgaacggcgacg

SEQ ID NO: 261605 - DNA, 517 bp, Homo sapiens
  misc_feature: GYAE6OF02JG77H.9.86.H09.1.454.CMB.1.raw
  modified_base (506)..(506): a, c, t, g, unknown or other
  misc_feature (506)..(506): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaacgcccccaaactcatgatttatgaagtcactaagcggccctcggggatttctgctcgcttctctggctccaagtccgtcaacacggcctcctgacatctctggctccagactgaggacgaggctcattattactgttgctcatatacaggtgtaagtagttgggtgttcggcggaggcaagctgaccgtctaggtcagcccaggctcgcccctcggtcactctcgttccccgcccttcctcacgactactcactgacgcgggcnggcaggcgacg

SEQ ID NO: 261606 - DNA, 691 bp, Homo sapiens
  misc_feature: GYAE6OF02GXMTA.9.86.H09.1.454.CMB.1.raw
  modified_base (676)..(676): a, c, t, g, unknown or other
  misc_feature (676)..(676): n is a, c, g, or t
  modified_base (683)..(683): a, c, t, g, unknown or other
  misc_feature (683)..(683): n is a, c, g, or t
tcagtgatacgtctcacgaccggtgctcgatttagtgctatagacttggggtttggggggctttgcctgggctctgctgctcctcaccctcctcactcagggaccgcagggtcctgggcccaggtctgccctgactcagcctgccctccggtgtctagcgtctcctggacagtcgatccaccatcctcctcgcactggaaccagctagttgggattttaacctgtctcctggtaccaacaccacccgaggacaaacgccccaaaatcatcgatttatcgaagtcaactaaagccggaccctacgggggacttttacgacgtccttaccgtctttcgtcgtcgtacctaccgtaacggttccctactaaccgtaccggtccctacccgtacggtaaccgtaacttcgtccggtacgggtccctaccgaacggtaccgtagggacggaacggtacggtacctacgtaatttacttacgttcgttcgtactactaattactacgtaggttaagttaaggttagggttcgggttcggtccgggacgggtaacggactaaggttcacgttaccgttcgtaggtcaccgaccgtaggtcctcccggtccccgttgtaccgtaccgttccgtccgtacccgtcccgtacgtacgaacgtacctctacacgtaggcggtcggtntcggacncggctacg

SEQ ID NO: 261607 - DNA, 630 bp, Homo sapiens
  misc_feature: GYAE6OF02JZCXJ.9.86.H09.1.454.CMB.1.raw
  modified_base (226)..(226): a, c, t, g, unknown or other
  misc_feature (226)..(226): n is a, c, g, or t
  modified_base (298)..(298): a, c, t, g, unknown or other
  misc_feature (298)..(298): n is a, c, g, or t
  modified_base (326)..(326): a, c, t, g, unknown or other
  misc_feature (326)..(326): n is a, c, g, or t
  modified_base (364)..(364): a, c, t, g, unknown or other
  misc_feature (364)..(364): n is a, c, g, or t
tcagtgatacgtctcacgaccggtgctcgatttagtgctatagacttgggtttgggggggtcacaagaggcagcgctctcgggacgtctccaccatggcctgggctctgctgctcctcaccctcctcactcaggacgcagggtcctgggcccagtctgccctgactcagcctgcctcgtgtctgcgtctcctggacagtcgatcaccatctcctgcactggaaccngctagttgggacttttacctgtctcctggtaccaataccaccaggacaacgaccccaaatcatcgtatttangagtcactaagcggtcctgggactttcngctcgtcttctcgtgctccaagtccacacgacgcctcngacactctcgtcggctacgagactaggacgtacgacggtcttacgtagttattacgtgtcgtactagtaattaccgtaaggtaggttaagggtttaaggttacgggtttggggttacggtttaccggggacgggtaacgggtacctaacggtccggttaacgggtaccgttaccggtacggttccgaccggtaccggtaacggtccgtaacccgtcccgtcgtaccttaccgtccgtttacccgtacccctaccgtccttaaccgg

SEQ ID NO: 261608 - DNA, 705 bp, Homo sapiens
  misc_feature: GYAE6OF02I8W56.9.86.H09.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (231)..(231): a, c, t, g, unknown or other
  misc_feature (231)..(231): n is a, c, g, or t
tcagtgatacgtctcacgaccggtgctcgatttagtgctatagacttgggttcggggctttgcctcgggctcctgctgctcctcaccctcctcgactcaggacgccagggtcctgggcccagtcctgccctggactcagcctgcctccgtgtctgcgtctcctggaccagtcgatcaccatctcctgcactggaccngcagtgatgtggattatgcttgtcncctgaccanagcacccaggctaacgccccaaactcgatactaattactacgtacggtcacgtaacgccggccctcgtaggggtttctagttccgtacgttctcgtggtcctaccgaacggttccttacggaaccaaaccgaaccgggtccctaccccgttaggaccctaacgtccgttccggtcggtcctaccgtaacgggtcgttacgggacggaacccggtacgggtaccctagggtaacgtttacttaacggtcggtactcggctaccgaattacgtcgacgtaggacgttggttacaaccgtccgtacccggtagggttaacttccgggaggtaccggtacaacgggtcgtaccgtacgttacgccgtaacggcccgaaggccgtcccggtaccccttcgggttaaccacccgtttccggtaccgttttaacccccgccccgttaccgttccgaaccgggttaccgtacgttaacccgg

SEQ ID NO: 261609 - DNA, 528 bp, Homo sapiens
  misc_feature: GYAE6OF02HMFJ6.9.86.H09.1.454.CMB.1.raw
  modified_base (291)..(291): a, c, t, g, unknown or other
  misc_feature (291)..(291): n is a, c, g, or t
  modified_base (479)..(479): a, c, t, g, unknown or other
  misc_feature (479)..(479): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggattttaaccttgtctcctggtaccaacaccaccaggcaaagcccccaaactcatgatttatgaagtcactaagcggccctcggggatttcngctcgcttctctggctccaagtccgtcaacacggcctcctgacaatctcgtggcctcagactggaaggacgaggctcattattactgttgctcatatacaggtagtaagttaggttgggtgttcggcggaggaccgagctgaccgtcgtaggtcacgccaaggctcgcccctgccactcttcgtcccnccctcctcgagactactcacgtgacggcggcgtggacgtacggcgtacg

SEQ ID NO: 261610 - DNA, 714 bp, Homo sapiens
  misc_feature: GYAE6OF02JJLME.9.86.H09.1.454.CMB.1.raw
tcagtgatacgtctcacgaccggtgctcgatttagtgctatagacttgggtttgggggggggtcacaagaggcagcgctctcgggacgtctccaccatggcctgggctctgctgctcctcaccctcctcactcaggacgcagggtcctgggcccagtctgccctgactcagcctgcctcgtgtctgcgtctcctggacagtcgatcaccatctcctgcactggaaccagcagttgggaattttacctgtctcctggtaaccaacaccaccaggacaaacgccccaaactcatgattatagaagtcactaagccgtccgtcgggtattcgtgctcgctttctctgcctacaacgtcctacaacgacgtccctcgtacgactaactctcgtcgggtcctaccgaacgtacgtacgggaacgggaaccggacgggtccttaacttaactttaacgttaacttcggtttacggcccttactaaacttaacgttacgtaacgggttagtttaaacgggtttagggtttacggggtttacgggttccggggacggggtaaccgggtaaccgaaacggtacgttaaccgggtaccccgttacggttacgggtccgaaccggacccccggtaaaggcccgttaccccggtaccccccggtttacggtacccttaaccgttacccgttcccgtttacccccgaccccttacccgttaacccgg

SEQ ID NO: 261611 - DNA, 577 bp, Homo sapiens
  misc_feature: GYAE6OF02FH520.9.86.H09.1.454.CMB.1.raw
  modified_base (262)..(262): a, c, t, g, unknown or other
  misc_feature (262)..(262): n is a, c, g, or t
  modified_base (560)..(560): a, c, t, g, unknown or other
  misc_feature (560)..(560): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggattttaaccttgtctcctggtaccaacaccacccaggcaaacgccccaaactcatgatttangaatcactaagcggcccgtggggtatttctgctcgcttctctggctccaagtccgtcaacacggccctccctgacctaatcctcgtggctccagactggaaggacgaggctactatttattacttgttcgctctatatacgaggttgtaaggtagttgggtggttcggaggaggaccagctgaccgtccgtaggtcacgaccgaggtcctccggcccccttcggtcctaccgttcctccgttaccccacccttccctcgtaaccggtacctacgtccgacgttcgacggccgggtccngggaccgtaggcgtacg

SEQ ID NO: 261612 - DNA, 637 bp, Homo sapiens
  misc_feature: GYAE6OF02GC2IQ.9.86.H09.1.454.CMB.1.raw
  modified_base (547)..(547): a, c, t, g, unknown or other
  misc_feature (547)..(547): n is a, c, g, or t
tcagtgatacgtctcacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttagggtcactcaccctgccccgattaacgtggacaggaaccctggtcttccggcgagcgggtcttttcacccgtctttactcgtttacttatgtcagctattcgctacttctgactaccctccaagcatcgcctcacagcaactaccttcaacaggtaccttaacacgaaccgccctacccctaacccaaacaaccgcaacgtaacgtccgtacgcctcgcccgacacgtccgtttcggngtccaggtttccgggtttaccgtcccccgttttacgacctttccccgttccccgtacctaacttccgtacggtaaccggtaccgttaacg

SEQ ID NO: 261613 - DNA, 521 bp, Homo sapiens
  misc_feature: GYAE6OF02IXJRP.9.86.H09.1.454.CMB.1.raw
  modified_base (293)..(293): a, c, t, g, unknown or other
  misc_feature (293)..(293): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaacctgtctcctggtaccaacaccacccaggcaaagcccccaaaactcatgatttatgaagtcactaagcggccctcggggatttcngctcgcttctctggctccaagtccgtcaacacggcctcctgacaatctctggctccagactgagacgaggctcattattactgttgctcatatactaggtgtaagttaggttgggtgttcggcggagggacagctgaccgtctaggtcacgcccaaggctcgcccctgtcacctctcgttcccaccctcctcgacgacgtatcacgtgcgcgggctggacgaggcacg

SEQ ID NO: 261614 - DNA, 626 bp, Homo sapiens
  misc_feature: GYAE6OF02JMIDR.9.86.H09.1.454.CMB.1.raw
  modified_base (201)..(201): a, c, t, g, unknown or other
  misc_feature (201)..(201): n is a, c, g, or t
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (315)..(315): a, c, t, g, unknown or other
  misc_feature (315)..(315): n is a, c, g, or t
  modified_base (366)..(366): a, c, t, g, unknown or other
  misc_feature (366)..(366): n is a, c, g, or t
  modified_base (387)..(387): a, c, t, g, unknown or other
  misc_feature (387)..(387): n is a, c, g, or t
tcagtgatacgtctcacgaccggtgctcgatttagtgctatagacttgggtttgggggcgtttggcctgggctctgctggctccgtcaccctcctcacctcaggacgcagggtcctgggcccagtcctgccctgacctcacgcctgcctccgtgtctgccgtctcctaggccagtcgatcaccatctcctgcactggaccngcatggatttacctgtcnctggtaccacnccaccnggcaaagcccccaaatcaatgacttatgagtcactaagcgcctcggggattctgctcgcttctctggactcgaagtccnctaccacggcctcctgacctaatctctgggccttcaagcctgacggaacgnggcttcgaattctaactggtntctcatatactaggcgttaagttaggttacggtacggtttcgggcggttaagggaccgacggtacgttcgaacccgttcggtacggtcacgaccccaagggtccttccgccccccgtcgggttccaaacccggttctccgggttaaccctccccggttaccctctaacccggtacgttacttcccgaacgtttcggaaccgttcggggcccgttaaggccccgtaaggggtccaaccgg

SEQ ID NO: 261615 - DNA, 562 bp, Homo sapiens
  misc_feature: GYAE6OF02GAP1O.9.86.H09.1.454.CMB.1.raw
  modified_base (301)..(301): a, c, t, g, unknown or other
  misc_feature (301)..(301): n is a, c, g, or t
  modified_base (373)..(373): a, c, t, g, unknown or other
  misc_feature (373)..(373): n is a, c, g, or t
  modified_base (392)..(392): a, c, t, g, unknown or other
  misc_feature (392)..(392): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacacccacccaggccaaaacgcccccaaactcactgatttatagaagtcaactaagccggccctcggggatttcngctcgcttctctggctccaagtccgtcaacacggcctccctgacatctctggctcagactgaggcgaggctnattattacgtgttagctanatatacgtaggtagtaaggtagttgggttgtcgggcggagggaccagcgtgaccgtcgtagtcacgaccaggctcgccccgtgtcctacgtcgtcgttaccccacccttccgtaccgacgtacgtactccgtaccgtggaccggtcggaccgtggccgaacggtcgtacg

SEQ ID NO: 261616 - DNA, 594 bp, Homo sapiens
  misc_feature: GYAE6OF02H7XQG.9.86.H09.1.454.CMB.1.raw
  modified_base (566)..(566): a, c, t, g, unknown or other
  misc_feature (566)..(566): n is a, c, g, or t
  modified_base (577)..(577): a, c, t, g, unknown or other
  misc_feature (577)..(577): n is a, c, g, or t
  modified_base (590)..(590): a, c, t, g, unknown or other
  misc_feature (590)..(590): n is a, c, g, or t
tcagtgatacgtctcacgaccggtgctcgatttagtgctatagacttggggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggacctgcattgggtattttaccttgtctcctcggtaccaacaccaccaggacaaacgaccccaaatccatcgatttatgaactcaactaacggcggacccgtcggggtatttcgtgtcctcgctttctctcggctaccaaggttccactaacgccggccctcctgaacatcgtctcggcctactagacgtgacggacggacggcttactagtttacttacgttgtttcgcttacattactacgtaggtaacgtagtaggttgggtcggttcgggcggagggacctaagcgtcgtaccgtacggtagacgtacgacccgagcctccgtccccgtgtcctactccgttccgtcccgtccctctcgaactactcacgtacgnggacggcgggngtcggacgacggntacg

SEQ ID NO: 261617 - DNA, 748 bp, Homo sapiens
  misc_feature: GYAE6OF02G0SJ5.9.86.H09.1.454.CMB.1.raw
tcagtgatacgtctcacgaccggtgctcgatttagtgctatagacttgggtttgggggctttgcctgggctctgctgttcctcaccctcctcactcaggacgcagggtcctgggcccagtctgccctgactcagcctgcctccgtgtctgcgtctcctggacagtcgatccaccatcctcctgaccacgtacggaaccagctagttaggggttaacgtttttaaccttgttcctccgttacggtaacccaaccaccccacccgacggaccaaaccgacccccaaactcatgtatttatggtacggtacaagtaacggccgtacccgtcggtccggggtcctgactcggtctttcgtcgtcggtcctacgaacgttcgtacggaccaaccgaccggtcccctcccgtcggtacccgtcgtcgtcgggcctaccggacgtctgacgtagtcggacggtactaggttaactttacgttaccgtcgtactacgtctacgtatacgtacgccgaacggacccaaccctagttaacgttcgttacggttacgggaacggtccgggaacccgtaccgggtacccgtacccggttaccgtaacggtcccgaacccggacccgaaacccggtaccccaacccgttccgtacgtaccctaccgttcccgtttaccccgtacccctaccccgtcgtaactacggtaaccgttcctaaccgtacggtcgggaccggtccggtccgtacgggaccgtacgg

SEQ ID NO: 261618 - DNA, 714 bp, Homo sapiens
  misc_feature: GYAE6OF02JKIUD.9.86.H09.1.454.CMB.1.raw
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaacctgtctcctggtaccaacaccacccaggccaaacgcccccaaaatcatcgtattatgaagtcaactaagcggtccctggggatttcgtgctcgtcgttctcttggcctaccgaagttccgtacaactaccggtccctcccgtgaactaactctcgtggcctccgaacgtaccgtagacgggacgtaaggtccctataactttacgttaactttcggtttacggtctttacgaaacttacgtaacgtaagggttcgttaaaaggtttgggttaggggttcgtttaccggggacgggtaacgggtaacccaaagggttccgttaccgtaacccggttcctacggggttactaaccggaaccccgtagggtacccgttcccgggacccccgttacgggtacctacccgttacctccgtttaccccaccccgttacctacccggaacgtaaccttacgtaccgaccgttaaggccggtcggtaccgtggaacccgtaggtcggtaaccg

SEQ ID NO: 261619 - DNA, 548 bp, Homo sapiens
  misc_feature: GYAE6OF02JK23R.9.86.H09.1.454.CMB.1.raw
  modified_base (295)..(295): a, c, t, g, unknown or other
  misc_feature (295)..(295): n is a, c, g, or t
  modified_base (343)..(343): a, c, t, g, unknown or other
  misc_feature (343)..(343): n is a, c, g, or t
  modified_base (362)..(362): a, c, t, g, unknown or other
  misc_feature (362)..(362): n is a, c, g, or t
  modified_base (473)..(473): a, c, t, g, unknown or other
  misc_feature (473)..(473): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggattttaaccttgtctcctggtaccaacaccacccaggcaaacgcccccaaaactcatgatttatgaagtcactaagccggccctcggggatttcngctcgcttctctggctccaagtccgtcaacacgcctcctgacatctcnggctccagactgaggacgngctcatttatactgtgctcatatacgaggtagtaagttgttgggttgttcggacgggaggaacagtacgtcgaccgtctaggcacgacccaggcctccgccccgtcgtacncctctccgttccccaccctcctcgagtaccgtatccgacgttcggacggtccgggcgtgggaccacgggtcgacg

SEQ ID NO: 261620 - DNA, 623 bp, Homo sapiens
  misc_feature: GYAE6OF02HEX86.9.86.H09.1.454.CMB.1.raw
  modified_base (361)..(361): a, c, t, g, unknown or other
  misc_feature (361)..(361): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggattttaaccttgtctcctggtaccaacaccaccaggcaaacgcccccaaatcatgatttatgaagtcactaagccggccctggggatttctgctcgcttctctggctccaagtccgtcaacaccggcctccctgacaatctctggctccagctgaggacgnggctcattattcgttgtttcgctctatatacagggtacgttaaggttaggttggggtgtttcgggacgggtacgggaaccgaaggtccgtaggtacccgttcgtaacgggtccaggtacccccgtaagggccgttcccggcccccgttcggtccctaccgttccgttaccgttcccccgtaccccttccgttaccgaacggtaccgttacgtacccgtacgtaggacgggccggtcgtacgggccggtaacggccggtaacg

SEQ ID NO: 261621 - DNA, 669 bp, Homo sapiens
  misc_feature: GYAE6OF02IRZIH.9.86.H09.1.454.CMB.1.raw
  modified_base (263)..(263): a, c, t, g, unknown or other
  misc_feature (263)..(263): n is a, c, g, or t
  modified_base (346)..(346): a, c, t, g, unknown or other
  misc_feature (346)..(346): n is a, c, g, or t
  modified_base (369)..(369): a, c, t, g, unknown or other
  misc_feature (369)..(369): n is a, c, g, or t
  modified_base (400)..(400): a, c, t, g, unknown or other
  misc_feature (400)..(400): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcacgtggaaccagcattgggagttttaacttgtctcctggtaccaacaccaccaggacaaacgcccccaaatcatgatttangaagtcactaagcgccgtggggattctgctcgctttctctggcctccaagtccgtcaaccgcggccctcctgaactatccgtntcggctccagacctgacggacgnggcctgtattattacttgttacgctacatanactaggtagtagttaggttgggttcggttcgggacgggagggaaccgaagtccgttacggacccgttaccggtaggtccgacggacccgaaacggtccgttcccggaccccccgttcgggttacccacgtttcccgttaccgttacccccccgtaccccgttccgtacccggtaacggtacccggttaaccttaccccggtaacgttccgggaccgggtacccgggttacccgggtaccgggtaaccggtaaccgggtacccgtaacgg

SEQ ID NO: 261622 - DNA, 597 bp, Homo sapiens
  misc_feature: GYAE6OF02FKWM3.9.86.H09.1.454.CMB.1.raw
  modified_base (334)..(334): a, c, t, g, unknown or other
  misc_feature (334)..(334): n is a, c, g, or t
  modified_base (386)..(386): a, c, t, g, unknown or other
  misc_feature (386)..(386): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggtagttttaaccttgtctcctggtaccaacaccacccaggcaaacgcccccaaactcatgatttatgaagtcacgtaagcggccctcggggtattctgctcgcttctctggctccagtcctcaacacggcctccngacaatctcgtcggctccagtacagaggacgaggctctattacttactgttnctactatatacgaggttagtaagtaggtttagggttgttacgggcgggagggaaccgaacgtcgtcgtaccgtccgtaggtacgacgacccgaacggtcgtaccgtcccccgttcggacctccttccgttccgttccccgccccttccgtaccgtacgtaccgtacttccgacgttggacggtaccgggtcgtacgggactacggcgtacg

SEQ ID NO: 261623 - DNA, 544 bp, Homo sapiens
  misc_feature: GYAE6OF02GCE8B.9.86.H09.1.454.CMB.1.raw
  modified_base (291)..(291): a, c, t, g, unknown or other
  misc_feature (291)..(291): n is a, c, g, or t
  modified_base (322)..(322): a, c, t, g, unknown or other
  misc_feature (322)..(322): n is a, c, g, or t
  modified_base (385)..(385): a, c, t, g, unknown or other
  misc_feature (385)..(385): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggattttaaccttgtctcctggtaccaacaccaccaggcaaacgcccccaaatcatgatttatgaagtcactaagcggccctcggggatttcngctcgcttctctggctccaagtccgtcaacncggcctcctgacatctctggctcagactgaggacgaggctcattattactgttgctcatatanaggtgtaagtgttgggtgttcggcggaggacgagcgtgacgtcgtaggtacacgccgaagctcgtccccgtcgtccacttctccgtcccgtcccttcccgtccgacggtaccgttactccgtacgtcggacggccgggtcgtgggaccgacggcgtacg

SEQ ID NO: 261624 - DNA, 824 bp, Homo sapiens
  misc_feature: GYAE6OF02GLXDF.9.86.H09.1.454.CMB.1.raw
  modified_base (242)..(242): a, c, t, g, unknown or other
  misc_feature (242)..(242): n is a, c, g, or t
  modified_base (323)..(323): a, c, t, g, unknown or other
  misc_feature (323)..(323): n is a, c, g, or t
  modified_base (369)..(369): a, c, t, g, unknown or other
  misc_feature (369)..(369): n is a, c, g, or t
tcagtgatacgtctcacgaccggtgctcgatttagtgctatagacttgggtttgggggggggtcgacaagaggcagcgctctcgggacgtctccaccatacggcctgggctctgctgctcctcaccctcctcactcacggacgcagggtcctgggcccagtctgccctgactcacgcctgccctccgtgttctgcgtcgtcctggaccacgttcgactcaccgatctcctgcactggaaccngcctagttgggaacgtttttaacctgtctcctaggtaaccaacaccacccaggccaaacgcccccaaactcatcgatttancgaacgtcaacgttaacgccggtacccgtcggggtaacttttccgnggtacctccggtcctttcgttccgttcgggtaccttacccggtaacgttccggtaccaaaccggtacccggtcccttcccgtagaacccaaacgttccttcggtacgggccttacccgaacggtaccgtcgggaacgggaaccggtagggtaccttacgtaacttttaacgtttaaccgttggtttacggaccttactaagttaaacttaccggaagggttttacggttaaacggtttacgggtttacgggggttttcggttaaccgggggttaccggggaacggggtaaacccctaaaagggtccggtttaagaaccccggtttaccggttaacgggtaccgtaaccgggtaccccgaaagggttcccggtacccggttaccccccggttcgggttaacccttaccgtttcccgtttacccggttaccccccttaccccgtcccgttaacccgg

SEQ ID NO: 261625 - DNA, 792 bp, Homo sapiens
  misc_feature: GYAE6OF02F1126.9.86.H09.1.454.CMB.1.raw
  modified_base (264)..(264): a, c, t, g, unknown or other
  misc_feature (264)..(264): n is a, c, g, or t
tcagtgatacgtctcacgaccggtgctcgatttagtgctatagacttgggtttgggggctttgcctgggctctgctgctcctcaccctcctcactcacggacgcagggtccctgggcccagtctgccctgactcagcctggcctccgtgtctgcgtctcctggacagtcgatcaccatctcctgcactggaaccagcattgggattttaaccttgtctcctggtaccaacaccaccaggacaaacgccccaaatcatgatttangaagtcacgtaagccggccccttcgggggtattttcgtggactcgtactttaccgtctcggtcctaccgaaacggttcccgtacaaaccgtaccggtcccttcccgtagaacctaacttccttccgtcgggtcccttacccgaaaggtaccgttaggaacgggtaacggaacggtaccttacgtaattttacgtttaacgttggtttacgtaccgttacaacgttaacgtaaccgtagggttaggttaaacgggttagggtttcgggggttgtttaccggggacggggtaacgggtaaccgtaaaggtccttacgggaaccccgtttaccgtaacgggttaccgaacggtaaccccggtaagggttcccgttacccggtccccccgtttacgggttacctacccgttccgttaccggtttaccccctacccgttcccgtaccggtaacggtaccggttaacctacccgtaccgttaccggaccgggtccgggtaccgtacgggtacccgtaacgggtcccgtaaccgg

SEQ ID NO: 261626 - DNA, 722 bp, Homo sapiens
  misc_feature: GYAE6OF02F1A3A.9.86.H09.1.454.CMB.1.raw
  modified_base (431)..(431): a, c, t, g, unknown or other
  misc_feature (431)..(431): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccaccaggcaaacgccccaaactcatgtatttatagaagtcaactaacgcggtccccgtacggggtattttctagccttcgccttctctggtcctccgaagtccgtacaacgaccggccttccctgaactatcctcgtgggtcctccagtaccgtgtaacggacgtacggtcctacgtaattttacttaacgttcggtttcncgttactaacgttataaccgtagggtttacgttaaggttacgggtttggggttcggttccggggacgggtaacgggaaccgaaggtccgtacggtaacccgttccgtaacgggtcgtacggaccccgtaaggtcccgttcccgacccccggtttccgtaccgtttacccgttttcccggttacccccgtccccgttacccgttaccgaaccggtccgttaaccgtcctaaccggttgggtacccggtcccggggtcggttaccggacggtaccgggtaccgtagttaacgg

SEQ ID NO: 261627 - DNA, 741 bp, Homo sapiens
  misc_feature: GYAE6OF02IM995.9.86.H09.1.454.CMB.1.raw
  modified_base (260)..(260): a, c, t, g, unknown or other
  misc_feature (260)..(260): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggattttaacctgtctcctggtaccaacaccaccaggacaaacgccccaaatcatgatttangaagtcaactaagccggcccgtgggtactttcgtcgctcgtcttctcgtggcctaccgaacgtccgtacaacgaccggcccttacctaggaactaacgttcctcgtcgggcctaccgagacctggaaggacggaggtcctactaatttaactttaccgttgtttcgtccttacgtaactttaacgtaaccggttaagggttacgttaaaagggtttcgggtttacgggggttacggttcccgggggtaacggggtaacggggtaaacccgaaacggttcccgttaccgggtaaccccggtttacccgtaagggttacccgaaccgggtaccccgtaaacgggtccgttacccggtccccccgttacggttacccgtaccttcccgttacccggtttcccccgtcccgttacccttacggaacgttaacccgttactccgtaacgtacggacggtcgggtacgtcggaccgacggcgtaacg

SEQ ID NO: 261628 - DNA, 600 bp, Homo sapiens
  misc_feature: GYAE6OF02IUS53.9.86.H09.1.454.CMB.1.raw
  modified_base (295)..(295): a, c, t, g, unknown or other
  misc_feature (295)..(295): n is a, c, g, or t
  modified_base (323)..(323): a, c, t, g, unknown or other
  misc_feature (323)..(323): n is a, c, g, or t
tcagtgatacgtctcacgaccggtgctcgatttagtgctatagacttgggtttggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctagcactggaaccagcattgggattttaacctgtctctggtaccaacaccaccaggcaaacgcccccaaatcatgtatttanagatcactaagcggcctcgggactttcngtctcgcttctctgcctacaacgtccgtcaacacgcctcctagacaactcgtctacgggctaccgagtactgaggacgaggctacgattacttacttgttcgacttacattaacgtacgtaggtagttaagttagggttgggttacggttacgggcggaacgggtaaccgaaggtactacggtacccgttccgtacggtacgaccggtacccgaacggtccgtaccgtccccgtcggtcctaccgtccttacccggtcccctaccctcccgttaccg

SEQ ID NO: 261629 - DNA, 623 bp, Homo sapiens
  misc_feature: GYAE6OF02JWL1I.9.86.H09.1.454.CMB.1.raw
  modified_base (317)..(317): a, c, t, g, unknown or other
  misc_feature (317)..(317): n is a, c, g, or t
  modified_base (325)..(325): a, c, t, g, unknown or other
  misc_feature (325)..(325): n is a, c, g, or t
  modified_base (592)..(592): a, c, t, g, unknown or other
  misc_feature (592)..(592): n is a, c, g, or t
tcagtgatacgtctcacgaccggtgctcgatttagtgctatagacttgggtttggggggggtcgacgaagaggcagcgctctcgggacgtctccaccatggcctgggctctgctgctcctcaccctcctcactcaggacgcagggtcctgggcccagtctgccctgactcagcctgcctccgtgtcctgcgtctcctggacagtcgatcaccatccgtcctagccacgtcggaaccagcagttgggaacttttacctgtcctccgtggtaaccaacaccacccaggaccaaacgcccccaaatccatagactttagngacggttnaattaaggccgtccctcggtacggggtcccctgactcgtccttcgtcgtacggcctacaagtctggaccaacgacggtcctcctcgaccgttctcggcggtcaccgagtcgtgacgagtcgaggtcctagtacttagttactgactagtctactagtataccgcaaaggcccaacggtaactacgtagtccgttacgggagttcgggaacctacggtcctaccggttccaacggttacaccgaacccgtaacgacccttaacccggntttaccggactaccgtccgtacgttaccccc

SEQ ID NO: 261630 - DNA, 677 bp, Homo sapiens
  misc_feature: GYAE6OF02GUAXO.9.86.H09.1.454.CMB.1.raw
  modified_base (288)..(288): a, c, t, g, unknown or other
  misc_feature (288)..(288): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcacgtggaaccagctagtttagggtaactttttaaccttgttcctccgttaggtaacccaaccacccacccgaggaccaaaaccgaccccaaatcatgtaactttanagtaacgtcaacgtaacggccggcccgtacggggtactttcgtcgcgttccgtcttcgtctggacctaccgacgtccgtacaaccgtccggtccctccgtacgtactaacttccgtcgtcggtcctaccgagacgttggaacggtacggacggtctagtaactttacttacgttcgttgtacctacgtacttaacgtacggtaggttaggttaaggttgggtttgggtcggttacgggacggaacgggaacgtaggtcgtaccggtaccgttcggtaggtccgacgaccgtacgtcctccgtcccgtgtcctcttcgtaccttcccctaccgttcgtacgtacgtacgtacgtctacgtagacggtccggtcgacggacacggctaacg

SEQ ID NO: 261631 - DNA, 754 bp, Homo sapiens
  misc_feature: GYAE6OF02H82XX.9.86.H09.1.454.CMB.1.raw
  modified_base (717)..(717): a, c, t, g, unknown or other
  misc_feature (717)..(717): n is a, c, g, or t
tcagtgatacgtctcacgaccggtgctcgatttagtgctatagacttgggtttgggggggggtcacaagaggcagcgctctcgggacgtctccaccatggcctgggctctgctgctcctcaccctcctcactcaggacgcagggtcctgggcccagtctgccctgactcagcctgcctcgtgtctgcgtctccgtggacagtcgatcaccatcctctgcactggaaccagctattgggtacttttacctgtcctcctggtaccaacaccacccgaggaccaaaccgaccccctaaatcatacgtattactaggaacgtaccaacgtaacggccggtacccgtcggggtaattttccgtcgaccttcgtccgtttactcgttacggccttacccgtaaacgttcccggtaccaaccgtacccgggtcccttacccgtacgtaacctaagttcccgttacgtccggggtacccttaccgtaacggaccgttcggaaaccgggttaccggacgggttacccttacgtaaacgtttaaccgtttaccgtttggtttaccgacgttacctaacgttaaccgttaacggtagggtttaaccgtttaaggggttaacggtttcggggttaccgttacggggtaaccgggacggtaaccgtaacggtcgtaaccgtaccgtcgtaggtccgacgccgtaacggctacccgtccccgtgttacccnccgttccgtcccgttacccctacccgttctaacccgg

SEQ ID NO: 261632 - DNA, 859 bp, Homo sapiens
  misc_feature: GYAE6OF02FM4NN.9.86.H09.1.454.CMB.1.raw
  modified_base (181)..(181): a, c, t, g, unknown or other
  misc_feature (181)..(181): n is a, c, g, or t
  modified_base (200)..(200): a, c, t, g, unknown or other
  misc_feature (200)..(200): n is a, c, g, or t
tcagtgatacgtctcacgaccggtgctcgatttagtgctatagacttggggtttgggggctttgcctgggctctgctgctcctcaccctcctcacctcaggacgccagggtcctgggccccagtctgccctcgactcagcctgcctccggtgctgcgtctcctggacagtcgatccaccgntctccgtgcactggaaccnggcagttgggagttttaaaccttgtccgtcctggtaaccaacgaccaccaggcaaacgcccccaaaactcatgattactgaagtcaactaaagccggtacccctcggggtatttcgtgcctcggcctttccgtacgtcggtcttccgaaaggttcccgtacaacgaccggtccgttaccccgttggactaaagtccttcggtcgggccttacccgaagtacgtggaacgggtacggtacgggtccgtttacgtaaacttttaacggtttaacccgtttgggttttaccggaccttaccgtaaacggtttaaaccgttaaccggttaaccggggttaaaggttaacgggtttaacggggttttacgggggtttaccgggttttaccggggaccgggggttaaccgggggaaacccgtaaacggttacccggttaccggttaaccccggttacccggttaaccgggttaccgtaaccgggtaaccccggtaaacgggtcccgttacccggttaccccccggttagggttaacccgtaccgttccggttacccggttacccccggtacccttacccggtccgtaaccggttaccgttaaacgtccgtaccgttaggaacgggttcggggtccggttaccgggaccgtaccggtaccgtacgg

SEQ ID NO: 261633 - DNA, 631 bp, Homo sapiens
  misc_feature: GYAE6OF02I5D8G.9.86.H09.1.454.CMB.1.raw
  modified_base (264)..(264): a, c, t, g, unknown or other
  misc_feature (264)..(264): n is a, c, g, or t
  modified_base (295)..(295): a, c, t, g, unknown or other
  misc_feature (295)..(295): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaacgccccaaactcatgactttangaagtcaactaagcggccctcggggatttcngctcgcttctctggcctccaagtcccgtacaaccgacggccctacctgacaactctcgtggcctaccagactgaggacgtaggcctacattaattacgtgttgactcattaacgtactaggttacgtaagtaggttagggtggttccgggacgggagggacgaagtcgtacgtaccgtaccgtacgggtcgacgtacccgaacgtccgtccgcccccgtcggttacctaccgtcgttccgttaccccgtacccttcccgtaccgtacggtaccgtacgtacccgacgtacggacgggtccgggtaccgttagggaccgtaacgggtccgtaaccgg

SEQ ID NO: 261634 - DNA, 823 bp, Homo sapiens
  misc_feature: GYAE6OF02HC6KG.9.86.H09.1.454.CMB.1.raw
  modified_base (190)..(190): a, c, t, g, unknown or other
  misc_feature (190)..(190): n is a, c, g, or t
tcagtgatacgtctcacgaccggtgctcgatttagtgctatagacttgggtttgggggctttgcctgggctctgctgctcctcaccctcctcactcaggacgcaggtcctgggcccagtctgcctgactcagcctgcctccgtgtctgcgtctcctggacagtcgatcaccatctcctgcactggaaccngctaagttgggacgtttttaacctgtcctcctaggtacccaaccaccaccaggccaaacgcccccctaaatcagtcgtatttagtcggaatcgacttaacggccgccccgttggggtactttcgtcggctcgtacttccgtcgtcggtcctccgtaaacgtcccgtacaaccgtaccggcccttacccgtcgtaactaacttccgtccgttacgggtccctaccgtaacggtacgttagggaaacgggtaacggacgtccgttacgtaattttaacgttacgttagtttacgtccttactaacggttacgtaaccggttaaggggttacggtttaaagggttcgggtttaggggttaccgggtttccgggaacggggtaaacgggttcccgtaaaggtccggttaacccggacccggtttaccggtaacgggttaccgaaccgggttacccctaaacgggttccccgttaccccggggtccccctttaacggggttcccttacccgtttacccgggttacccggtttaccccctaccctttcccggtaaccgtaccggttaccgttacccgtacgttaccgtacggtaacgggttccggaccggtttacggaacccgggtacggtccgtaacg

SEQ ID NO: 261635 - DNA, 514 bp, Homo sapiens
  misc_feature: GYAE6OF02HAUUH.9.86.H09.1.454.CMB.1.raw
  modified_base (264)..(264): a, c, t, g, unknown or other
  misc_feature (264)..(264): n is a, c, g, or t
  modified_base (324)..(324): a, c, t, g, unknown or other
  misc_feature (324)..(324): n is a, c, g, or t
  modified_base (385)..(385): a, c, t, g, unknown or other
  misc_feature (385)..(385): n is a, c, g, or t
  modified_base (428)..(428): a, c, t, g, unknown or other
  misc_feature (428)..(428): n is a, c, g, or t
  modified_base (458)..(458): a, c, t, g, unknown or other
  misc_feature (458)..(458): n is a, c, g, or t
  modified_base (469)..(469): a, c, t, g, unknown or other
  misc_feature (469)..(469): n is a, c, g, or t
  modified_base (485)..(485): a, c, t, g, unknown or other
  misc_feature (485)..(485): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggattttaacctgtctcctggtaccaacacccacccaggccaaacgcccccaaaatcatgatttangaagtcactaagcggcctcggggatttctgctcgcttctctggctccaagtccgtcaacncggcctccctgacatctctcggtctccagactgaggacgaggctcattattactgttgctnatatacgaggtgtaagtaggttgggtgtcggcggaggacagcngccgtctaggcagccagtctcgccctgtcnctctcgtcccnccttcacgcgactacncgactggacgcgggctcggcgaggcgacg

SEQ ID NO: 261636 - DNA, 711 bp, Homo sapiens
  misc_feature: GYAE6OF02HXH3I.9.86.H09.1.454.CMB.1.raw
  modified_base (652)..(652): a, c, t, g, unknown or other
  misc_feature (652)..(652): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctctggacagtcgatccaccatctcctgacacgtaggaaccagctagttggggtactttttaaccgttgttctccgtacggtaacccaaccaccaccgaggaccaaacgcccccaaaatcaatagtacttatgaacgtacacgtaaggccggcccgtcggggtattttctagtctacgtctttcgtacgtcggacctacgaaccgttccgtaccgaaaccgacccgggtcccttcccgagtaactaaacttcgttacgttacgggaccttccgaacgtacgtacggaaagggtaacggaacggtcctaacttaatttaacgtttaccgttgtttcgactttacaagttactaacgtaggttacgttaaggttagggtttcgggtacggttaccgggacgggtaaacgggaccaaaggtccgttaccgtaccgtactagggtaccacgaaccgacgcctaccgcccgttacggtctaccgtcgttcccgttccgccctcncgtaagtaccgtacgtacctacgtcggaacggcggacgtacgggacgtacgggctaacg

SEQ ID NO: 261637 - DNA, 776 bp, Homo sapiens
  misc_feature: GYAE6OF02H70CM.9.86.H09.1.454.CMB.1.raw
  modified_base (275)..(275): a, c, t, g, unknown or other
  misc_feature (275)..(275): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgccttccgtgtctgcgtctcctggacagtcgatcaccatctcctgcactggaaccagcagttgggtagttttaaccttgtctcctaggtaacccaacacccacccaaggacctaaacgcccccaaaatcatgatttangagtcactaagcgcctgtagggtttctattcgtcttctcgtaggtcctaccaagtctcgaaccaaacgaccggtaccctccctacgaacctaatcctcgtcggtacccttacgacggtgtacggacgggacggaacgggtcttaacgtaattttaacgttaacgtcggtacgtttcgtaccttactaatttaaacgttcggaacgtaaggttagttacggtaacggtaaccgtacccggtttccccgggttaggttaaccggtttacggggaaccgggggaacgggtaacccggtaaaacgggttccggtaaaccccggttaccggtaacgggttaacccgaacgggaaccccgttaaacgggcccgtacccggttaccccccgttacgggttaccctaccgtttcccgttaacccgttccccctaaccccgttacccgtaacgtaccgtaacggtttactaaccgaacggttcggaaccggggtcgggacccgtaacggg

SEQ ID NO: 261638 - DNA, 566 bp, Homo sapiens
  misc_feature: GYAE6OF02I884D.9.86.H09.1.454.CMB.1.raw
  modified_base (298)..(298): a, c, t, g, unknown or other
  misc_feature (298)..(298): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactgtaaccagcattgggtagttttaaccttgtctcctggtaccaacaccacccaggcaaacgcccccaaactcatgtatttatgaagtcactaagcggcccgtcggggtatttcngctcgcttctctggcctccgaagtccgtaccaacacggccctccctgacaactctctcggctccagactgaggacgagctctattattactgttgctcatactacgaggtagtaagttggttgggtgtcgggacggaggacagctcgaccgtctaggtcacgacccgaggcctccgccccgtcgtccacgttcgtccgttccccgccctccgtcgaggtacctactcgacgttcggacggtccgggcgtacgggacgacggcgtaacg

SEQ ID NO: 261639 - DNA, 903 bp, Homo sapiens
  misc_feature: GYAE6OF02HXJMB.9.86.H09.1.454.CMB.1.raw
tcagtgatacgtctcacgaccggtgctcgatttagtgctatagacttggggtttgggggggctttgcctgggctctgcttctccgtcaccctcctccactcgacggacggcagggtcctgggccctagtctcgccctgactcaggcctgccgtccgtggtcctgcgtctcctggactagtcgactcacctacttctcctggcctacgtcggaaccagtccgtagtttcgggtacgttttaaccttgttccttccgtcggtaccctaacgtaccacccgaaggtaccaaacggtccccctaaaacttcctaattcgtaattttactacggtaacggttaccaacgtaacggtaccccggcccgttaaccggggggtaccttttaccgtcggtaccgttacggtcctttaccgttcgttcggggtaccttaccggtaacggtcccgttaccggaacccgtacccgggtacccgttaccctacggtaacctaaccgttccgttaccgtcggggtacccttcccgtaacggtacccggtacgggacgggtacccggtaacgggtaccgttacccgtaacgttttaccgttaaccgtttcggttttaccgtcccgtttacgtaacgtttaccgttaacggtaaccgggtttaggttaaacgggtttaggtttacgggggtttaccgttcggggttaacgggttaacgggtaaccctaaggttccgttaacggtacccgttaacgttacggtaaccgtacggtacccgtaaaggggtccgtaccggttaccccgggtacggttacccgtaccggtccgttaccggttccccacccgttacctccgaccgtaccgttcaccgtacgtacgccgggtccgtcgtaccggtacgtacggtcgtacctaacgg

SEQ ID NO: 261640 - DNA, 756 bp, Homo sapiens
  misc_feature: GYAE6OF02IAXMY.9.86.H09.1.454.CMB.1.raw
  modified_base (751)..(751): a, c, t, g, unknown or other
  misc_feature (751)..(751): n is a, c, g, or t
tcagtgatacgtctcacgaccggtgctcgatttagtgctatagacttgggtttgggggcttttgcctgggctctgctgctcctcaccctcctcactcaggacgcagggtcctgggcccagtctgccctgactcagcctgcctccgtgtctgcgtctcctggacagtcgatcaccatctcctgcactggaaccagctagttgggtaacgtttttaacctgtcctaccgtgtaccaacaccaccaggacctaaacgcccccaaatcatcgtatttagacgtaagtaccaacgtaaacggccggtaccccgtacggggtactttcgtcggccttacgcctttcctccgttagggtccttaccggaaccggttacccgtacgaaaaccgtccggtacccctacccgtacgaactaaccttcgtccggtcggtcctacgaacgtaccgtggaaacggtcggacggtacttaacgttaaatttacgttaacgtttcgtttcgtacctaacgtacttaacgtaaaggttacggttacgttaagggtttagggtttgggtacgggttacggggtacgggaacggtaccgtagaccggttacggtacccgttacggtaccggtacgaacggtacccgaacggtccgacccggttccccgttacggttaccttaccttccgttacccgttaccccctaccgttccgtaccgacgtaaccgttcgtaactcggtacgcggacgggtcgtcggacgtaccggntacgg

SEQ ID NO: 261641 - DNA, 944 bp, Homo sapiens
  misc_feature: GYAE6OF02JV96T.9.86.H09.1.454.CMB.1.raw
  modified_base (242)..(242): a, c, t, g, unknown or other
  misc_feature (242)..(242): n is a, c, g, or t
tcagtgatacgtctcacgaccggtgctcgatttagtgctatagacttgggggtttgggggggggggtcacaagaggcagcgctctcgggacgtctccaccatggcctgggctctgctgctcctcaccctcctcactcaggacgcagggtcctgggcccagtctgccctgactcacgcctgcctccgtgtcctgcgtctcctggactagtcgatccaccatctcctgccacgtacggaacccngaccgtagttaggggtaactttttaaccttcgtcctaccgtacggtaaccctaaccgacccaaccgtacggaccaaaaaccccggtaccccccctaaaacttaccgtaagttacggttaaacttttaacgtacggtaaacgttacctaaaccgttaaacgggccccgggtaaccccggttacgggggttaacttttaccgttcggtacccgtttccggttccgttttccgtaccggttaccggggtacccttaacccgtaaaccggtttccccgtaaaccgtaaacccggtaccccggtcccctttacccgtaacgtaaccttaacctttccggttacccggttacggggtcccttaaccggtaacggtaaccgttacggaaaccggggtaaccggtacgggttaccttacgtttaaacgtttactttaccgttcggttaccgtacttacgtaacgtttaacgtaacgggttacgggtttaacggttaaaggttttcgggttacggggtttacgggtttaccgggggaaccggggtaacggtaaccgtaacggttacccggtaacggttacccggttaacggtacgggttaccgtaacccgggacccggtaacgggttcccgtaccccgggttaccccggtacggttacccttacccggttaccgtttcccccgggttcccctacccgttacccgtaaccgg

SEQ ID NO: 261642 - DNA, 853 bp, Homo sapiens
  misc_feature: GYAE6OF02I0PGE.9.86.H09.1.454.CMB.1.raw
  modified_base (213)..(213): a, c, t, g, unknown or other
  misc_feature (213)..(213): n is a, c, g, or t
tcagtgatacgtctcacgaccggtgctcgatttagtgctatagacttgggtttgggggggggtcacaagaggcagcgctctcgggacgtctccaccatggcctgggctctgctgctcctccaccctcctcactcaggacgcagggtcctcggcccagtctgccctgactcagcctgcctcgtcgtctgcgtctcctggacagtcgatccaccntcctcctagaccacgtacggaaccagacgagttacggggttacgttttaaccttcggtccttaccgttacggtaaaccaaacccaacccgaacccgtaacggaacctaaaaaccgaacccccctaaaactactaacttacgtaattttaacgtaggtaacgttaacgaaccgtaaacggacccggtaccccggtacggggttacttttaccgtcgtaccgttcgtcctttacttccgtacggtaccttaacccgtaaacgtaccggttaaccaaacccgaccggtccctacccgtaacgtaacgtaactaccgttcggtacgggcccttacgaacgtacgtacggaaacgggtaaccggacggtacttactaacgtttaacgttaacgttgttacggtacctttacgtaacgttacgttacggtaactacggtaggttaacggtccgtaacccgaaccggtttaccggttacggggtttaacgttaccggggtacgggtaacggggaaccgttaacgggtaccgtaacccggttaccgttaacgggtaaccgtaccggtaaccccggaacgttccccggttacccggtaccccccgttacggttacccggttaaccgttcccggttacccgttacccccg

SEQ ID NO: 261643 - DNA, 640 bp, Homo sapiens
  misc_feature: GYAE6OF02FQL30.9.86.H09.1.454.CMB.1.raw
tcagtgatacgtctcacgaccggtgctcgatttagtgctatagacttgggtttggggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatcctcctgcacgtcggaaccagcagttcgggtaacgtttttaaccttgtccttcctggtaacccaacaccacccaggacaaacgcccccaaactcatgatttatgaactcactaacgcggccgtcgggtactttctgtctcgtcttctcgtgctacacgtccgtcaacgtccggccttcccgtagacctaattccgtcgtcgggctaccgacggtacgtcggaacgggacggacggtactacgttaacttacttacgttgtttcgtctactaattacgtacgtaaggttaggttaagttagggtttggggttacggttcgggacgggtacggaccgtaacgtcgtacgtccgtaccgtaggtcgacgcccgaaggtccgtccgtccccgtacgtccgtactccgtacggttcccctaccctcgtaccg

SEQ ID NO: 261644 - DNA, 641 bp, Homo sapiens
  misc_feature: GYAE6OF02GX917.9.86.H09.1.454.CMB.1.raw
tcagtgatacgtctcacgaccggtgctcgatttagtgctatagacttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttagggtcgactcaccctgccccgattaacgttggacaggaacccttggtccttccggcgagcgggtcttttcacccgtctttatcgttacttatgtcagctattcgctactttctgactacctccagtcatcgcctcacacgccactacccttacaccgacggtccttaacgacgaacccgtaccctacccccgtaaccccaaaccaaccgacctaacttaacgccgttaccgccgtacgcccgccacgtccgttaccggtgccgttagttcggtttacccgtccccgtttctaccttcccgttcccgccttactcgtacgtacgacgttaccg

SEQ ID NO: 261645 - DNA, 744 bp, Homo sapiens
  misc_feature: GYAE6OF02GQF6A.9.86.H09.1.454.CMB.1.raw
  modified_base (258)..(258): a, c, t, g, unknown or other
  misc_feature (258)..(258): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacacgtcgatcaccatctcctgcactggaaccagcagttgggtattttaacttgtctctggtaccacaccaccagcaacgccccaaatcatgatttanagaagtctactaagccggacccgtcggggatttcgtgccttcggtcctttcgtcgtcggtcctacccgtaacggttcccgtaccaaacccgcccggtcccttaccccgtagaaacctacgttaccttccggttcgggtcccttaccgaacggtaccgtacgggaacggtacggtacggtacctacttaagttttacttacgttcggtttcgtaccgtctaagttaacgtcgtaagggttagtaaggttaggtttggggtcgttacgggcgggtaacggaacctacggtcccgtagtacccggttacgtaacgggttccgaaccgtacccggtaaggtccctacccggtcccccgtttaccgtcttacccgtaccgtttcccggttcccgttaccccttcccgtaccgtaaacggttccgttaaaccgtcccgtaacggtcgggtacggtacccgggtcgttaaccgggccgaaccgggtccgtacg

SEQ ID NO: 261646 - DNA, 752 bp, Homo sapiens
  misc_feature: GYAE6OF02H5UQE.9.86.H09.1.454.CMB.1.raw
  modified_base (431)..(431): a, c, t, g, unknown or other
  misc_feature (431)..(431): n is a, c, g, or t
tcagtgatacgtctcacgaccggtgctcgatttagtgctatagacttgggtttgggggctttgcctgggctctgctgctcctccaccctcctcactcaggacgcaggggtcctgggcccagtctgccctgactcagcctgcctccgtgtctgcgtctcctggacagtcgatccacctactctccgtgcacgtaggaaccagctagttggggttaacttttaaccgttgtaccttccgtacggtaaccaaccacccaccacggaccaaaccgaccccctaaactacctaagtcgtaactttagtacgaacgtacaactaacggcccggtacccggttcggggtactttcgtcgtcctcgtcttcgtcgtacggccttaccgacgttaccgtacaaaccgcgtccctcctagaacttactcgtcgtcggtccncgaacgcgtacggaacggacggacgtccttaattaacgttaactttcgtcgttacgtactacttaagtaacgttaacgagggtttaaaggtaaggtttgggtttacgggggttcggttccggggacggaacgggtaaacccgtaggtaccgtcgggtaaacccgttcggtacggtaaccgaaccggtacccggtaacgggtcccgttcccgtaccccgttacgggaccttaccgttccgtaccgttaccccctacctccgtacgaacgtaccgtactcggtacgagggtccggtaccgtggacggtacggacgtcgtaacg

SEQ ID NO: 261647 - DNA, 702 bp, Homo sapiens
  misc_feature: GYAE6OF02HK6LF.9.86.H09.1.454.CMB.1.raw
  modified_base (237)..(237): a, c, t, g, unknown or other
  misc_feature (237)..(237): n is a, c, g, or t
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcagtgatggttgggagttatgtaccttgtctcctggtaccaacngccacccgaggacaaacgccccaaactcatctatttatgaggtcactaagcgccctcgtaggggtttctacgttcgtcttctcgtcggctccgaacgtctacgaaccaacgaccggtccctacccgtgtaacctaacttccttcgtcgggcctccgacgggtctaggacgggaccggacggtcgttagtaactttacgtttacgtgcgtcgtccttaacattatcgactaggtaacgttggtactaccgtaccgtccggttaggttacggttccggggaccgggtaacgggtaacccggtaagggttacccggtacccgggtttacccggtaacgggtaccgaacccgggtacccggaacgggtcccgtacccggtccccccggttaccgttcccgtcctttacccggtttaccccttccccgtacccccgtacccttaccggtaaccgtaccgtacctacccgg

SEQ ID NO: 261648 - DNA, 829 bp, Homo sapiens
  misc_feature: GYAE6OF02G7TVP.9.86.H09.1.454.CMB.1.raw
tcagtgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactcggaaccagctagttcggggtatttttaaccttgtctccgtacggtaaccaacacccacccaggccaaaacgcccccaaaactcaatgtatttatagaagtcaacgtaacgccggtccccgtggggtactttcgtcgctcgtcttcctcgtcggaccttaccgtaacggtcccgtaacgtaaccgaccgggtcccctcccgtacgtaaccttaacgttttccgtcgggtcccgttaccgacggtacgtagggaaccgggaacggtacgggtccttaacgtaagtttaacgtttaccgttggttccggtacttacctaatttaacgttaacggttaagggtttaacggtttaaagggttttagggtttacgggggtttcggggtttaccgggggtaaccggggtaacggggtaacccggtaaacggtcccgttaaccgggtacccggttacccgttaccgggtaaccgaaccggtaacccggtaaccgggtcccgtaccccgtacccccggtttcgtacccgttaccgttcccgtttcccggttaccccctcccgttcccgtaccgtaaccggtccggttaactaccggtaccgtcgggtaaccggtcgggttaccggacggtaccggacgggcgtacgtaacgg

SEQ ID NO: 261649 - DNA, 701 bp, Homo sapiens
  misc_feature: GYAE6OF02G25RE.9.86.H09.1.454.CMB.1.raw
  modified_base (181)..(181): a, c, t, g, unknown or other
  misc_feature (181)..(181): n is a, c, g, or t
  modified_base (202)..(202): a, c, t, g, unknown or other
  misc_feature (202)..(202): n is a, c, g, or t
  modified_base (531)..(531): a, c, t, g, unknown or other
  misc_feature (531)..(531): n is a, c, g, or t
  modified_base (546)..(546): a, c, t, g, unknown or other
  misc_feature (546)..(546): n is a, c, g, or t
  modified_base (652)..(652): a, c, t, g, unknown or other
  misc_feature (652)..(652): n is a, c, g, or t
tcagtgatacgtctcacgaccggtgctcgatttagtgctatagacgttgggtttgggggctttgcctgggctctgctgctcctcaccctcctcactcaggacgcagggtcctggcccagtctgcctgactcagcctgcctccgtgtcgtcgggtctaccgtggacaggtcactccaacctntccgtctgcaacgtggaaccngcgtagtcgagttcggtagggtactttagtcgtaaccgtttgtccgtacgtaacggtaaacccaacgacggtacccaaccggtaagggaaaccctaaaacccggaaccccctaaacgttacaactttaacgtaagttttaacgacggtaacgtacgtaaaccgtaacggcccgtaccgtacgggttacgggtttaccttagttccgtacgtttaccggtctccggtaccttacgaacgttccgacgaacctaacgccggtccctacgtagaactatcgacgtcggactcgaggtctaggacgtagacgtctagttattacgtcgacgtntacgtctatacgtancgtaacgtagtcgttagaccgttacgtaccgttcggttagtacggtcgggacgtaacggaccgtaaggtccgacgtagcgtacacgtagacggcctccgacccgtntcctactccgtaccctacgaccctcgtaacgccggtaactgtactacgg

SEQ ID NO: 261650 - DNA, 745 bp, Homo sapiens
  misc_feature: GYAE6OF02JXIT5.9.86.H09.1.454.CMB.1.raw
  modified_base (173)..(173): a, c, t, g, unknown or other
  misc_feature (173)..(173): n is a, c, g, or t
  modified_base (191)..(191): a, c, t, g, unknown or other
  misc_feature (191)..(191): n is a, c, g, or t
  modified_base (711)..(711): a, c, t, g, unknown or other
  misc_feature (711)..(711): n is a, c, g, or t
  modified_base (734)..(734): a, c, t, g, unknown or other
  misc_feature (734)..(734): n is a, c, g, or t
tcagtgatacgtctcacgaccggtgctcgatttagtgctatagacttggggtttggggggctttgcctgggctctgctgctcctcaccctcctcactcaggacgcagggtcctgggcccagtcctcgccctgactcgagcctgtcctcgtgtctgcgttctctggacagtcgntccacctattcctccgtnaccacgtaggaaacctaggctaagttcggggttaactttttaacctcggttctccgtacggtaaccaaaccacccgaacccgaggaacctaaaaccggtaccccctaaaatcctagttagtattttagagtaacgttacaaccgtaacggccggtaccgtaccgggtaatttccgtagacctacgtcttcgtattaccgcctacgtacggttccgaccggaacgtacccgggtcctacctaacggtacctaatccgtacgtcgtaccgtacgtaagtcgaggaccgtacggaccgttactaacttacgttattaccgtgggtttctaaccgtctaacgttaagtacggttacgggtaattaagggttacgggtttcggttcgggttaaaccggcggtaacgggtaactcgtaaaccgttcctccgtacgtaacggtccgaaaccgcgtaaccgttaccgtccgacccgtttcctaccggcgttaccccgcgttcccgtcctaactcggaactcggttaancccgtgaccgtcggacgtcgacncgtagtacacg

SEQ ID NO: 261651 - DNA, 934 bp, Homo sapiens
  misc_feature: GYAE6OF02HLDDH.9.86.H09.1.454.CMB.1.raw
tcagtgatacgtctcacgaccggtgctcgatttagtgctatagacttgggtttgggggggggtcacaagaggcagcgctctcgggacgtctccaccatggcctgggctctgactgctcctcaccctcctcactcaggacgcagggtcctggcccagtctcgccctgactcacgcctgcctccgtgtctgccgtctccgtggacagtcgataccaccatcctcctgaccgtacgtacggaaccagtacctaggtttacggggttaacttttttaacctcgttcccgttaccgttacggttaccccaaacccgtaaccccgtaaccccgtaacgggaccaaaaccccggtaaccccccaaaacgtaccgtacgtacgttaacgtttaagtacggtaaaccggtaccgtaaacggttaaccgggcccgggtaccccggtttacggggttaactttccggtacgtaccgttcgttaccgttccgtccggtcgtcccgttacggtaacccggttacccgtaaccgtaaccggtaccccggtccccggttaccctaaacgtaccgtaacgttccggttaccgtacgggtcccttaccgtacgtaacgggtacgggaaacggttaaccggtacggtacccttaaatttaaacgtttacgttttacgtacgggtttacgtcccgtttaacgtacgtttaaacgggtaacgttaggggttaacgtttaacgggttttaaacgggtttggggttacggggtttaccgggggaccgggtaacgggtaacccgggtaaaaggttccgggttaccgttaacccggttccggttaaccgggtacccggtaacccgggaacgttaacccggcggttccccgttaccccggtacggtccgttacccgttccgttaccccgggtaccccgtttcccgttaccggtaaccgg

SEQ ID NO: 261652 - DNA, 542 bp, Homo sapiens
  misc_feature: GYAE6OF01EG4Q5.9.1.A01.1.454.CMB.1.raw
tcagtgatacgtctcacgaccggtgctcgatttagacgtctcatcaaaggaaggaagggggggtctcaggaggcagcgctctcgggacgtctccaccatggcctgggctctgctattcctcaccctcctcactcagggcacagggtcttgggcccagtctgccctgactcagcctgcctccgtgtctgggtctcctggacagtcggtagccatctcctgcactggaactaacagtgacgttggtgctttaataattatgtctcctggtatcaacaacaccaggcaaacgcccccaactcattatttctgatgtcaacaatccggcccccagggatttctgatcgcttctctgctccaagtctggcaacacggcctccctgaccatctcgtgggcctccgggctggaggacgaggtcctcacttattactgcagctcatactaacaacacgcactacttctggttgttcggcggaggactagacgtcgtaccgtccgtaggtaccacgacccgaacggcctaccggcccctcggtcctacccg

SEQ ID NO: 261653 - DNA, 301 bp, Homo sapiens
  misc_feature: GYAE6OF01AH8ZU.9.1.A01.1.454.CMB.1.raw
  modified_base (296)..(301): a, c, t, g, unknown or other
  misc_feature (296)..(301): n is a, c, g, or t
tcagtgatacgtctcacgaccggtgctcgatttagacgtctcatcaggggaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttcccgcatctgaagacgtatcactgagcgggctggcaaggcgcatagnnnnnn
